US009815723B2

(12) United States Patent
Jaffe et al.

(10) Patent No.: US 9,815,723 B2
(45) Date of Patent: Nov. 14, 2017

(54) METHODS AND COMPOSITIONS FOR NITROGEN REMOVAL USING FEAMMOX MICROORGANISMS

(71) Applicant: The Trustees of Princeton University, Princeton, NJ (US)

(72) Inventors: Peter R. Jaffe, Princeton, NJ (US); Shan Huang, Plainsboro, NJ (US)

(73) Assignee: THE TRUSTEES OF PRINCETON UNIVERSITY, Princeton, NJ (US)

( * ) Notice: Subject to any disclaimer, the term of this patent is extended or adjusted under 35 U.S.C. 154(b) by 0 days.

(21) Appl. No.: 14/707,700

(22) Filed: May 8, 2015

(65) Prior Publication Data

US 2015/0321933 A1 Nov. 12, 2015

Related U.S. Application Data

(60) Provisional application No. 61/990,525, filed on May 8, 2014, provisional application No. 62/058,453, filed on Oct. 1, 2014.

(51) Int. Cl.
    *C02F 3/30*      (2006.01)
    *C02F 3/34*      (2006.01)
    *C02F 101/16*    (2006.01)
    *C02F 101/00*    (2006.01)
    *C02F 101/20*    (2006.01)
    *C02F 101/30*    (2006.01)

(52) U.S. Cl.
    CPC .............. *C02F 3/341* (2013.01); *C02F 3/301* (2013.01); *C02F 3/303* (2013.01); *C02F 3/307* (2013.01); *C02F 3/346* (2013.01); *C02F 2101/006* (2013.01); *C02F 2101/16* (2013.01); *C02F 2101/20* (2013.01); *C02F 2101/30* (2013.01)

(58) Field of Classification Search
    None
    See application file for complete search history.

(56) References Cited

U.S. PATENT DOCUMENTS

| 5,705,072 | A  | 1/1998  | Haase |
| 2011/0207061 | A1 | 8/2011  | Cantwell et al. |
| 2012/0309071 | A1 | 12/2012 | Scherson et al. |

OTHER PUBLICATIONS

Clum, Alicia; et al; "Complete genome sequence of Acidimicrobium ferrooxidans type strain (ICP)" Standards in Genomic Sciences, 1, 38-45, 2009.*
Sawayama, Shigeki; "Possibility of Anoxic Ferric Ammonium Oxidation" Journal of Bioscience and Bioengineering, 101, 70-72, 2006.*

Huang et al. "A Newly Identified Microorganism Affecting the N Cycle: Ammonium Oxidation in Iron Reducing Soils" Mineralogical Magazine, 2013, vol. 77 (5) p. 1339.
Abbassi et al. "Laboratory Study of Nitrification, Denitrification and Anammox Processes in Membrane Bioreactors Considering Periodic Aeration" Journal of Environmental Management, 2014, vol. 142, p. 53-59.
Braker et al. "Development of PCR Primer Systems for Amplification of Nitrite Reductase Genes (nirK and nirS) to Detect Denitrifying Bacteria in Environmental Samples" Appl. and Environ. Microbio., Oct. 1998, vol. 64 (10) p. 3769-3775.
Schloss and Handelsman "Introducing DOTUR, a Computer Program for Defining Operational Taxonomic Units and Estimating Species Richness" Appl. and Environ. Microbio., Mar. 2005, vol. 71 (3) p. 1501-1506
Stults et al. "Application of the 5' Fluorogenic Exonuclease Assay (TaqMan) for Quantitative Ribosomal DNA and rRNA Analysis in Sediments" Appl. and Environ. Microbio., Jun. 2001, vol. 67 (6) p. 2781-2789.
Suzuki et al. "Quantitative Analysis of Small-Subunit rRNA Genes in Mixed Microbial Populations via 5'-Nuclease Assays" Appl. and Environ. Microbio., Nov. 2000, vol. 66 (11) p. 4605-4614.
Call and Logan "Hydrogen Production in a Single Chamber Microbial Electrolysis Cell Lacking a Membrane" Environ. Sci. Technol., 2008, vol. 42, p. 3401-3406.
Coupland and Johnson, "Evidence That the Potential for Dissimilatory Ferric Iron Reduction Is Widespread Among Acidophilic Heterotrophic Bacteria" Article in FEMS Microbiol Lett, Mar. 2008, vol. 279 p. 30-35.
Clément et al. "Ammonium Oxidation Coupled to Dissimilatory Reduction of Iron Under Anaerobic Conditions in Wetland Soils" Soil Biology & Biochemistry, 2005, vol. 37 p. 2323-2328.
Call and Logan "A Method for High Throughput Bioelectrochemical Research Based on Small Scale Microbial Electrolysis Cells" Biosensors and Bioelectronics, 2011, vol. 26 p. 4526-4531.
Gilch et al. "A Soluble Form of Ammonia Monooxygenase in Nitrosomonas Europaea" Biol. Chem., Sep. 2009, vol. 390 p. 863-873.
Francis et al. "Ubiquity and Diversity of Ammonia-Oxidizing Archaea in Water Columns and Sediments of the Ocean" PNAS, Oct. 11, 2005, vol. 102 (41), p. 14683-14688.
Harms et al. "Real-Time PCR Quantification of Nitrifying Bacteria in a Municipal Wastewater Treatment Plant" MiniManuscript, Sep. 2015.
Harms et al. "Real-Time PCR Quantification of Nitrifying Bacteria in a Municipal Wastewater Treatment Plant" Environ. Sci. Technol., 2003, vol. 37 p. 343-351.
Hua et al. "Kinetics of Uranium(VI) Reduction by Hydrogen Sulfide in Anoxic Aqueous Systems" Environ. Sci. Technol., 2006, vol. 40 p. 4666-4671.
Huang and Jaffe "Characterization of Incubation Experiments and Development of an Enrichment Culture Capable of Ammonium Oxidation Under Iron-Reducing Conditions" Biogeosciences, 2015, vol. 12 p. 769-779.
Huang et al. "Distribution of Typical Denitrifying Functional Genes and Diversity of the Nirs-Encoding Bacterial Community Related to Environmental Characteristics of River Sediments" Biogeosciences Discuss., 2011, vol. 8 p. 5251-5280.

(Continued)

*Primary Examiner* — David Berke-Schlessel
(74) *Attorney, Agent, or Firm* — Volpe and Koenig, P.C.

(57) ABSTRACT

Processes and compositions for removal nitrogen, organic and inorganic contaminants from wastewater using Feammox bacterium are provided.

8 Claims, 28 Drawing Sheets

(56) References Cited

OTHER PUBLICATIONS

Huang and Jaffe "Characterization of Incubation Experiments and Development of an Enrichment Culture Capable of Ammonium Oxidation Under Iron Reducing Conditions" Biogeosciences Discuss., 2014, vol. 11 p. 12295-12321.

Hyman and Wood "Suicidal Inactivation and Labelling of Ammonia Mono-Oxygenase by Acetylene" Biochem. J., 1985, vol. 227 p. 719-725.

Nylander et al. "Bayesian Phylogenetic Analysis of Combined Data" Syst. Biol., 2004, vol. 53 (1) p. 47-67.

Smith and Waterman "Identification of Common Molecular Subsequences" J. Mol. Biol., 1981, vol. 147 p. 195-197.

Hynes et al. "Production of Nitrous Oxide by Nitrosomonas Europaea: Effects of Acetylene, Ph, and Oxygen" Can. J. Microbiol., 1984, vol. 30 p. 1397-1404.

Jensen et al. "Diversity in Methane Enrichments From Agricultural Soil Revealed by DGGE Separation of PCR Amplified 16S rDNA Fragments" FEMS Microbiol. Ecol., 1998, vol. 26 p. 17-26.

Kartal et al. "Molecular Mechanism of Anaerobic Ammonium Oxidation" Macmillan Publishers Limited, Nov. 2011, vol. 479 p. 127-132.

Keeling et al. "Geology and Characterization of Two Hydrothermal Nontronites from Weathered Metamorphic Rocks at the Uley Graphite Mine, South Australia" Clays and Clay Minerals, 2000, vol. 48. (5) p. 537-548.

Komlos et al. "Biostimulation of Iron Reduction and Subsequent Oxidation of Sediment Containing Fe-Silicates and Fe-Oxides: Effect of Redox Cycling on Fe(III) Bioreduction" Water Research, 2007, vol. 41 p. 2996-3004.

Pankratov et al. "Telmatobacter Bradus Gen. Nov., Sp. Nov., A Cellulolytic Facultative Anaerobe From Subdivision 1 of the Acidobacteria, and Emended Description of Acidobacterium Capsulatum Kishimoto et al. 1991" International Journal of Systematic and Evolutionary Microbiology, 2012, vol. 62 p. 430-437.

Laabroek et al., "Oxygen Consumption Kinetics of Nitrosomonas Europaea and Nitrobacter Hamburgensis Grown in Mixed Continuous Cultures at Different Oxygen Concentrations" Arch Microbiol, 1994, vol. 161 p. 156-162.

Komlos and Jaffe "Effect of Iron Bioavailability on Dissolved Hydrogen Concentrations During Microbial Iron Reduction" Biodegradation, 2004, vol. 15 p. 315-325.

Logan et al. "Microbial Fuel Cells: Methodology and Technology" Environmental Science & Technology, 2006, vol. 40 (17) p. 5181-5192.

Liu et al. "Reduction of Structural Fe(III) in Nontronite by Methanogen Methanosarcina Barkeri" Geochimica et Cosmochimica Acta, 2011, vol. 75 p. 1057-1071.

Madigan et al.; Appendix 1, Energy Caculations in Microbial Bioenergetics, 2002.

Margulies et al. "Genome Sequencing in Microfabricated High-Density Picolitre Reactors" Nature, Sep. 2005, vol. 437 p. 376-380.

Majzlan et al. "Thermodynamics of Iron Oxides: Part III. Enthalpies of Formation and Stability of Ferrihydrite ($\sim$Fe(OH)3), Schwertmannite ($\sim$FeO(OH)3/4(SO4)1/8), and $\epsilon$-Fe2O3" Geochimica et Cosmochimica Acta, 2004, vol. 68 (5) p. 1049-1059.

Morrison et al. "Adsorption of Uranium(VI) on Amorphous Ferric Oxyhydroxide at High Concentrations of Dissolved Carbon(IV) and Sulfur(V1)" Journal of Contaminant Hydrology, 1995, vol. 17 p. 333-346.

Pinto and Raskin "PCR Biases Distort Bacterial and Archaeal Community Structure in Pyrosequencing Datasets" PLOS ONE, Aug. 2012, vol. 7 (8) p. 1-16.

Petrie et al. "Enumeration and Characterization of Iron(III)-Reducing Microbial Communities from Acidic Subsurface Sediments Contaminated with Uranium(VI)" Applied and Environmental Microbiol, Dec. 2003, vol. 69 p. 7467-7479.

Ronquist and Huelsenbeck "MrBayes 3: Bayesian Phylogenetic Inference Under Mixed Models" Bioinformatics Applications Note, 2003, vol. 19 (12) p. 1572-1574.

Rowe et al. "Microbial Communities and Geochemical Dynamics in an Extremely Acidic, Metal-Rich Stream at an Abandoned Sulfide Mine (Huelva, Spain) Underpinned by Two Functional Primary Production Systems" Environ. Microbiol., 2007, vol. 9 (7) 1761-1771.

Rotthauwe et al. "The Ammonia Monooxygenase Structural Gene amoA as a Functional Marker: Molecular Fine-Scale Analysis of Natural Ammonia-Oxidizing Populations" Applied and Environmental Microbiology, Dec. 1997, vol. 63 (12) p. 4704-4712.

Shigeki Sawayama "Possibility of Anoxic Ferric Ammonium Oxidation" Journal of Bioscience and Bioengineering, 2006, vol. 101 (1) p. 70-72.

Schmid et al. "Molecular Evidence for Genus Level Diversity of Bacteria Capable of Catalyzing Anaerobic Ammonium Oxidation" System. Appl. Microbiol., 2000, vol. 23 p. 93-106.

Schmid et al. "Candidatus *Scalindua brodae*", Sp. Nov., Candidatus *Scalindua wagneri*", Sp. Nov., Two New Species of Anaerobic Ammonium Oxidizing Bacteria" System. Appl. Microbiol., 2003, vol. 26 p. 529-538.

Shrestha et al. "Algae of Itahari Municipality and Its Adjoining Area, Eastern Nepal" Int J Appl Sci Biotechnol, 2013, vol. 1 (1) p. 5-10.

Lawrence L. Stookey "Ferrozine—A New Spectrophotometric Reagent for Iron" Analytical Chemistry, Jun. 1970, vol. 42 (7) p. 779-781.

Smith et al. "Small-Scale, Hydrogen-Oxidizing-Denitrifying Bioreactor for Treatment of Nitrate-Contaminated Drinking Water" Water Research, 2005, vol. 39 p. 2014-2023.

Tourna et al. "Growth, Activity and Temperature Responses of Ammonia-Oxidizing Archaea and Bacteria in Soil Microcosms" Environmental Microbiology, 2008, vol. 10 (5) p. 1357-1364.

Yang et al. "Nitrogen Loss From Soil Through Anaerobic Ammonium Oxidation Coupled to Iron Reduction" Nature Geoscience, Jul. 2012, vol. 5 p. 538-541.

Van de Graaf et al. "Autotrophic Growth of Anaerobic Ammonium-Oxidizing Micro-Organisms in a Fluidized Bed Reactor" Microbiology, 1996, vol. 142 p. 2187-2196.

Yoshinari et al. "Acetylene Inhibition of Nitrous Oxide Reduction and Measurement of Denitrification and Nitrogen Fixation in Soil" Biochem., 1977, vol. 9 p. 177-183.

Zhang et al. "Microbial Reduction of Iron(III)-Rich Nontronite and Uranium(VI)" Geochimica et Cosmochimica Acta, 2009, vol. 73 p. 3523-3538.

Hsi et al. "Adsorption of Uranyl Onto Ferric Oxyhydroxides: Application of the Surface Complexation Site-Binding Model" Geochim. Cosmochim. Acta., 1985, vol. 49 p. 1931-1941.

International Search Report and Written Opinion for International Application No. PCT/US15/29961, dated May 8, 2015.

\* cited by examiner

METHODS AND COMPOSITIONS FOR NITROGEN REMOVAL USING FEAMMOX MICROORGANISMS

CROSS REFERENCE TO RELATED APPLICATION

This application claims the benefit of U.S. provisional patent application No. 61/990,525, filed May 8, 2014; and claims the benefit of U.S. provisional application No. 62/058,453, filed Oct. 1, 2014; both of which are incorporated herein by reference as if fully set forth.

GOVERNMENT SUPPORT

This invention was made with government support under Grant No. DE-SC0006847 awarded by the Department of Energy and Grant No. CBET-1433101 awarded by the National Science Foundation. The government has certain rights in this invention.

The Sequence Listing titled "Sequence$_{13}$Listing," having a file size of 2,817,927 bytes, created on May 8, 2015 and filed herewith is incorporated herein by reference as if fully set forth.

FIELD

The disclosure relates to processes and compositions for removal nitrogen and other contaminants from wastewater using Feammox bacteria.

BACKGROUND

The removal of nitrogen and other contaminants from water is an important environmental task. Wastewater treatment plants in the developed world and in many developing countries oxidize $NH_4^+$ to $NO_3^-$ before discharging the treated wastewater. This is done to decrease oxygen demand in the receiving waters.

Additionally, nitrogen excess in near shore environments has been identified as a major environmental problem leading to eutrophication and anoxia. Legislations are being implemented requiring the conversion of $NO_3^-$ to $N_2$ in conventional waste water treatment plants. The nitrogen compounds that are present in contaminated water, such as ammonium $NH_4^+$, nitrite ($NO_2^-$) and nitrate ($NO_3^-$) will have to be converted to elemental nitrogen $N_2$, which can be released in the gaseous state into an open environment.

Nitrogen removal via nitrification and denitrification can be performed by microrganisms. Numerous studies have focused on the aerobic oxidation of ammonia or $NH_4^+$ to first nitrite ($NO_2^-$) and then nitrate ($NO_3^-$). Oxidation of $NH_4^+$ to $NO_2^-$ is the first and rate limiting biological step in the nitrification, and also a required step prior to anaerobic $NH_4^+$ oxidation (anammox), which is the biological conversion of $NH_4^+$ and $NO_2^-$ to nitrogen gas in the absence of oxygen. Anammox is the most common anaerobic $NH_4^+$ oxidation pathway in soils environments known so far, using $NO_2^-$ as the electron acceptor. Anaerobic $NH_4^+$ oxidation is performed by anammox bacteria. Aerobic $NH_4^+$ oxidation is performed by two groups of organisms, ammonia-oxidizing bacteria (AOB), and ammonia-oxidizing archaea (AOA).

In the wastewater treatment plants, biological ammonium oxidation is conducted by aerobic nitrifying bacteria and requires aeration in the step with the highest energy input. An alternative is the partial nitrification (nitritation) Anammox system, which has been implemented in some treatment plants, with the goal of saving energy costs, since only half of the $NH_4^+$ is converted to $NO_2^-$ aerobically. However, these Anammox based wastewater treatment systems need to operate between 28° C. and 35° C.

An $NH_4^+$ oxidation process coupled to iron (Fe) reduction called Feammox was identified (Clement J C et al. 2005 Soil Biol Biochem 37:2323-2328; Sawayama S. 2006; J Biosci Bioeng 101:70-72; Shrestha J et al. 2009 Soil Sci 174:156-164; Yang W H et al. 2012 Nat Geosc 5: 538-541, all of which are incorporated herein by reference as if fully set forth). Feammox is a process that can be described as the oxidation of $NH_4^+$ in the absence of molecular oxygen, with iron oxides [Ferric iron, Fe(III)] as the electron acceptor. In this reaction Fe(III) is reduced to Ferrous iron Fe(II), while $NH_4^+$ is transformed to $NO_2^-$, nitrogen gas ($N_2$), or other nitrogen forms. Feammox may provide benefits for development of an improved system that does not require aeration or heating of the wastewater in temperate climates.

SUMMARY

In an aspect, the invention relates to a composition. The composition includes Feammox bacteria and at least one of soil, wastewater, or a carrier. The Feammox bacteria are capable of oxidizing ammonium coupled with reduction of Fe(III) to Fe(II) and a carrier.

In an aspect, the invention relates to a system. The system includes a reactor and a composition that includes a Feammox bacterium and at least one of soil, wastewater or a carrier. The Feammox bacterium is capable of oxidizing ammonium coupled with reduction of Fe(III) to Fe(II).

In an aspect, the invention relates to a process for removing a nitrogen contaminant from wastewater. The process includes mixing the wastewater with Feammox bacteria.

In an aspect, the invention relates to a process for removing a nitrogen contaminant in a soil or groundwater system. The process includes adding Feammox bacteria to the soil or groundwater system.

BRIEF DESCRIPTION OF THE DRAWINGS

The following detailed description of the preferred embodiments of the present invention will be better understood when read in conjunction with the appended drawings. For the purpose of illustrating the invention, there are shown in the drawings particular embodiments. It is understood, however, that the invention is not limited to the precise arrangements and instrumentalities shown. In the drawings:

FIG. 12A illustrates the total variance in the bacterial abundance and the cumulative variance of the bacteria-environment relationship. FIG. 12B illustrates the total variance in the microbial composition and the cumulative variance of the bacteria-sampling location relationship.

FIG. 19A illustrates growth of the A6 bacterium in the liquid medium. FIG. 19B illustrates A6 growth on the solid inorganic $NH_4^+$-ferric iron medium. FIGS. 19C-19D show rod-shaped A6 cells.

DETAILED DESCRIPTION OF THE PREFERRED EMBODIMENTS

Figure 1A:
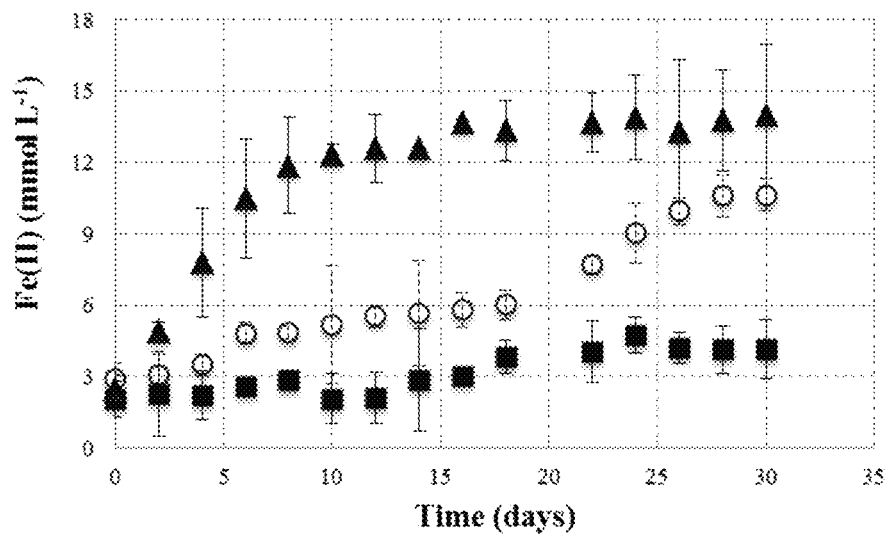
FIGS. 1A-1B illustrate concentration of Fe(II) (FIG. 1A) and $NH_4^+$ (FIG. 1B) in incubation with three different Fe(III) sources: ferrihydrite (open circle), ferric chloride (closed square), and ferric citrate (closed triangle).

Certain terminology is used in the following description for convenience only and is not limiting. The words "right," "left," "top," and "bottom" designate directions in the drawings to which reference is made. The words "a" and "one," as used in the claims and in the corresponding portions of the specification, are defined as including one or more of the referenced item unless specifically stated otherwise. This terminology includes the words above specifically mentioned, derivatives thereof, and words of similar import. The phrase "at least one" followed by a list of two or more items, such as "A, B, or C," means any individual one of A, B or C as well as any combination thereof.

"Synthetic nucleic acid sequence," "synthetic polynucleotide," "synthetic oligonucleotide," "synthetic DNA," or "synthetic RNA" as used herein refers to a nucleic acid, polynucleotide, oligonucleotide, DNA, or RNA that differs from one found in nature by having a different sequence than one found in nature or a chemical modification not found in nature. The definition of synthetic nucleic acid includes but is not limited to a DNA sequence created using biotechnology tools. Such tools include but are not limited to recombinant DNA technology, chemical synthesis, or directed use of nucleases (so called "genome editing" or "gene optimizing" technologies).

An embodiment provides a composition that comprises a Feammox bacterium. The composition may also include a carrier. The Feammox bacterium may be capable of oxidizing ammonium coupled with reduction of Fe(III) to Fe(II). The Feammox bacterium may be capable of conversion of ammonium to nitrite. The Feammox bacterium may be an Acidimicrobiaceae bacterium or a bacterium with a similar genetic composition. The Feammox bacterium may be a bacterial strain that was isolated from wetland soils collected in New Jersey after a series of enrichment incubations. The soil samples were collected at the location identified as 40°15'N-74°30' W or within 100 m of the identified location. The Feammox bacterium may be the bacterial strain designated the Acidimicrobiaceae Feammox bacterium A6 and described herein. The Acidimicrobiaceae Feammox bacterium A6 was submitted for deposit with the American Type Culture Collection (ATCC; 10801 University Blvd. Manassas, Va. 20110-2209, USA) on Apr. 27, 2015, and the submission was supplemented on May 7, 2015. The Acidimicrobiaceae Feammox bacterium may have a genome comprising, consisting essentially of, or consisting of a nucleic acid sequence with at least 70, 72, 75, 80, 85, 90, 91, 92, 93, 94, 95, 96, 97, 98, 99, or 100% identity to SEQ ID NO: 1. The Feammox bacterium may have the genome size of 3.3 mega base pairs (Mb) and guanine-cytosine content 52%. The bacterial genome may further include a gene encoding a Feammox Ammonium Monooxygenase. As used herein, the term "Feammox Ammonium Monooxygenase" (FMO) refers to an enzyme that plays a key role in oxidizing ammonium coupled with ferric iron reduction. The gene may include a nucleic acid comprising, consisting essentially of, or consisting of a nucleic acid sequence with at least 70, 72, 75, 80, 85, 90, 91, 92, 93, 94, 95, 96, 97, 98, 99, or 100% identity to SEQ ID NO: 8. The Feammox bacterium may be live or lyophilized.

Determining percent identity of two nucleic acid sequences may include aligning and comparing the nucleotides at corresponding positions in the two sequences. If all positions in two sequences are occupied by identical nucleotides then the sequences are said to be 100% identical. Percent identity may be measured by the Smith Waterman algorithm (Smith TF, Waterman MS 1981 "Identification of Common Molecular Subsequences," J Mol Biol 147: 195 -197, which is incorporated herein by reference as if fully set forth).

In an embodiment, the composition may include wastewater. As used herein, the term "wastewater" refers to any water that has been adversely affected in quality by anthropogenic influence. Wastewater may be municipal wastewater, industrial wastewater, agricultural wastewater, surface runoff, stormwater, or wastewater combining wastewater from multiple sources. Wastewater may be treated in a wastewater treatment plant. Wastewater may include nitrogen contaminants. As used herein, the term "contaminant" refers to compounds that are not occurring in water naturally, pose health or ecological risks and are subject to state and federal regulation. Nitrogen contaminants may be an ammonium containing contaminant. The ammonium containing contaminant may be but is not limited to an industrial, agricultural, or human municipal waste. The ammonium containing contaminants may be included but are not limited to fertilizers, domestic sewage, or industrial effluents. The ammonium containing contaminant may be ammonium chloride. The ammonium containing contaminant may be a nitrogen containing organic compound, wherein nitrogen may be hydrolyzed to ammonium.

Wastewater may include at least one more contaminant. The at least one more contaminant may be inorganic contaminants. Inorganic contaminants may be but are not limited to heavy metals, radionuclides or trace metals. Inorganic contaminants may be copper, uranium, ferric iron, lead, zinc, arsenic, chromium, mercury or silver. The at least one more contaminant may be organic contaminants. The organic contaminants may be but are not limited to chlorinated volatile organic compounds, perchloroethylene (PCE), trichloroethylene (TCE), trichloroethane, dichloroethane, vinyl chloride, polychlorinated biphenyls, fuel constituents, benzene, ethylbenzene, toluene, xylene, phenanthrene, methyl tert butyl ether, tertiary butyl alcohol, polyaromatic hydrocarbons, or ethylene dibromide.

In an embodiment, the ammonium containing contaminant may be added to a composition that would otherwise be low or deficient in ammonium when reactions in addition to or in place of ammonium oxidation are of interest.

The composition may further include a source of ferric iron. The source may be but is not limited to a ferrihydrite, a goethite, an elemental iron, a nontronite or an iron-rich clay. As used herein, the term "ferrihydrite," or hydrated ferric iron oxide, refers to a dark brown or yellow brown mineral composed of about 20% ($FeO_4$) and 80% ($FeO_6$) polyhedral. The term "goethite" refers to an iron oxyhydroxide containing ferric iron. The term "nontronite" refers to the Fe(III) rich clay mineral having a typical structural formula $Ca_{0.5}(Si_7Al_{0.8}Fe_{0.2})(Fe_{3.5}Al_{0.4}Mg_{0.1})O_{20}(OH)_4$. The source may be scrap metal, or any other source of ferric iron.

In an embodiment, the composition may include a carrier. The carrier may support growth of the Feammox bacterium. The carrier may be but is not limited to a filter, beads, agarized medium, or any surface that allows bacterial attachment. The carrier may include media for culturing the Feammox bacterium. The media may be inorganic $NH_4^+$-ferric iron media. The inorganic $NH_4^+$-ferric iron media may be solid media or liquid media. The liquid media may include but not limited to the following components: $NH_4Cl$, $(NH_4)_2SO_4$, $NaHCO_3$, $KHCO_3$, $KH_2PO4$, 100 mg $MgSO_4.7H_2O$, and $CaCl_2.2H_2O$. The liquid media may further include ferrihydrite, AQDS, trace element solution or vitamins. Vitamins may be but are not limited to ATCC® vitamins. The liquid media may have a pH in a range from 4.0 to 5.0. The media may include traces of dissolved oxygen. The solid medium may have the same composition as the liquid media but include elements to solidify the mixture. The solid media may be solidified with 0.8% agar. The solid media may include ferrihydrite that is spread on the surface of the medium.

Figure 11:
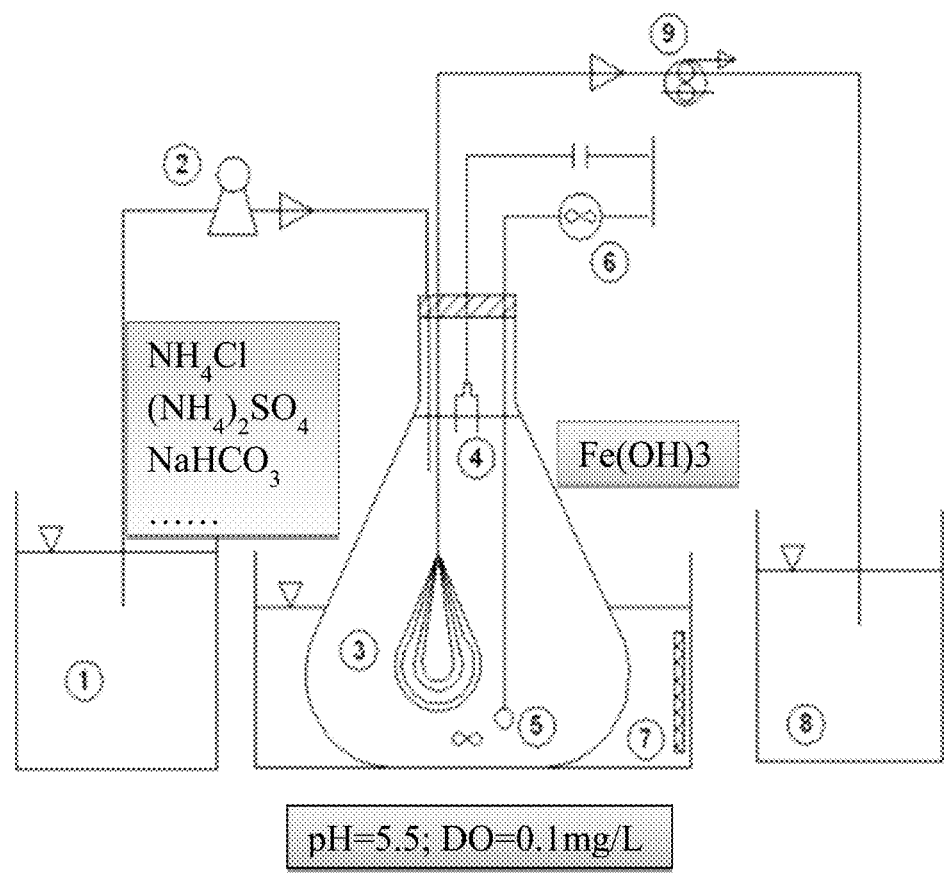
FIG. 11 illustrates a schematic representation of a membrane reactor for $NH_4^+$ oxidation via Feammox.
Figure 29:
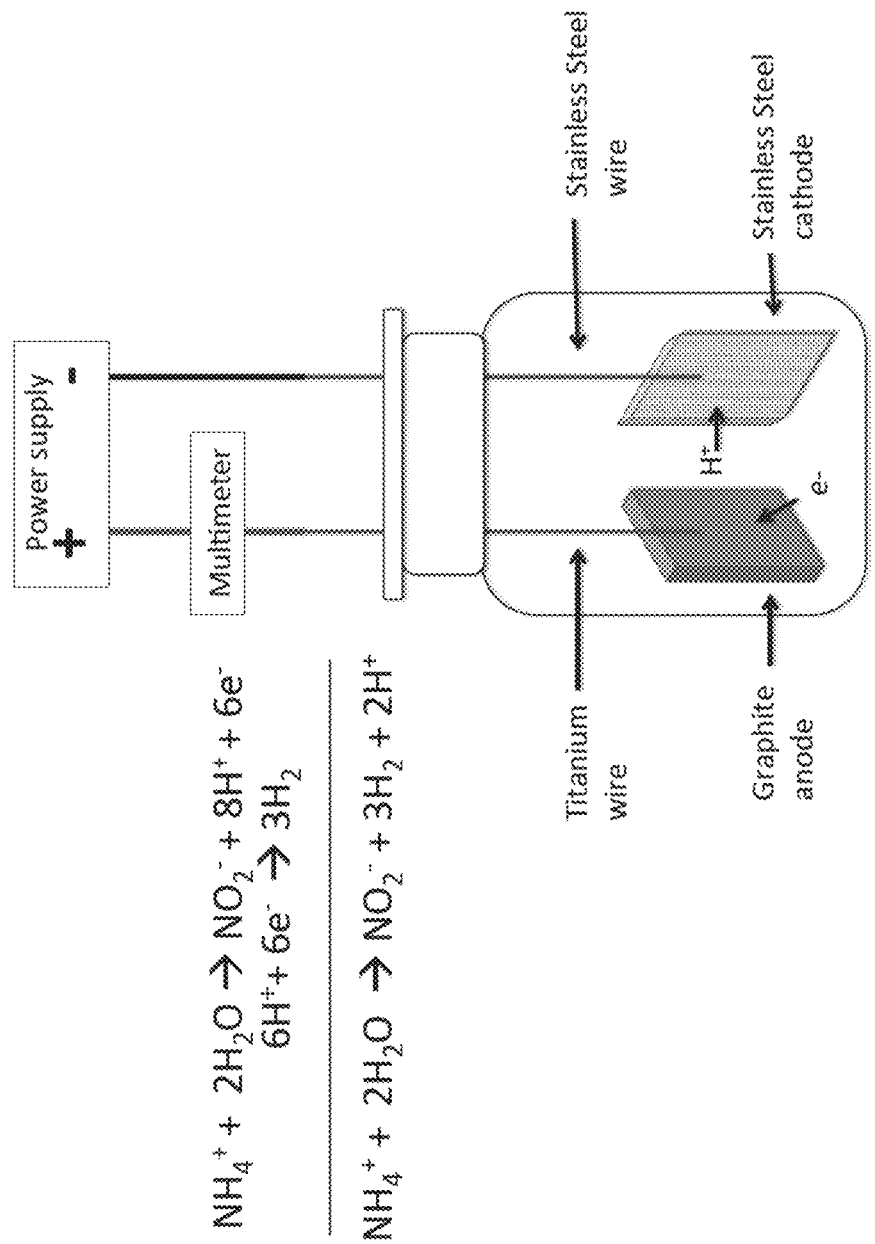
FIG. 29 illustrates a scheme of the electrogenic microbial reactor.

In embodiment, a system is provided. The system may include a reactor and any composition herein. The reactor may be a continuous membrane reactor or a sequential batch reactor. In a non-limiting example the continuous membrane reactor may be a reactor illustrated in FIG. 11. FIG. 11 illustrates a scheme of a membrane reactor for $NH_4^+$ oxidation via Feammox. Referring to FIG. 11, 1 refers to the feed solution, 2 refers to the feed pump, 3 refers to the membrane module, 4 refers to the floater connected to an electrical on/off switch, 5 refers to the ceramic diffuser, 6 refers to the $N_2$ supplier, 7 refers to the water bath, 8 refers to outflow, and 9 refers to the outflow pump. The reactor may be an electrogenic microbial reactor. The electrogenic microbial reactor may be any bioelectrochemical system that extracts energy from a substrate (Call and Logan 2011 Biosen. Bioelectron. 26(11): 4526-4531, which is incorporated herein by reference as if fully set forth). The electrogenic microbial reactor may be any bioelectrochemical system that extracts energy from a substrate (Call and Logan 2011 Biosen. Bioelectron. 26(11): 4526-4531, which is incorporated herein by reference as if fully set forth). In the bioelectrochemical system, electrons may be harvested biologically, and then transferred to the anode that functions as the terminal electron acceptor for the microorganisms in the system, and $H_2$ is produced at the anode. The electrogenic microbial reactor may be a Microbial Fuel Cell (MFC) or Microbial Electrolysis cell (MEC). A non-limiting example of the electrogenic microbial reactor is illustrated in FIG. 29. Referring to FIG. 29, the reactor includes a tank, a graphite anode connected via titanium wire to the positive terminal of the power supply, a stainless steel. cathode connected via stainless steel wire to the negative terminal of the power supply. MECs require a small potential applied from an external power source ($E_{AP}$>0.25 V), resulting in $H_2$ production at the anode (Logan, Hamelers et al. 2006 *Environ. Sci. Technol.* 40(17):5181-5192; Call and Logan 2008 *Environ. Sci. Technol.* 42(9):3401-3406; Call and Logan 2011, all of which are incorporated by reference herein as if fully set forth).

In an embodiment, a reactor may be an industrial-type reactor. The reactor may operate within a water treatment plant. The reactor may be a treatment pond or a reservoir. The reactor may be a tank for wastewater storage.

An embodiment provides an isolated Feammox bacterium capable of oxidizing ammonium coupled with reduction of Fe(III) to Fe(II) and designated Acidimicrobiaceae Feammox bacterium A6 (also referred to herein as Acidmicrobiaceae bacterium A6, Feammox bacterium, A6, isolate A6, or A6 isolate). The Acidimicrobiaceae Feammox bacterium A6 was submitted for deposit with the American Type Culture Collection (ATCC; 10801 University Blvd., Manassas, Va. 20110-2209, USA) on Apr. 27, 2015, and the submission was supplemented on May 7, 2015. The bacterium may have a genome comprising, consisting essentially of, or consisting of a nucleic acid sequence with at least 70, 72, 75, 80, 85, 90, 91, 92, 93, 94, 95, 96, 97, 98, 99, or 100% identity to a reference sequence selected from the group consisting of SEQ ID NO: 1. The bacterium may contain a gene comprising, consisting essentially of, or consisting of a nucleic acid sequence with at least 70, 72, 75, 80, 85, 90, 91, 92, 93, 94, 95, 96, 97, 98, 99, or 100% identity to a reference sequence selected from the group consisting of: SEQ ID NO: 8.

An embodiment provides a synthetic nucleic that encodes an enzyme capable of oxidizing ammonium coupled with iron reduction. The enzyme may be Feammox Ammonium Monooxygenase (FMO). The synthetic nucleic acid may comprise consists essentially of, or consists of a sequence with at least 70, 72, 75, 80, 85, 90, 91, 92, 93, 94, 95, 96, 97, 98, 99, or 100% identity to a reference sequence selected from the group consisting of: SEQ ID NO: 8.

An embodiment provides an expression cassette that includes any synthetic nucleic acid described herein. The expression cassette may include the synthetic nucleic acid encoding the FMO. The expression cassette may be introduced into a vector. Suitable vectors may be cloning vectors, transformation vectors, expression vectors, or virus-based vectors. The expression cassette portion of a vector may further include a regulatory element operably linked to a synthetic nucleic acid encoding the FMO. In this context, operably linked means that the regulatory element imparts its function on the synthetic nucleic acid. For example, a regulatory element may be a promoter, and the operably linked promoter would control expression of the synthetic nucleic acid.

The expression of a synthetic nucleic acid encoding the FMO from the expression cassette may be under the control of a promoter which provides for transcription of the synthetic nucleic acid in a host. The promoter may be a constitutive promoter or, tissue specific, or an inducible promoter. A constitutive promoter may provide transcription of the nucleic acid throughout most cells and tissues of the host and during many stages of development but not necessarily all stages. An inducible promoter may initiate transcription of the synthetic nucleic acid sequence only when exposed to a particular chemical or environmental stimulus. A tissue specific promoter may be capable of initiating transcription in a particular host tissue. The promoter may provide transcription of a synthetic nucleic acid having a sequence with at least 70, 72, 75, 80, 85, 90, 91, 92, 93, 94, 95, 96, 97, 98, 99, or 100% identity to a reference sequence of SEQ ID NO: 8 and expression of the FMO that is capable of oxidizing ammonium coupled with iron reduction.

In an embodiment, any one of the vectors or expression cassettes described herein may be introduced to a host. The host may be but is not limited to a bacterium, plant, algae, or yeast.

In an embodiment, a process for treating wastewater is provided. The process may be implemented to remove a nitrogen contaminant. The process may be implemented to remove at least one more contaminant from the wastewater. Removal may be reduction or complete removal of the nitrogen contaminant or the at least one more contaminant described herein. The process may include mixing the wastewater with Feammox bacteria. The mixing may occur in a reactor. The process may occur in the absence of oxygen. The process may include removing oxygen. As used herein, "absence of oxygen" may include a complete lack of oxygen, low levels of oxygen and oxygen levels below detection. Absence of oxygen may include low oxygen concentrations that allow for iron reduction. The process may be run at 2 mg/l of dissolved oxygen or less. The process may be run at 0.5 mg/l of dissolved oxygen. Absence of oxygen may be 2 mg/l of dissolved oxygen or less. Absence of oxygen may be 0.5 mg/l of dissolved oxygen or less. The process may include creating low levels of oxygen. Low levels of oxygen may be created by organisms degrading organic carbon when oxygen is consumed by organisms degrading organic carbon, and no or insufficient aeration is provided to compensate for low levels of oxygen. The process may include maintaining low levels of oxygen. The nitrogen contaminant may contain ammonium. The Feammox bacteria may oxidize ammonium under conditions suitable for oxidizing ammonium. The process of oxidizing ammonium may be coupled with reduction of Fe(III) to Fe(II). The process may include providing a source of ferric iron. The source of ferric iron may include 1 mM to 200 mM ferric iron. The concentration of ferric iron may be from 1 mM to 2 mM, from 2 mM to 3 mM, from 3 mM to 4 mM, from 4 mM to 5 mM, from 5 mM to 6 mM, from 6 mM to 7 mM, from 7 mM to 8 mM, from 8 mM to 9 mM, from 9 mM to 10 mM, from 10 mM to 20 mM, from 20 mM to 30 mM, from 30 mM to 40 mM, from 40 mM to 50 mM, from 50 mM to 60 mM, from 60 mM to 70 mM, from 70 mM to 80 mM, from 80 mM to 90 mM, from 90 mM to 100 mM, from 100 mM to 150 mM, or from 150 mM to 200 mM. The concentration of ferric iron may be any one integer value selected from those including and between 1 mM to 200 mM. The concentration of ferric iron may be less than 1 mM. The concentration of ferric iron may be up to 200 mM. The conditions may include a temperature in a range from 4° C. to 35° C. The temperature may be in a range between any two integer value temperatures selected from 4° C. to 35° C. The temperature may be in a range between and including 4° C. to 10° C., 10° C. to 15° C., 15° C. to 20° C., 20° C. and 25° C., 25° C. and 30° C., 30° C. and 35° C. The temperature may be any one integer value temperature selected from those including and between 4° C. and 35° C. or 15° C. to 35° C. Temperatures between room temperature and 35° C. may be used. The temperature may be any one temperature including and between room temperature and 35° C. Temperatures between 20° C. and 35° C. may be used. The temperature may be any temperature including and between 20° C. and 25° C. The temperature may be 25° C.

The process may be performed for a period of time ranging from 2 hours to 45 days. The time period may be 5 hours, 10 hours, 15 hours, 20 hours, 1 day, 2 days, 3 days, 4 days, 5 days, 10 days, 15 days, 20 days, 25 days, 30 days, 35 days, 40 days or 45 days. The time period may be any one integer value selected from those including and between value points, endpoints inclusive. The time period may be than 40 days. The time period may be than 45 days. The time period may be less than 1 day. In continuous flow reactors or in batches, the process may last from several hours to several months. For continuous flow reactors, the time period may depend on the bacterial concentration in the inoculum. Higher bacterial concentration in the inoculum may result in a shorter remediation time. The time period may depend on hydraulic retention capacity of a continuous flow reactor. Lower retention capacity of the continuous flow reactor may result in a shorter remediation time. Hydraulic residence time for the continuous flow reactors may be from 3 hours to 4 hours, from 3 hours to 5 hours, from 3 hours to 6 hours, from 3 hours to 7 hours, from 3 hours to 8 hours, from 3 hours to 10 hours, from 3 hours to 15 hours, from 3 hours to 20 hours, from 3 hours to 1 day, from 3 hours to 2 days, from 3 hours to 3 days. Hydraulic residence time may be any integer value selected from those including and between value points, endpoints inclusive.

The conditions may include a pH in a range from 2.0 to 7.5. The pH may be in a range between and including 2.0 and 3.0, 3.0 and 4.0, 4.0 and 5.0, 5.0 and 6.0, 6.0 to 7.0, 7.0 to 7.5. The pH may be any one integer value pH selected from those including and between 2.0 and 7.5. The pH may be any pH including and between 4.0 and 7.0. The pH may be 4.5.

In an embodiment, the at least one more contaminant that may be removed in the process described herein may be but is not limited to a metal, a heavy metal, a radionuclide, and a trace metal. The at least one more contaminant may be but is not limited to at least one of ferric iron, uranium, zinc, or copper. Ferric iron, Fe(III), may be converted to ferrous iron, Fe(II). Aqueous uranium, U(VI), may be converted to U(IV) solids. Copper, Cu(II), may be converted to Cu(I). The at least one more contaminant that may be removed in the process described herein may be but is not limited to trichloroethylene (TCE), perchloroethylene (PCE), benzene, ethylbenzene, toluene, phenanthrene, or a polyaromatic hydrocarbon.

In an embodiment, the process may include any reactor described herein. The process may include any other reactor suitable for growth of the Feammox bacterium.

In an embodiment, the process may have nitrification and denitrification phases. The process may include a nitrification phase followed by a denitrification phase. The nitrification and denitrification phases may be performed in parallel. The parallel performance of nitrification and denitrification phases may occur at low levels of oxygen. The nitrification and denitrification phases may be performed in the same location. The same location may be a reactor. The reactor utilized in the process may be configured to allow a nitrification phase and a denitrification phase. There may be two separate reactors for each of the nitrification and denitrification phases. The process may further include adding Anammox bacteria to the reactor. The nitrification phase may be performed by the Feammox bacteria. In the nitrification phase, ammonium may be converted to nitrite. The denitrification phase may be performed by denitrifying bacteria. In the denitrification phase, nitrite may be converted to gaseous nitrogen ($N_2$). The denitrification phase may be performed by the Anammox bacteria.

In an embodiment, a process for treating a soil or groundwater system is provided. The process may be implemented to remove a nitrogen contaminant from a soil or groundwater systems. The process may be implemented to remove at least one more contaminant from a soil or groundwater system. The process may include adding Feammox bacteria to the soil or groundwater system. The process may be performed in the absence or low level of oxygen. The contaminant may include ammonium. The process may include providing conditions suitable for the Feammox bacterium to oxidize ammonium. Conditions may include a source of ferric iron. Ferric iron may be added at any concentration described herein. The conditions may include any pH described herein that is suitable for growth of the Feammox bacterium. The conditions may include any temperature described herein that is suitable for growth of the Feammox bacterium. The at least one contaminant may be any inorganic or organic contaminant described herein.

Embodiments

The following list includes particular embodiments. The list, however, is not limiting and does not exclude the embodiments otherwise described herein or alternate embodiments.

An embodiment provides a composition comprising: a Feammox bacterium and at least one of soil, wastewater, or a carrier, wherein the Feammox bacterium is capable of oxidizing ammonium coupled with reduction of Fe(III) to Fe(II). The Feammox bacterium may have a genome comprising a nucleic acid sequence with at least 90% identity to a reference sequence of SEQ ID NO: 1. The nucleic acid sequence may have 100% identity to the reference sequence of SEQ ID NO: 1. The Feammox bacterium may include a nucleic acid encoding at least one enzyme capable of oxidizing ammonium into nitrite. The nucleic acid may include a sequence with at least 70% identity to SEQ ID NO: 8. The sequence may have 100% identity to SEQ ID NO: 8. The Feammox bacterium may be the bacterial strain designated as the Acidimicrobiaceae Feammox bacterium A6, which was submitted to be deposited with the American Type Culture Collection (ATCC; 10801 University Blvd., Manassas, Va. 20110-2209, USA) on Apr. 27, 2015, and the submission was supplemented on May 7, 2015. The composition may comprise the wastewater and the wastewater comprises an ammonium containing contaminant. The composition may comprise at least one more contaminant. The at least one more contaminant may be one or more inorganic contaminants. The inorganic contaminants may be selected from the group consisting of: a heavy metal, a radionuclide, and a trace metal. The at least one more inorganic contaminants may be selected from the group consisting of: ferric iron, uranium, zinc, and copper. The at least one more contaminant may be one or more organic contaminants. The organic contaminants may be but are not limited to chlorinated volatile organic compounds, perchloroethylene (PCE), trichloroethylene (TCE), trichloroethane, dichloroethane, vinyl chloride, polychlorinated biphenyls, fuel constituents, benzene, ethylbenzene, toluene, xylene, phenanthrene, methyl tert butyl ether, tertiary butyl alcohol, polyaromatic hydrocarbons, or ethylene dibromide. The composition may further comprise a source of ferric iron. The source may be selected from the group consisting of: a ferrihydrite, a goethite, an elemental iron, a nontronite, and an iron-rich clay. The composition may comprise the soil.

An embodiment provides a system comprising a reactor and a composition comprising a Feammox bacterium and at least one of soil, wastewater or a carrier, wherein the Feammox bacterium is capable of oxidizing ammonium coupled with reduction of Fe(III) to Fe(II). The Feammox bacterium may have a genome comprising a nucleic acid sequence with at least 90% identity to a reference sequence of SEQ ID NO: 1. The nucleic acid sequence may have 100% identity to the reference sequence of SEQ ID NO: 1. The Feammox bacterium may include a nucleic acid encoding at least one enzyme capable of oxidizing ammonium into nitrite. The nucleic acid may include a sequence with at least 70% identity to SEQ ID NO: 8. The sequence may have 100% identity to SEQ ID NO: 8. The Feammox bacterium may be the bacterial strain designated as the Acidimicrobiaceae Feammox bacterium A6, which was submitted to be deposited with the American Type Culture Collection (ATCC; 10801 University Blvd., Manassas, Va. 20110-2209, USA) on Apr. 27, 2015, and the submission was supplemented on May 7, 2015. The composition may comprise the wastewater and the wastewater comprises an ammonium containing contaminant. The composition may comprise at least one more contaminant. The at least one more contaminant may be one or more inorganic contaminants. The inorganic contaminants may be selected from the group consisting of: a heavy metal, a radionuclide, and a trace metal. Inorganic contaminants may be copper, uranium, ferric iron, lead, zinc, arsenic, chromium, mercury or silver. The at least one more contaminant may be organic contaminants. The organic contaminants may be but are not limited to chlorinated volatile organic compounds, perchloroethylene (PCE), trichloroethylene (TCE), trichloroethane, dichloroethane, vinyl chloride, polychlorinated biphenyls, fuel constituents, benzene, ethylbenzene, toluene, xylene, phenanthrene, methyl tert butyl ether, tertiary butyl alcohol, polyaromatic hydrocarbons, or ethylene dibromide. The composition may further comprise a source of ferric iron. The source may be selected from the group consisting of: a ferrihydrite, a goethite, an elemental iron, a nontronite, and an iron-rich clay.

An embodiment provides a process for removing a nitrogen contaminant from wastewater comprising mixing the wastewater with Feammox bacteria. The Feammox bacterium may be the bacterial strain designated as the Acidimicrobiaceae Feammox bacterium A6, which was submitted to be deposited with the American Type Culture Collection (ATCC; A10801 University Blvd., Manassas, Va. 20110-2209, USA) on Apr. 27, 2015, and the submission was supplemented on May 7, 2015. The nitrogen contaminant may be ammonium. The process may further comprise providing conditions suitable for the Feammox bacteria to oxidize ammonium. Providing conditions may comprise creating or maintaining an absence of oxygen. Providing conditions may comprise adding a source of ferric iron. Providing conditions may comprise establishing a temperature in a range from 4° C. to 35° C. Providing conditions may comprise establishing a pH in a range from 2.0 to 7.5. The mixing may occur in a reactor. The reactor may be configured to allow a nitrification phase and a denitrification phase. There may be two separate reactors for each of nitrification and denitrification phases. The nitrification phase may be performed by the Feammox bacterium. The Feammox bacterium may have a genome comprising a nucleic acid sequence with at least 90% identity to a reference sequence of SEQ ID NO: 1. The Feammox bacterium may include a nucleic acid sequence with at least 90% identity to a reference sequence of SEQ ID NO: 8. The denitrification phase may be performed by the Anammox bacterium. The reactor may be selected from the group consisting of: a continuous membrane reactor, a sequential batch reactor, an electrogenic microbial reactor, and an industrial-type reactor. The process may further comprise removing at least one more contaminant. The at least one more contaminant may be one or more inorganic contaminants. The inorganic contaminants may comprise at least one metal selected from the group consisting of: a heavy metal, a radionuclide, and a trace metal. The inorganic contaminants may be selected from the group consisting of: ferric iron, uranium, copper, lead, zinc, arsenic, chromium, mercury, and silver. The at least one more contaminant may be organic contaminants. The organic contaminants may be but are not limited to chlorinated volatile organic compounds, perchloroethylene (PCE), trichloroethylene (TCE), trichloroethane, dichloroethane, vinyl chloride, polychlorinated biphenyls, fuel constituents, benzene, ethylbenzene, toluene, xylene, phenanthrene, methyl tert butyl ether, tertiary butyl alcohol, polyaromatic hydrocarbons, or ethylene dibromide.

An embodiment provides a process for removing a nitrogen contaminant in a soil or groundwater system comprising: adding Feammox bacterium to the soil or groundwater system. The Feammox bacterium may be the bacterial strain designated as the Acidimicrobiaceae Feammox bacterium A6, which was submitted for deposit with the American Type Culture Collection (ATCC; 10801 University Blvd., Manassas, Va. 20110-2209, USA) on Apr. 27, 2015, and the submission was supplemented on May 7, 2015. The nitrogen contaminant may contain ammonium. The process may further comprise providing conditions suitable for the Feammox bacteria to oxidize ammonium. Providing conditions may comprise creating or maintain an absence of oxygen. Providing conditions may comprise adding a source of ferric iron. The source of ferric iron may be selected from the group consisting of: a ferrihydrite, a goethite, a scrap iron, a nontronite, and an iron-rich clay. Providing conditions may comprise establishing a temperature in a range from 4° C. to 35° C. Providing conditions may comprise establishing a pH in a range from 2.0 to 7.5. The process may further comprise removing at least one more contaminant. The at least one more contaminant may be one or more inorganic contaminants. The inorganic contaminants may comprise at least one metal selected from the group consisting of: a heavy metal, a radionuclide, and a trace metal. The inorganic contaminants may be selected from the group consisting of: ferric iron, uranium, a copper, lead, zinc, arsenic, chromium, mercury, and silver. The at least one more contaminant may be organic contaminants. The organic contaminants may be but are not limited to chlorinated volatile organic compounds, perchloroethylene (PCE), trichloroethylene (TCE), trichloroethane, dichloroethane, vinyl chloride, polychlorinated biphenyls, fuel constituents, benzene, ethylbenzene, toluene, xylene, phenanthrene, methyl tert butyl ether, tertiary butyl alcohol, polyaromatic hydrocarbons, or ethylene dibromide.

Further embodiments herein may be formed by supplementing an embodiment with one or more element from any one or more other embodiment herein, and/or substituting one or more element from one embodiment with one or more element from one or more other embodiment herein.

The following non-limiting examples are provided to illustrate particular embodiments. The embodiments throughout may be supplemented with one or more detail from one or more example below, and/or one or more element from an embodiment may be substituted with one or more detail from one or more example below.

EXAMPLE 1

Development of an Enrichment Culture Capable of Ammonium Oxidation under Iron Reducing Conditions An anaerobic $NH_4^+$ oxidation process coupled to iron reduction was first noted in a forested riparian wetland in New Jersey. In this reaction, $NH_4^+$ is the electron donor, which is oxidized to nitrite ($NO_2^-$), and ferric iron [Fe(III)] is the electron acceptor, which is reduced to ferrous iron [Fe(II)]. The stoichiometry and change in free energy when ferrihydrite is the Fe(III) source is:

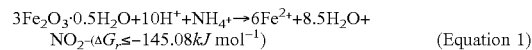

$$3Fe_2O_3 \cdot 0.5H_2O + 10H^+ + NH_4^+ \rightarrow 6Fe^{2+} + 8.5H_2O + NO_2^- (\Delta G_r \leq -145.08 kJ \, mol^{-1}) \quad \text{(Equation 1)}$$

These pathways have been reported to oxidize $NH_4^+$ to $NO_2^-$, to $NO_3^-$, or directly to $N_2$, using Fe(III) as electron acceptor (Clement et al., 2005; Shrestha et al., 2009; Sawayama, 2006; Yang et al., 2012, all of which are incorporated by reference as if fully set forth).

Soil samples were collected from the same location and used for laboratory incubation experiments as well as to set up an enrichment system for Feammox in a continuous flow membrane reactor. Various incubation conditions [Fe(III) sources, inorganic carbon content, $NH_4^+$ concentration, $^{15}NH_4^+$, and acetylene gas ($C_2H_2$) as a selected inhibitor] were used to study the Feammox mechanism. Molecular biology methods, such as denaturing gradient gel electrophoresis (DGGE), 454 pyrosequencing, and real-time quantitative PCR (qPCR) analysis were used to investigate the bacterial community change during incubations. Production of both nitrite (NO2−) and ferrous iron were measured repeatedly during incubations when soil slurries were supplied with iron oxide (ferrihydrite or goethite) and ammonium chloride.

The Feammox process provided denitrifiers and anammox bacteria with the necessary NO2− under this anaerobic incubation, and achieved total nitrogen loss via denitrification and anammox pathways. Therefore, Feammox is an important process in the nitrogen cycle in soil environments under oxygen limited conditions, and reveals a new linkage between these two significant biogeochemical cycles (iron and nitrogen cycle).

EXAMPLE 2

Sample Collection and Processing

Soils for all the experiments described in examples herein were taken from a temperate forested riparian wetland at the Assunpink Wildlife Management Area, New Jersey. Ten soil cores were collected from 10 cm below the surface with polyethylene column containers (8 cm diameter and 30 cm long) and transported to the laboratory within 2 hours. The soil pH was between 3.5 and 4.5, and no manganese oxides were detected. The detailed physicochemical characteristic of these wetland soils have been described elsewhere (Clement et al., 2005 Soil Biol Biochem 37: 2323-2328, which is incorporated by reference as if fully set forth). Prior to all incubation experiments, soil slurry from the field site was aerated for a month to degrade much of the labile organic carbon. After a 30 days of aeration, the dissolved organic carbon (DOC) content was stable at 2.06±0.20 mg g$^{-1}$. Following the aeration treatment, the soil was divided into 400×10 g (air-dry equivalent) subsamples, and added into 50 mL serum vials, with 30 mL deionized water. The soil slurries were purged thoroughly with a $CO_2:N_2$ (80:20) mixture, resulting in a final pH of ~4 to 4.5. The vials were sealed tightly with rubber stoppers and were stored in an anaerobic glove box for 30 days at ambient temperature to allow for stabilization before starting the incubations.

EXAMPLE 3

Batch Incubation Experiments

All incubations, addition of reagents, and sampling were conducted in an anaerobic glove box with a solution of resazurin as the redox indicator. Soil samples were first incubated with different Fe(III) sources to determine which source would yield a more active Feammox process: 6-line ferrihydrite ($Fe_2O_3 \cdot 0.5H_2O$) or goethite [FeO(OH)]+$NH_4^+$ addition; ferric chloride+$NH_4^+$ addition; ferric citrate+$NH_4^+$ addition; either only ferrihydrite or $NH_4^+$ addition; and autoclaved soil with ferrihydrite+$NH_4^+$ addition (n=30 per treatment). 6-line ferrihydrite ($Fe_2O_3 \cdot 0.5H_2O$) or goethite [FeO(OH)] was prepared according to Cornell and Schwertmann, 2003 The Iron Oxides: Structure, Properties, Reactions, Occurrences, and Uses. John Wiley and Sons Ltd., which is incorporated herein by reference as if fully set forth. pH was adjusted to 4.5 in the ferrihydrite/goethite augmented samples, and to between 3.5~4.0 in the ferric chloride/citrate augmented samples. Soil-slurry samples, which were prepared to have an initial concentration of 12.0 mmol L$^{-1}$ Fe(III) and/or 2.00 mmol L$^{-1}$ $NH_4^+$, were incubated in a series of 50 ml vials with an oxygen-free headspace, created by purging with a $CO_2:N_2$ (80:20) mixture. Triplicate samples were collected destructively every two days to analyze iron and nitrogen species.

The second incubation was conducted to extend the anoxic incubation with ferrihydrite to 180 days, with repeated $NH_4Cl$ additions after the $NH_4^+$ in solution was exhausted. The initial concentration of Fe(III) was 25.0 mmol L$^{-1}$ and 1.00 mmol L$^{-1}$ $NH_4^+$ was added on days 4, 24, and 60, furthermore, 0.20 mmol L$^{-1}$ $NaHCO_3$ was added on day 50 and day 90 of the incubation. On day 125, incubation vials were divided into two sets to study the effect of different inorganic carbon contents on Feammox. Either 1.20 mmol L$^{-1}$ or 0.20 mmol L$^{-1}$ of $NaHCO_3$ plus 2 mmol L$^{-1}$ of $NH_4Cl$ were added to each set. $NaHCO_3$ was then added every 10 days, which increased the soil pH to ~5 in the samples amended with 1.20 mmol L$^{-1}$ of $NaHCO_3$. For this incubation, samples were collected every four days. Finally, soil samples collected on day 180 of the incubations were used to enrich the Feammox bacteria in a membrane reactor. To study how the organic carbon content affects the Feammox bacteria, 1.00 mmol sodium citrate was also supplied on day 125 to four of the 1.20 mmol $NaHCO_3$ amended samples.

In the third experiment, inorganic nitrogen species were quantified through incubations in the presence of $C_2H_2$. Soil slurries were first incubated for 90 days in eighty 50 mL vials. The Fe(III) concentration at the beginning of the incubations was 25 mmol L$^{-1}$. One mmol $NH_4Cl$ and 0.20 mmol $NaHCO_3$ was added on days 24, 60, and 90. After this incubation, 5 mL of pure $C_2H_2$ gas were added to 40 vials, which resulted in a finial $C_2H_2$ concentration of 100 L$^{-1}$. Samples with and without $C_2H_2$ were then incubated anaerobically for 20 days. The headspace gas was sampled every 24 hours for $N_2O$ analysis, and soil samples were analyzed every two days for Fe and N species.

EXAMPLE 4

Continuous Flow Membrane Feammox Reactor

Soil samples collected on day 180 from the incubation with ferrihydrite, $NH_4Cl$, and 1.20 mmol $NaHCO_3$ additions were inoculated into a continuous flow membrane reactor, which was operated under anaerobic conditions by constantly purging $N_2$ through the reactor's headspace at a room temperature (25° C.), and with a 48 hour hydraulic retention time (Abbassi et al., 2014 *J. Environ. Management* 142:53-59, which is incorporated herein by reference as if fully set forth).

The enrichment medium contained the following components per liter: 177 mg $NH_4Cl$, 77.9 mg $(NH_4)_2SO_4$, 19.8 mg $NaHCO_3$, 71.0 mg $KHCO_3$, 9.00 mg $KH_2PO_4$, 100 mg $MgSO_4 \cdot 7H_2O$, and 60.0 mg $CaCl_2 \cdot 2H_2O$. After autoclaving, 1 mL trace element solution was added to the medium (Van de Graaf et al., 1996 *J. Microbiol.*, 142:2187-2196, which is incorporated herein by reference as if fully set forth). 50.0 mmol $L^{-1}$ ferrihydrite were added once every two weeks directly into the reactor. To aid in maintaining anaerobic conditions, 0.10-0.20 mmol$L^{-1}$ sodium citrate was fed to the reactor about twice per month. pH was controlled at around 4~5, and dissolved oxygen was <0.10 mg/L. Samples form the outflow were collected every two days, and sludge samples from reactor were collected and kept at −20° C. for molecular biology analysis.

Finally, $^{15}N$ isotope tracer incubations were conducted using slurries collected form the stable Feammox membrane reactor. Five treatments (n=3 per treatment) were conducted: (1) control with only anoxic deionized (DI) water; (2) $^{15}NH_4Cl$ addition; (3) $^{15}NH_4Cl+Fe(III)$ addition; (4) $^{15}NH_4Cl$ and $C_2H_2$ addition; (5) $^{15}NH_4Cl$, $C_2H_2$, and Fe(III) addition. The headspace gas of each 50 mL incubation vial was sampled every 24 hours for $^{15}N_2O$ analysis.

EXAMPLE 5

Chemical Analyses

For each sample collection during the incubations, a set of vials was destructively sampled in a glove box under oxygen-free conditions and the pH was measured immediately using a pH electrode. An extraction with 0.5N HCl was conducted for 24 hours at room temperature to determine acid-extractable Fe(II) and $NH_4^+$ concentrations in the soils. Fe(II) was analyzed using the ferrozine assay method (Stookey, 1970 Anal Chem 42: 779-781; Komlos et al., 2007 Water Res 41: 2996-3004, which are incorporated herein by reference as if fully set forth). Extraction efficiency of Fe(II) was affected by the HCl concentration and the extraction time. About 5-10% more Fe(II) could be extracted with either 1N HCl extraction over 24 hours or with 0.5 N HCl over 36 hours as opposed to 0.5 N HCl over 24 hours. Furthermore, after more Fe(II) was produced in the system with increasing incubation time, the Fe(II) extraction efficiency improved. Only a 1-2% difference was observed in the Fe(II) extracted over 24 hours using 0.5N vs. 1N HCl towards the end of the incubation period. Clays, present in the soil incubations, typically sorb Fe(II) more efficiently when the total Fe(II) is low, furthermore ferrihydrite is slowly converted to magnetite, resulting in relatively different associations to different phases of the Fe(II) over the duration of the incubation. All of which leads to incomplete Fe(II) extractions, especially when the Fe(II) is low. Fe(II) data obtained herein via 0.5N HCl extractions over 24 hours to ensure that the methods and hence data are comparable to those reported by other researchers focusing on iron reduction and iron bioavailability.

$NH_4^+$ was analyzed using a Dionex™ Ion Chromatograph (LC3000) with a CS-16 Colum and a CS-16 guard column (flow rate=1.00 mL min$^{-1}$, detection limit=0.012 ppm). $NO_3^-$ and $NO_2^-$ were extracted with DI water for 1 hour anaerobically, and measured via Ion Chromatography, using an AS-22 Column along with an AG-22 guard column (flow rate=1.20 mL min$^{-1}$, detection limit=0.016 ppm). For the total organic carbon (TOC) and total nitrogen (TN) analyses a Shimadzu TOC-5000(A) was used. $N_2O$ concentrations were determined on a gas chromatograph Shimadzu 2014 equipped with an electron capture detector.

EXAMPLE 6

DNA and RNA Isolation

DNA and RNA samples were extracted from soils collected at the wetland prior to any laboratory incubation, from the samples taken at different time points during the incubation experiments and from the reactor. DNA was extracted from 500 mg soil or sludge samples using the FastDNA® spin kit for soil (MP Biomedicals, USA) as described by the manufacturer, and RNA using the FastRNA® pro Soil Direct Kit. The concentrations were measured using a Nanodrop 2000 spectrophotometer (Thermo Scientific, USA).

EXAMPLE 7

PCR-DGGE and 454 Pyrosequencing Analysis

Bacterial universal 16S rRNA gene primer sets V3-21V3-3 were used for PCR amplification (Jensen et al., 1998 FEMS Microbiol Ecol 26: 17-26, which is incorporated herein by reference as if fully set forth). DGGE was performed with an 8% polyacrylamide gel containing a gradient from 40% to 80% denaturant using the gradient gel electrophoresis system (C.B.S. SCIENTIFIC, USA). The electrophoresis was carried out at 60 V for 15 hours. After that the gel was stained with 0.1 µL mL$^{-1}$ SYBR Green I and visualized with an UV transilluminator. All visible bands were excised from the gel and used as templates for re-amplification, using the primer set V3-1/V3-2 and followed by cloning (Jensen et al., 1998, which is incorporated herein by reference as if fully set forth). PCR products were purified via agarose gel extraction and cloned into a pGEM-T vector (Promega). A total of 10 to 30 positive recombinant clones for each band were identified by colony PCR, and were sent for sequencing to avoid erroneous interpretations. DNA sequencing was then conducted by Genewiz, Inc. Bacteria were classified and the phylogenetic tree of Acidimicrobiaceae-related sequences was constructed using the Bayesian inference (Huelsenbeck et al., 2001 Science, 294:2310-2314, which is incorporated herein by reference as if fully set forth). Sequences obtained in this study were submitted to the GanBank database on February 4, 2013, and are available therein under accession numbers KC581755-KC581779. See also Huang S and Jaffe PR, *Characterization of incubation experiments and development of an enrichment culture capable of ammonium oxidation under iron reducing conditions*, 2014, Biogensciences Discuss, 11, 12295-12321, which is incorporated herein by reference as if fully set forth. To further confirm the changes in the bacterial community, 454 pyrosequencing was performed with samples collected from the incubation on days 0, 30, 90, 160 and from the membrane reactor after 150 days of reactor operation. Domain-specific primers Bact-338F1/909R, targeting the V3-V5 region of the 16S rDNA of bacteria were amplified and sequenced according to Pinto et al. (2012, PLoS One 7: 43093, which is incorporated herein by reference as if fully set forth).

EXAMPLE 8

Quantitative PCR (qPCR) Assay qPCR experiments were carried using a StepOnePlus™ Real-Time PCR System (Life Technologies, USA), represented by 16S rRNA genes, using primer sets 1055f/1392r for total bacteria (Harms et al., 2003), Amx368f/Amx820r for anammox bacteria (Schmid et al., 2000; Schmid et al., 2003), acd320f-432r which were developed for Acidobacteriaceae bacteria, and acm342f-439r which were developed for Acidimicrobiaceae bacteria. See Harms et al. 2003 Environ Sci Technol 37: 343-351, for total bacteria; a Schmid et al., 2000 Syst Appl Microbiol 23:93-106, and Schmid et al., 2003 Syst Appl Microbiol 26:529-538 for anammox bacteria. For the detection of denitrifiers, AOB and AOA, denitrifying functional genes (nirS and nick), ammonia monooxygenase structural gene (amoA) were quantified with primer sets NirS3F/NirS5R, NirK1F/NirK5R, amoA-1F/amoA-$_2$R for AOB-amoA and Arch amoA-F/amoA-R for AOA-amoA (Braker et al., 1998 Appl Environ Microbiol 64:3769-3775; Rotthauwe et al., 1997 Environ Microbiol 9:1761-1771; Francis et al., 2005 Proc. Natl. Acad. Sci. 102:14683-14688, all of which are incorporated by reference as if fully set forth). Primer pairs CrenamoA23f/616r, was also used to quantify the thaumarchaeal amoA genes which represented acidophilic ammonia oxidizers (Tourna et al., 2008 Environ Microbiol 10: 1357-1364, which is incorporated herein by reference as if fully set forth). For DNA quantification, each qPCR mixture (20 μL) was composed of 10 μL of SYBR Premix Ex Taq® II (Takara, Japan), 0.8 μL 10 μM of each primer, and ~10 ng DNA template. RNA quantification was conducted through a real-time quantitative reverse transcription-PCR (RT-qPCR) analysis, by using the One Step SYBR® PrimeScript® RT-PCR Kit (Takara, Japan) according to the manufacturer's recommendations. Thermal cycling conditions for total 16S rDNA, nirS and AOB-amoA gene numbers was initiated for 30 s at 94° C., followed by 40 cycles of 5 s at 94° C., 30 s at 57° C., and 30 s at 70° C. 16S rDNA numbers of anammox, Acidobacteriaceae and Acidimicrobiaceae bacteria were performed at 56° C., 55° C., and 58° C. as annealing temperature respectively, with the same program. For AOB-amoA gene and thaumarchaeal amoA genes, annealing temperature was 53° C. and 55° C., and the annealing time was adjusted to 45 s. For RNA quantification, the cycling conditions were identical to those described for measuring gene numbers, with the exception that an initial incubation was conducted for 5 min at 42° C. to facilitate reverse transcriptase activity. Each assay contained a standard using a serial dilution of plasmids containing specific target genes, independent triplicate templates for each soil sample, and triplicate no template controls (NTC).

EXAMPLE 9

Thermodynamic Consideration of Feammox

The change in Gibbs free energy of Equation 1 was calculated to determine the thermodynamic feasibility of the Feammox reactions using the following equation $$aA + bB \rightarrow cC + dD$$

$$\Delta G_r = \Delta G_r^0 + RT\ln\frac{(C)^c(D)^d}{(A)^a(B)^b}$$

and: $\Delta G_r^0 = c\Delta G_{fC}^0 + d\Delta G_{fD}^0 - a\Delta G_{fA}^0 - b\Delta G_{fB}^0$ R is the gas constant, which equals 0.008314 kJ mol$^{-1}$. K, and T is the absolute temperature in ° Kelvin (297.15 K). Free energies of formation were obtained from Stumm and Morgan (1996): $\Delta G_f^0$ (NH$_4^+$)=−79.37 kJ mol$^{-1}$, $\Delta G_f^0$ (NO$_2^-$)=−37.2 kJ mol$^{-1}$, $\Delta G_f^0$ (H$_2$O)=−237. 18 kJ mol$^{-1}$, $\Delta G_f^0$ (Fe$^{2+}$)=−78.87 kJ mol$^{-1}$. $\Delta G_f^0$ (Fe$_2$O$_3$·0.5H$_2$O)=−711 kJ mol$^{-1}$ (Stumm and Morgan 1996 Aquatic Chemistry: Chemical Equilibria and Rates in Natural Waters (John Wiley, New York); Majzlan et al., 2004 Geochim. Cosmochim. Acta. 68, 1049-1059, which are incorporated herein by reference as if fully set forth). For biogeochemical reactions involving H$^+$, requires converting from standard condition (pH=0) to biochemical conditions: $\Delta G^{0'}$=$\Delta G^0$+ m$\Delta G'_f$(H$^+$), where m is the net number of H$^+$ in the reaction and $\Delta G'_f$ (H$^+$) is calculated as −5.69 kJ mol$^{-1}$ per pH unit (Madigan et al., 2002 Brock Biology of Microorganisms, 10th ed. Appendix1: energy calculations in microbial bioenergetics, which is incorporated by reference herein as if fully set fort). The chemical activity values used in the calculation are based on our incubation experiments: $C_{NH_4^+}$=2 mmol L$^{-1}$, $C_{NO_2^-}$=10 μmol L$^{-1}$, $C_{Fe^{2+}}$≤0.01 μmol L (detection limit), respectively, and pH=4.0. The dissolved Fe(II) was below the ferrozinemethod detection limit in the solution due to its sorption onto the Fe(III) oxides. Measurable dissolved Fe was only present in the samples extracted with 0.5M HCl. An activity of 1 was used for the solid-phase Fe(III) oxide minerals, and water.

$$3Fe_2O_3 \cdot 0.5H_2O + 10H^+ + NH_4^+ \rightarrow 6Fe^{2+} + 8.5H_2O + NO_2^- \quad \text{(Equation 1)}$$

$$\Delta G_r \leq [6\Delta G^0_{fFe^{2+}} + 8.5\Delta G^0_{fH_2O} + 1\Delta G^0_{fNO_2^-} -$$

$$3\Delta G^0_{fFe_2O_3 \cdot 0.5H_2O} - 10\Delta G^0_{fH^+} - 1\Delta G^0_{fNH_4^+}] +$$

$$(0.008314 \text{ kJ mol}^{-1})(297.15 \text{ K})\ln$$

$$\frac{(C_{Fe^{2+}})^6(C_{H_2O})^{8.5}(C_{NO_2^-})^1}{(C_{Fe_2O_3 \cdot 0.5H_2O})^3(C_{H^+})^{10}(C_{NH_4^+})^1}$$

$$\Delta G_r \leq [6(-78.87) + 8.5(-237.18) + 1(37.2) - 3(-711) -$$

$$10(4 \times -5.69) - 1(-79.37)] + (0.008314 \text{ kJ mol}^{-1})$$

$$(297.15 \text{ K})\ln\frac{(10^{-8})^6(1)^{8.5}(10^{-5})^1}{(1)^3(10^{-4})^{10}(2 \times 10^{-3})^1}$$

$$\Delta G_r \leq -145.08 \text{ kJ mol}^{-1}$$

The ≤ sign is because an upper limit (detection limit) was used for the Fe(II) concentration.

Figure 10:
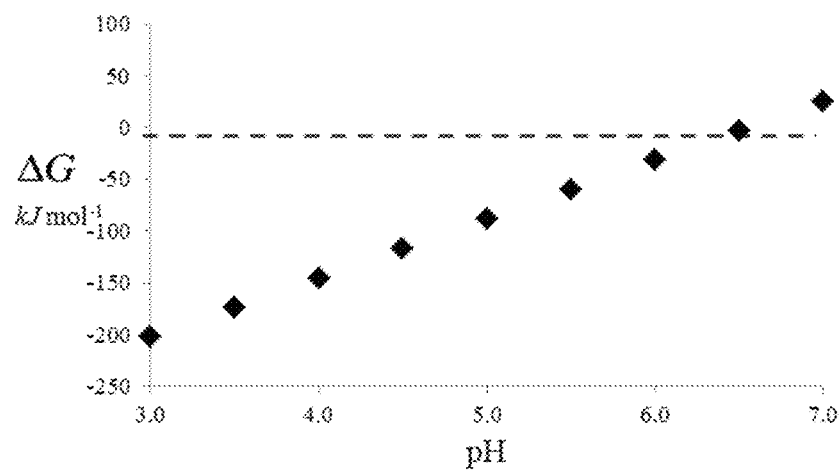
FIG. 10 illustrates a graph of ΔG vs. pH.

FIG. 10 illustrates a graph of ΔG vs. pH. Referring to this figure, pH shows that when maintaining all species concentrations constant except H$^+$, Feammox should not be feasible when the pH is above 6.5. Hence, Feammox is expected to occur in acidic environments.

EXAMPLE 10

PCR Amplification, DGGE Analysis and Pyrosequencing

Bacterial universal 16S rRNA gene primer sets V3-2/V3-3 and 27f/519r were used for PCR amplification (Jensen et al., 1998; Lane, 1991, both of which are incorporated herein by reference as if fully set forth). Each 25 µL reaction mixture contained 2.5 µL 10×PCR Buffer (500 mM KCl, 25 mM MgCl2, 200 mM Tris-HCl [pH 8.4], 0.1% Triton X-100), 2.0 µL 2.5 mM DNTP mixture (Takara, Japan), 0.3 µL of 10 µM V3-2 and V3-3, 0.13 µL 5U Taq polymerase, 1 µL of template DNA, and 18.77 µL sterilized ddH$_2$O. The PCR protocol was as follows: 30 s initial denaturation at 94° C.; 10 cycles with each cycle consisting of 30 s of denaturation at 94° C., 30 s of annealing at 61° C. (the temperature of anneal decreased 0.5° C. after each cycle), and 40 s extension at 72° C.; 25 cycle with each cycle included 30 s denaturation at 94° C., 30 s annealing at 55° C., and 40 s extension at 72° C.; followed by a final 5 min extension at 72° C. PCR products stained with 0.02 µL mL$^{-1}$ Genefinder were visualized on 1% (w/v) agarose gel at 120 V for 20 min, and visualized under SYNGENE Genesnap. A much higher degree of diversity was observed with primer sets V3-2/ V3-3, hence its DGGE products were used for the following analysis.

After the DGGE was performed, all visible bands were excised from the gel and used as templates for re-amplification, using primer set V3-1/V3-2 (Jensen et al., 1998, which is incorporated herein by reference as if fully set forth). The PCR program was initiated with 30 s at 94° C., followed by 40 cycles of 5 s at 94° C., 30 s at annealing at 56° C., and 30 s at 70° C. The PCR products were purified using Qiaquick PCR preps (Qiagen, Valencia, Calif.) and cloned into a pGEM-T vector (Promega, USA). Positive recombinant clones were identified by PCR, and the PCR products were cleaned with ExoSap treatment and sequences were conducted by Genewiz, Inc., USA. Clone libraries from 12 samples resulted in 721 sequences of partial 16S rRNA gene fragments and the sequences were grouped into operational taxonomic units (OTUs) based on a 5% sequence distance cutoff calculated using the DOTUR program (Schloss and Handelsman, 2005 *Appl. Environ. Microbl.* 71, 1501-1506, which is incorporated herein by reference as if fully set forth). Six groups of bacteria were classified via a phylogenetic analysis using the Bayesian inference (BI), implemented with MrBayes version 3.1.2 (Huelsenbeck et al., 2001; Ronquist et al., 2003 *Bioinformatics.* 19, 1572-1574, which are incorporated herein by reference as if fully set forth). A best fit model of nucleotide substitution was identified using the Akaike information criterion (AIC) (Akaike, 1973) as implemented in MrModelTest 2.3 (Nylander, 2004). Bayesian analysis was carried out using GTR+I+G model selected by MrModelTest 2.3, in which model parameters were treated as unknown and estimated through the BI. The following settings were applied: implementing two Markov chain Monte Carlo (MCMC) runs, running four simultaneous Markov chains for 19 million generations, and sampling the Markov chains every 100 generations. Tracer V1.5 (Rambaut and Drummond, 2009) was used to judge convergence of the Bayesian Markov chain Monte Carlo runs. The first 10,000 sampled trees were discarded as burn-in. A consensus tree was constructed from the remaining sampled trees. Sequences obtained in this study were submitted to the GanBank database on Feb. 4, 2013, and are available therein under accession numbers KC581755-KC581779. See also Huang S and Jaffe PR, *Characterization of incubation experiments and development of an enrichment culture capable of ammonium oxidation under iron reducing conditions,* 2014, Biogensciences Discuss, 11, 12295-12321, which is incorporated herein by reference as if fully set forth. Approximately 2.5 ng of each DNA extract from samples collected from the incubation on days 0, 30, 90, 160 and from the membrane reactor after 150 days of reactor operation were used for 454 pyrosequencing analysis. To amplify a 16S rRNA gene fragment of the appropriate size and sequence variability for the 454 pyrosequencing, specific primers Bact-338F1 (CCTACG GGRGGCΔGCΔG) (SEQ ID NO: 2) /909R (CCGTCAATTYHTTTRΔGT) (SEQ ID NO: 3), targeting the V3-V5 region of the 16S rRNA gene of bacteria were chosen (Pinto and Raskin 2012, which is incorporated herein by reference as if fully set forth). The PCR conditions used were 94° C. for 2 min, 20 cycles of 94° C., 45 s denaturation; 55° C., 45 s annealing and 72° C., 1 min extension; followed by 72° C., 6 min. After 20 rounds of amplification, another 3 rounds of amplification were done to add the A and B adapters required for 454 pyrosequencing to specific ends of the amplified 16S rRNA fragment for library construction (Margulies et al., 2005 Nature, 437, 376-380, which is incorporated herein by reference as if fully set forth). Approximately 4 ng/µl of 16S rRNA gene fragment from each soil samples was required to construct the five libraries for 454 sequencing. Polymerase chain reaction products were cleaned using the QlAquick PCR Purification Kit (Qiagen) following the manufacturer's instructions, quantified using a Qubit Fluorometer (Invitrogen), and then sent for 454-pyrosequencing using a Roche/454 GS FLX sequencer.

A total of 19,021 partial 16S rRNA sequences were obtained from the five soil samples. The sequences were then passed through the DOTUR program to further reduce errors as outlined previously (Schloss and Handelsman, 2005, which is incorporated herein by reference as if fully set forth). Briefly, after trimming, pre-clustering, removal of chloroplast sequences and alignments, a total of 10172 sequences remained. These were clustered with the average neighbor algorithm with a 3% dissimilarity cutoff, which resulted in 1015 OTUs (Pinto and Raskin 2012, which is incorporated herein by reference as if fully set forth).

EXAMPLE 11

Primer Design for Real-time PCR Assay

Two sets of primers, acd320f (5'-CGG TCC AGA CTC CTA CGG GA -3') (SEQ ID NO: 4) - 432r (5'-GAC AGG GTT TTA CAG TCC GAA GA -3') (SEQ ID NO: 5) and acm342f 5'- GCA ATG GGG GAA ACC CTG AC-3') (SEQ ID NO: 6) - 439r (5'-ACC GTC AAT TTC GTC CCT GC -3') (SEQ ID NO: 7) were designed for Acidobacteriaceae bacteria A8 and Acidimicrobiaceae bacterium A6 respectively from clone libraries in this study, using an NCBI Primer-Blast program. This program did not show any putative sequences deposited in the GenBank, that amplified with the selected primers, could interfere with the experiment. The sequences of Acidobacteriaceae bacteria and Acidimicrobiaceae bacterium A6 acquired from this study did not exhibit any mismatches with the above primer sequences. Primers were then used for real-time PCR amplification in the soil samples from the incubation experiments.

EXAMPLE 12

Isotope Tracer Incubations

After 270 days of operation, Feammox enrichment slurries collected form the Feammox membrane reactor were used for isotope tracer incubations. Slurries were first incubated for 20 days in 50 mL vials under anaerobic conditions.

Five treatments (n=3 per treatment) were conducted as follows: (1) control treatment with only anoxic DI water; (2) $^{15}NH_4Cl$ addition; (3) $^{15}NH_4Cl+Fe(III)$; (4) $^{15}NH_4Cl$ and $C_2H_2$ addition; (5) $^{15}NH_4Cl$, $C_2H_2$ and Fe(III) addition. The final concentration of $^{15}NH_4Cl$ was 1 mmol $L^{-1}$, and 5 mmol $L^{-1}$ of ferrihydrite was add as the Fe(III) source. 5 mL of pure $C_2H_2$ gas was added to the vials, which resulted in a finial $C_2H_2$ concentration of 100 µmol $L^{-1}$. Samples were then incubated anaerobically for 7 days. The headspace gas was sampled every 24 hours for $^{15}N_2O$ analysis. All these processes were conducted in an anaerobic glove box. $N_2O$ was determined by isotope ratio mass spectrometry (IRMS, Thermo Finnigan Delta V Advantage, Bremen, Germany). $^{15}N_2O$ concentration was also calculated as $^{15}N_2O$ atom % excess above its natural abundance, following methods described by Ding et al. 2014 *Environ Sci Technol.* 48(18): 10641-7, which is incorporated herein by reference as if fully set forth. $^{15}N_2O$ production rates were calculated from the linear change in $^{15}N_2$ concentrations in the vial headspace between two given time points.

EXAMPLE 13

Change in Fe and N Species under Different Operational Conditions

Figure 1B:
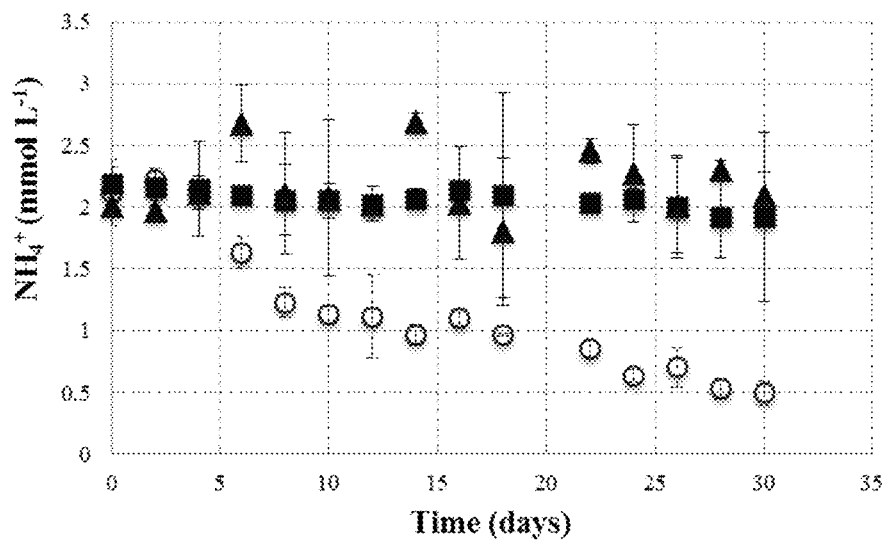
Figure 2A:
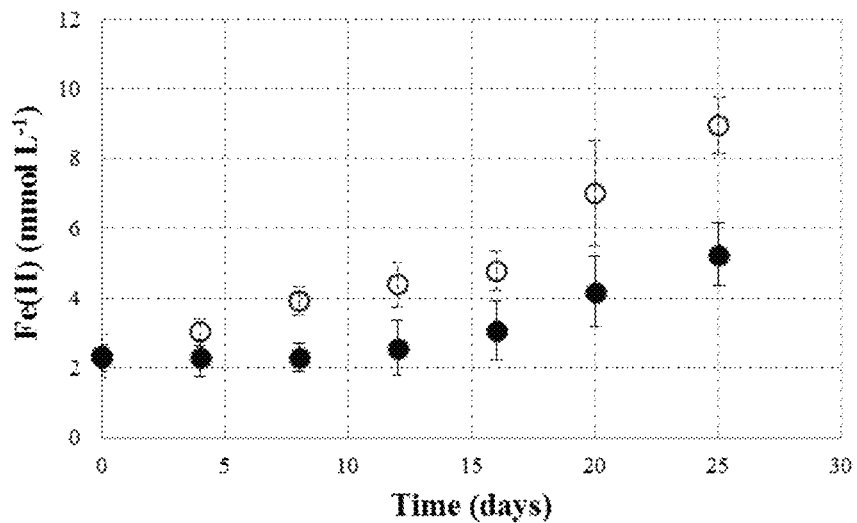
FIGS. 2A-2B illustrate concentration of Fe(II) (FIG. 2A) and $NH_4^+$ (FIG. 2B) in 25-day incubation with $NH_4Cl$ and ferrihydrite (open circle), $NH_4Cl$ and goethite (closed circle).
Figure 2B:
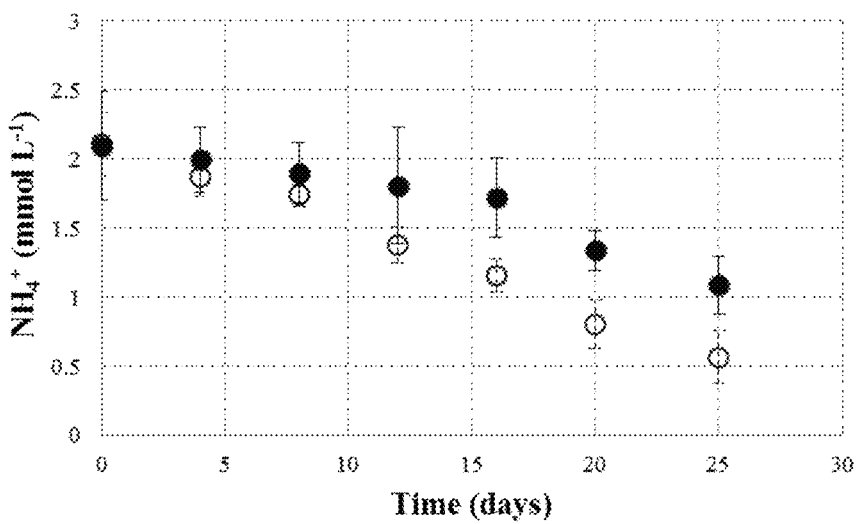
Figure 3A:
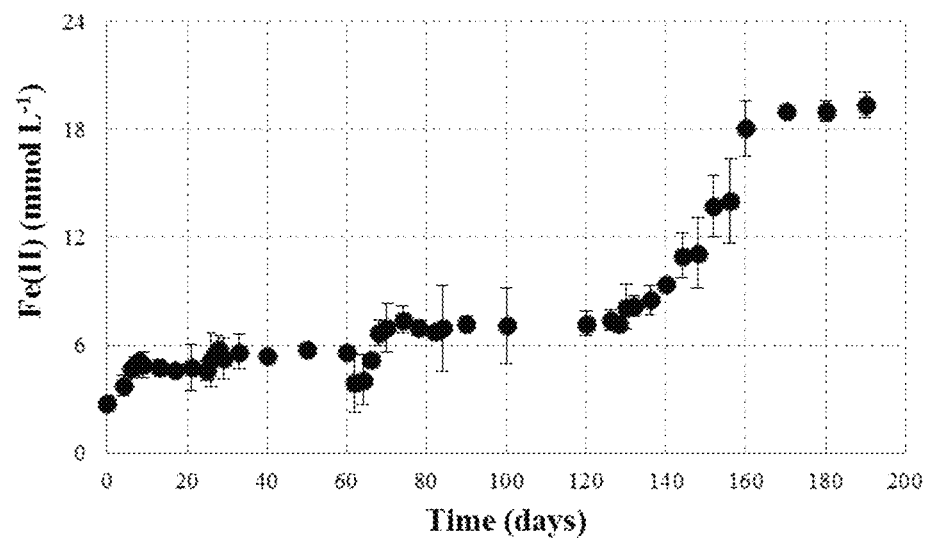
FIGS. 3A-3B illustrate concentration of Fe(II) (FIG. 3A) and $NH_4^+$ (FIG. 3B) during the 180 day incubation.
Figure 3B:
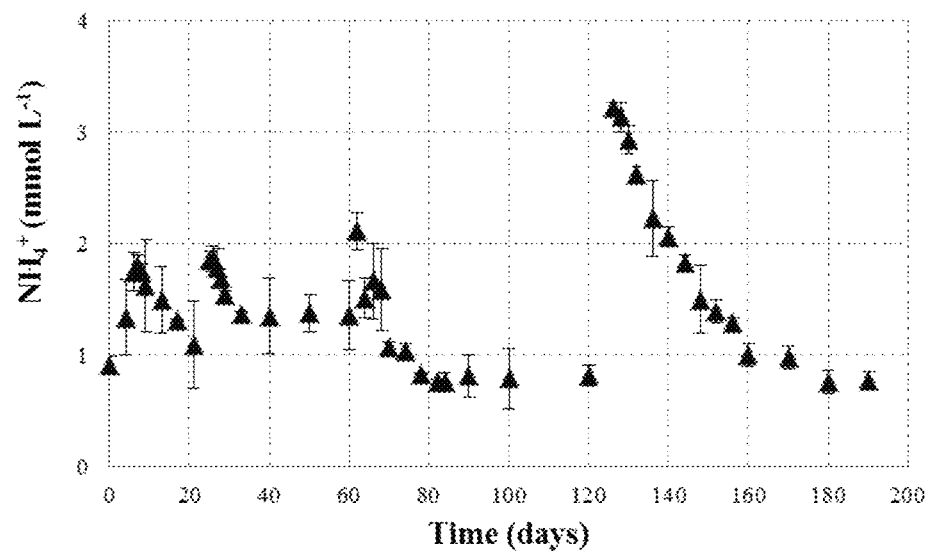
Figure 4A:
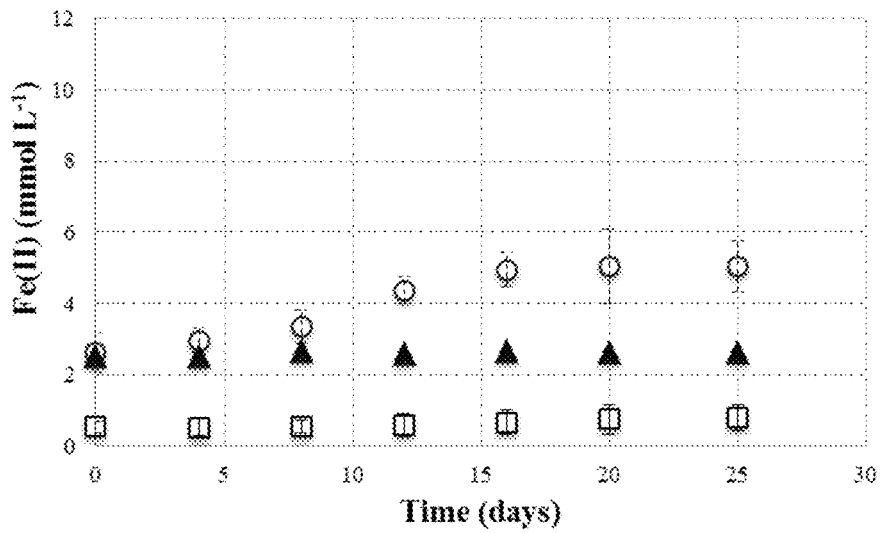
FIGS. 4A-4B illustrate concentration of Fe(II) (FIG. 4A) and $NH_4^+$ (FIG. 4B) in 25-day incubations in samples with $NH_4Cl$ (open square), ferrihydrite (open circle), sterilized soil with $NH_4Cl$ and ferrihydrite (closed triangle).
Figure 4B:
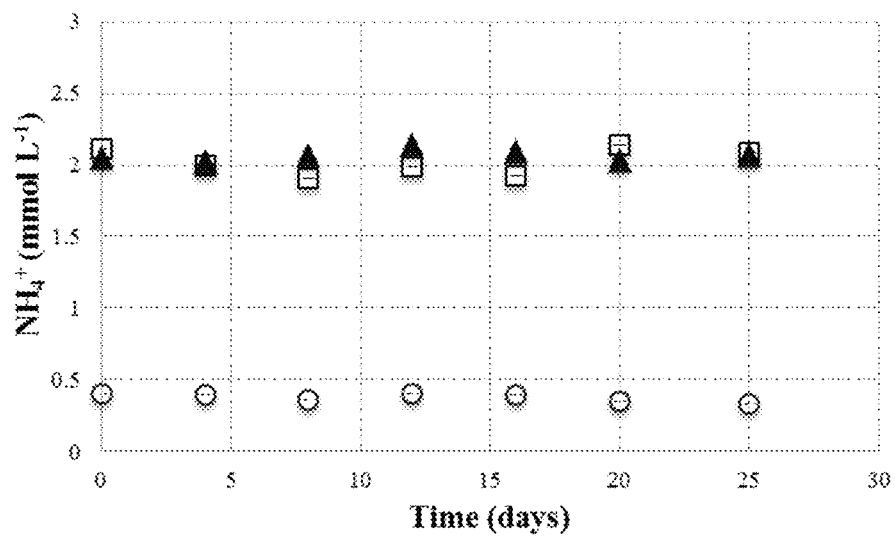

Batch incubation experiments were conducted. Batches included soil slurry included with three different Fe(III) sources. FIGS. 1A-1B illustrate concentration of Fe(II) (FIG. 1A) and $NH_4^+$ (FIG. 1B) in incubation with three different Fe(III) sources: ferrihydrite (open circle), ferric chloride (closed square), and ferric citrate (closed triangle). Referring to these figures, the values represent the mean and standard error (n=3). After incubating the pre-treated soil slurry with the three different Fe(III) sources for 30 days, only samples to which either ferrihydrite or goethite had been added showed measurable $NH_4^+$ oxidation. Referring to FIGS. 1A-1B, in samples incubated with ferric citrate and $NH_4Cl$, Fe(III) reduction was much faster than in those supplied with Fe(III) oxides, but the $NH_4^+$ concentration remained fairly constant. FIGS. 2A-2B illustrate concentration of Fe(II) (FIG. 2A) and $NH_4^+$(FIG. 2B) in 25-day incubation with $NH_4Cl$ and ferrihydrite (open circle), $NH_4Cl$ and goethite (closed circle). The values represent the mean and standard error (n=3). FIGS. 3A-3B illustrate concentration of Fe(II) (FIG. 3A) and $NH_4^+$ (FIG. 3B) during the 180 day incubation. 25 mmol $L^{-1}$ Fe(III) was added on day 0. 1.0 mmol $L^{-1}$ $NH_4^+$ was added on days 4, 24, and 60. 0.2 mmol $L^{-1}$ $NaHCO_3$ was added on day 50 and day 90. 1.2 mmol $L^{-1}$+2 mmol $L^{-1}$ of $NH_4Cl$ were added on day 125. The values represent the mean and standard error (n=3). FIGS. 4A-4B illustrate concentration of Fe(II) (FIG. 4A) and $NH_4^+$ (FIG. 4B) in 25-day incubations in samples with $NH_4Cl$ (open square), ferrihydrite (open circle), sterilized soil with $NH_4Cl$ and ferrihydrite (closed triangle). Referring to these figures, the values represent the mean and standard error (n=3). Still referring to FIGS. 4A-4B, no detectable Fe(II) reduction or $NH_4^+$ oxidation was found in the sterilized soils amended with ferrihydrite and $NH_4Cl$. Referring to FIGS. 2A-2B, faster iron reduction and $NH_4^+$ removal was observed in ferrihydrite than in goethite-amended sediments.

Figure 9:
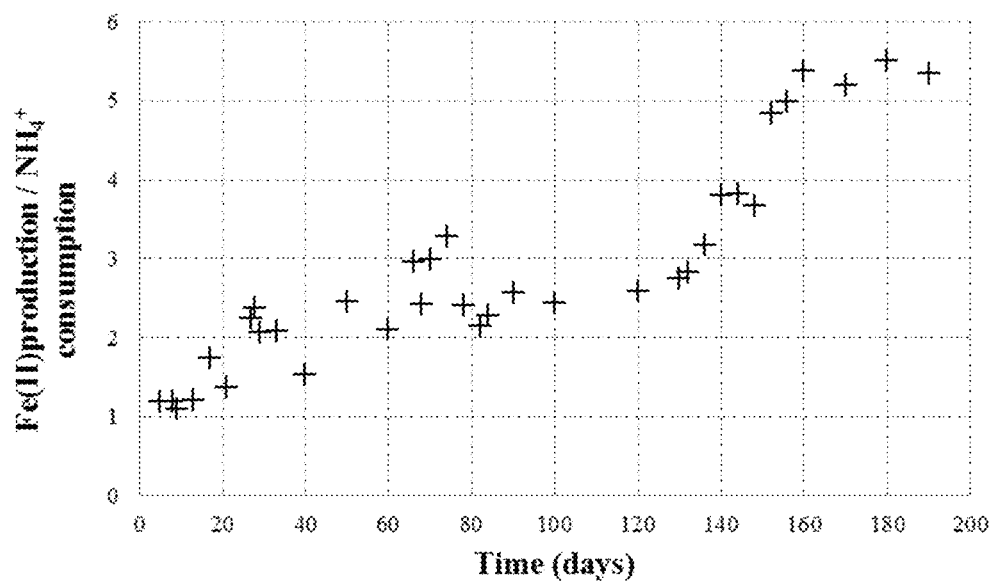
FIG. 9 illustrates stoichiometry between the Fe(II) production and $NH_4^+$ consumption during 180 day incubation.

Since samples incubated with ferrihydrite and $NH_4Cl$ resulted in the fastest $NH_4^+$ oxidation, the anaerobic incubation with ferrihydrite was extended to 180 days. Ferrihydrite as the Fe(III) source results in a larger negative ΔG value than goethite. The $NH_4^+$ oxidation rate increased as $NH_4Cl$ was supplied repeatedly, especially after 125 days of incubation when the $NaHCO_3$ additions were increased from 0.20 to 1.20 mmol $L^{-1}$ in addition to the 2.00 mmol $L^{-1}$ $NH_4^+$ added. Referring to FIGS. 4A-4B, the increased $NaHCO_3$ dosing also increased the generation of Fe(II). FIG. 9 illustrates stoichiometry between the Fe(II) production and $NH_4^+$ consumption during 180 day incubation. Referring to FIG. 9, 25 mmol $L^{-1}$ Fe(III) was added on day 0; 1.0 mmol $L^{-1}$ $NH_4^+$ was added on days 4, 24, and 60; 0.2 mmol $L^{-1}$ $NaHCO_3$ was added on day 50 and day 90 of the incubation. 1.20 mmol $L^{-1}$+2 mmol $L^{-1}$ of $NH_4Cl$ were added on day 125. The values represent the mean ratio (n=3). During the 180-day incubation, the ratio of Fe(II) produced to $NH_4^+$ removed gradually increased until it reached 5.3:1 by day 160 after which it remained stable.

Figure 5A:
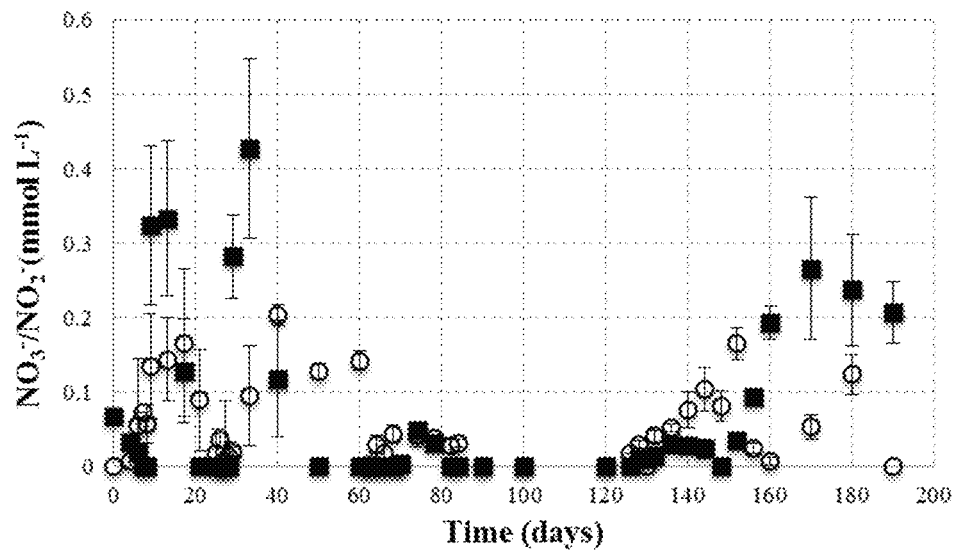
FIGS. 5A-5B illustrate concentration of $NO_3^-$ (open circle) and $NO_2^-$ (closed square) (FIG. 5A) and DOC (open triangle) and TN (open square) (FIG. 5B) during the 180 day incubation.
Figure 5B:
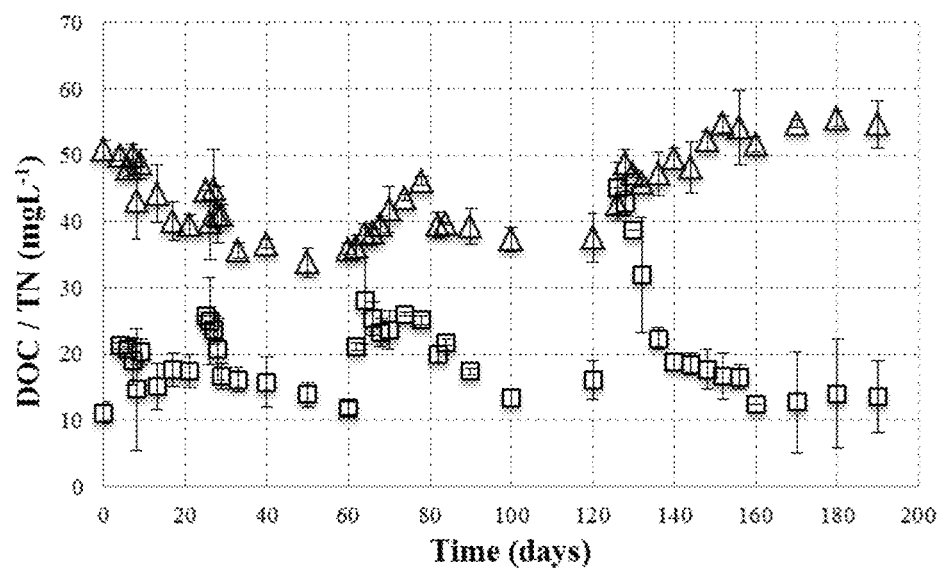

FIGS. 5A-5B illustrate concentration of $NO_3^-$(open circle) and $NO_2^-$(closed square) (FIG. 5A) and DOC (open triangle) and TN (open square) (FIG. 5B) during the 180 day incubation. Referring to these figures, 25 mmol $L^{-1}$ Fe(III) was added on day 0. 1.0 mmol $L^{-1}$ $NH_4^+$ was added on days 4, 24, and 60. 0.2 mmol $L^{-1}$ $NaHCO_3$ was added on day 50 and day 90 of the incubation; 1.20 mmol $L^{-1}$+2 mmol $L^{-1}$ of $NH_4Cl$ were added on day 125. The values represent the mean and standard error (n=3).

Referring to FIGS. 5A-5B, $NO_2^-$ appeared within a few days after the addition of $NH_4^+$, with a maximum concentration 0.44±0.17 mmol $L^{-1}$ in the second $NH_4^+$ oxidation cycle. Referring to FIG. 5A, $NO_2^-$ did not accumulate in the system and was immediately consumed after generation. Referring to FIGS. 5A-5B, $NO_3^-$ production showed a similar pattern to that of $NO_2^-$ (FIG. 5A), and TN loss similar to the decrease in $NH_4^+$ (FIG. 5B). During 180 days of incubation, the system experienced a loss of TN of 57.2±3.13 mg $L^{-1}$. Referring to FIG. 5B, the DOC content fluctuated slightly in the early stage of incubation, but overall, the DOC concentration was relatively stable at around 45~50 mg $L^{-1}$.

A 64.5% $NH_4^+$ removal, between inflow and outflow was achieved in the membrane reactor after 150-days of operation.

EXAMPLE 14

Phylogenetic Analysis of the Microbial Community Based on 16S rRNA Gene

Figure 6:
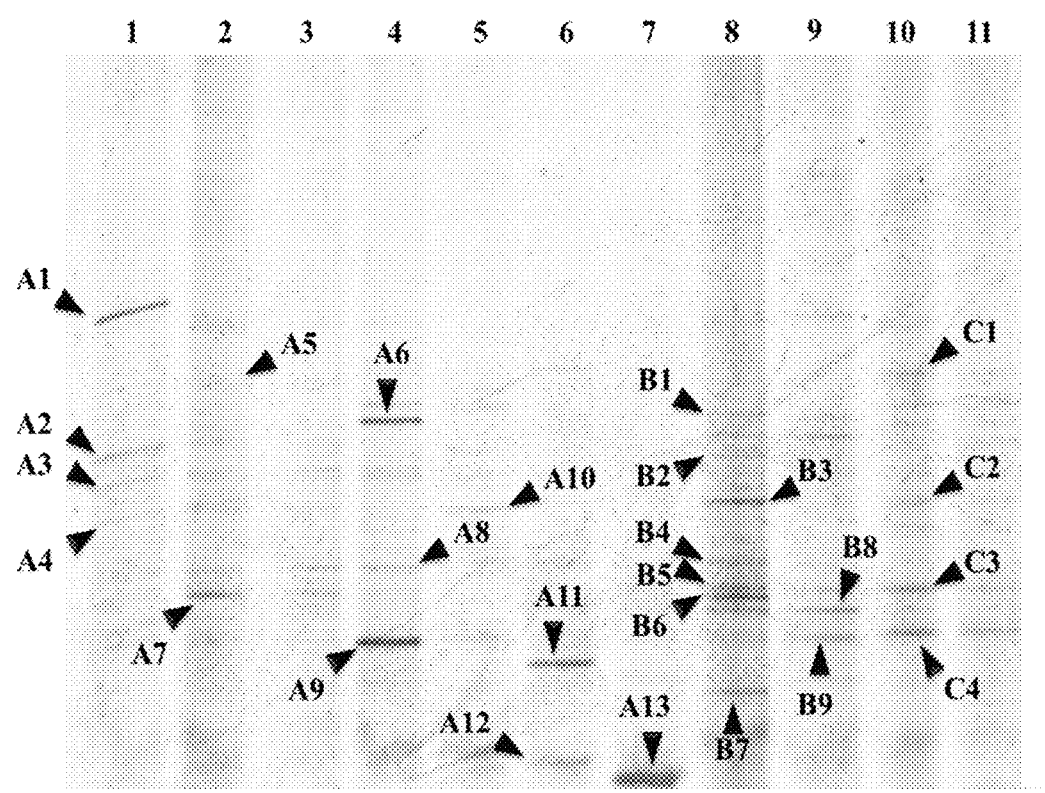
FIG. 6 illustrates comparison of DGGE analysis profiles of soil communities during anaerobic incubations.

FIG. 6 illustrates comparison of denaturing gradient gel electrophoresis (DGGE) analysis profiles of soil communities during anaerobic incubations. Samples from 0, 30, 90 and 160 days of incubation with ferrihydrite+$NH_4Cl$+ $NaHCO_3$ (lane 1-4); 160 days of incubation with only ferrihydrite (lane 5); ferric chloride+$NH_4Cl$ (lane 6); ferric citrate+$NH_4Cl$ (lane 7); 120 days incubation with ferrihydrite+$NH_4Cl$+$NaHCO_{3+}$ organic carbon (band 8); ferrihydrite+$NH_4Cl$+ organic carbon (lane 9). Still referring to FIG. 6, samples from 6 and 120 days of incubation without any addition (lanes 10 and 11) were used as controls.

Still referring to FIG. 6, all visible bands observed in the DGGE analysis (significant bands were marked) were excised from the gel and sequenced after cloning. Clone libraries from 12 samples resulted in 721 sequences of partial 16S rRNA gene fragments, and six groups of bacteria were classified via a phylogenetic analysis. During this 180-day anaerobic incubation with ferrihydrite and $NH_4Cl$, the microbial communities shifted dramatically and the microbial diversity decreased with time. See FIG. 6, lanes 1-4. Some DGGE bands disappeared gradually with time, such as band A5 and band A7. Band A5, represents a dissimilatory iron-reducing bacteria, Geobacter sp., which existed in this Fe(III)-rich wetland soil and reappeared for a short time during the initial anaerobic incubation. Band A7, represents an ammonia-oxidizing bacterium, *Nitrosomonas* sp., which showed a strong presence in the samples at 30 days of incubation and was attenuated after longer incubation times. In contrast, DGGE bands A6, A8 and A9 became more significant as the incubation time increased, showing that there were three groups of bacteria dominating in the system after 160 days of incubation. Band A6 represents a group of bacteria belonging to the Acidimicrobiaceae family. Bacteria from the Acidobacteriaceae family are represented by band A8. Some species in this family have been described as iron reducers and obligate heterotrophs (Kishimoto et al, 1991 Water Res 41: 2996-3004; Rowe et al., 2007 Environ Microbiol 9:1761-1771; Coupland and Johnson, 2008 FEMS Microbiol Lett 279:30-35). DGGE band A9 represents bacteria of the Rhodocyclaceae family. This family contains mainly denitrifying bacteria, which exhibit very versatile metabolic capabilities (Smith et al, 2005 Water Res 39: 2014-2023; Huang et al., 2011 Biogeosciences 8: 5251-5280).

Microbial communities also differed between samples incubated with various Fe(III) sources, and between samples with or without the addition of inorganic carbon. Samples supplied with either ferric chloride or ferric citrate as the Fe(III) source plus $NH_4^+$, and samples supplied with just ferrihydrite and no $NH_4^+$, had a decreased diversity in their bacterial communities. See FIG. 6, lanes 5-7. Samples supplied with both organic carbon (1.00 mmol $L^{-1}$ sodium citrate) and inorganic carbon (1.20 mmol $L^{-1}$ $NaHCO_3$) had a higher bacterial diversity. See FIG. 6, lane 8.

Changes in the microbial community after 180 days of incubation were also confirmed via 454-pyrosequencing, and the obvious growth of Actinobacteria, Acidobacteria and β-Proteobacteria groups (which band A6, A8 and A9 belong to) was consistent with the DGGE results, where the Actinobacteria cell number increased the most. Planctomycetes phylum, with which anammox bacteria are affiliated, was detected in the first 90 days of incubation, but disappeared or was below detection on day 160. Actinobacteria were also the dominant species in the Feammox enrichment reactor based on the results of the 16S rDNA library obtained via pyrosequencing.

The Acidimicrobiaceae bacterium, represented by band A6, which belongs to the Actinobacteria phylum, was the dominant species in the incubation experiments after 180 days of incubation (14.8% in total 16S rRNA gene sequences) as well as in the membrane reactor after 150 days of operation (40.2% in total 16S rRNA gene sequences). Its similarity to other Acidimicrobiaceae-related sequences was shown using a phylogenetic tree. The tree was constructed using the Bayesian inference (BI) method with 16S rRNA gene sequences from DGGE band A6 and bacteria from the Acidimicrobiaceae family from other studies. Unlike the bacteria represented by band A8 and A9, which were also found in samples that did not show Feammox transformations, this Acidimicrobiaceae bacterium was only detected in incubations (or reactor) that were augmented simultaneously with ferrihydrite, $NH_4Cl$, and $NaHCO_3$ and have shown Feammox activity.

EXAMPLE 15

Figure 7:
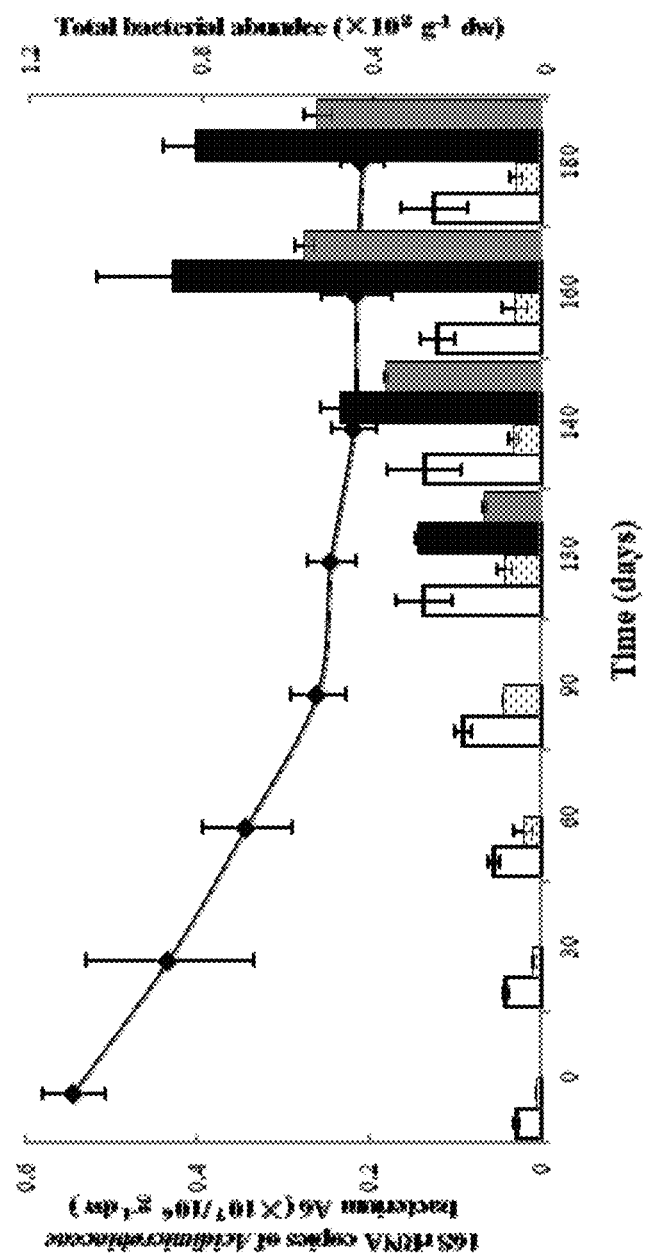
FIG. 7 illustrates abundance of total bacteria (closed rhombus) during 180 days of anaerobic incubation, 16S rRNA gene (black bars) and RNA copy numbers (gray bars) of Acidimicrobiaceae bacterium A6 in soil samples with 1.20 mmol $L^{-1}$ NaHCO$_3$ addition, 16S rRNA gene (white bars) and RNA copy numbers (dotted bars) of bacterium A6 with 0.20 mmol $L^{-1}$ NaHCO$_3$ addition.

Changes of Bacterial Abundance and Activity during Incubations and in the Reactor The total bacterial abundance determined via the 16S rRNA gene copy number, decreased during the 180-day incubation. FIG. 7 illustrates abundance of total bacteria (closed rhombus) during 180 days of anaerobic incubation. 16S rRNA gene (black bars) and RNA copy numbers (gray bars) of Acidimicrobiaceae bacterium A6 in soil samples with 1.20 mmol $L^{-1}$ $NaHCO_3$ addition. 16S rRNA gene (white bars) and RNA copy numbers (dotted bars) of bacterium A6 with 0.20 mmol $L^{-1}$ $NaHCO_3$ addition. Referring to FIG. 7, both, 16S rRNA gene and rRNA fragment copies of Acidimicrobiaceae bacteria (DGGE band A6) increased during the incubation, particularly after 90 days. Still referring to FIG. 7, the rRNA numbers increased slowly during the first 3 months and doubled between day 130 and day 140 of the incubation period. rRNA as a biomarker for changes of protein level, even though not as specific as mRNA, is a good indicator for bacterial activity (Poulsen et al., 1993 Appl Environ Microbiol 59: 1354-1360; Park et al., 2010 Environ Sci Technol 44: 6110-6116), both of which are incorporated by reference herein as if fully set forth. Increase in the denitrifier activity was most likely stimulated by the $NO_2^-$ generated via Feammox. The number of the amoA gene, representing the abundance of ammonia-oxidizing bacteria, decreased sharply with time and was hardly detected after 90 days of incubation. Through quantification of thaumarchaeal amoA genes, none of the acidophilic ammonia oxidizers were detected in the system.

In the Feammox reactor, the copy number of Acidimicrobiaceae bacterium A6, Anammox bacteria and nirS gene were $0.37 \times 10^7$, $0.13 \times 10^6$, and $0.92 \times 10^6$ copies $g^{-1}$ dw, respectively, while the amoA gene was not detected.

EXAMPLE 16

Changes of Bacterial Abundance and Activities with $NaHCO_3$ Amendment

Abundance and activity of Acidimicrobiaceae bacteria, represented by band A6, were compared between samples incubated under the same conditions except the amounts of $NaHCO_3$ added (0.20 mmol $L^{-1}$ vs. 1.20 mmol $L^{-1}$). From day 125 to day 180 of the incubation, both 16S rRNA gene and rRNA fragment numbers of Acidimicrobiaceae bacteria were higher in the soils with the higher inorganic carbon content. Referring to FIG. 7, the 16S rRNA gene copies of samples augmented with 1.20 mmol $L^{-1}$ $NaHCO_3$ were four times higher than those in samples that had been augmented with only 0.20 mmol $L^{-1}$ $NaHCO_3$. The rRNA copies of the Acidimicrobiaceae bacteria, showed even larger differences in response to the amounts of $NaHCO_3$ added. In the samples augmented with 1.20 mmol $L^{-1}$ $NaHCO_3$, the rRNA copy number increased from $0.04 \pm 0.06 \times 10^6$ to $0.19 \pm 0.09 \times 10^6$ copies $g^{-1}$ dw over 50 days of incubation (day 130 to day 180). Still referring to FIG. 7, however, in the samples to which only 0.2 mmol $L^{-1}$ $NaHCO_3$ were added on day 125, the rRNA number gradually deceased from $0.29 \pm 0.10 \times 10^5$ to $0.19 \pm 0.05 \times 10^5$ copies $g^{-1}$ dw during the same 50 days incubation.

EXAMPLE 17

Figure 8A:
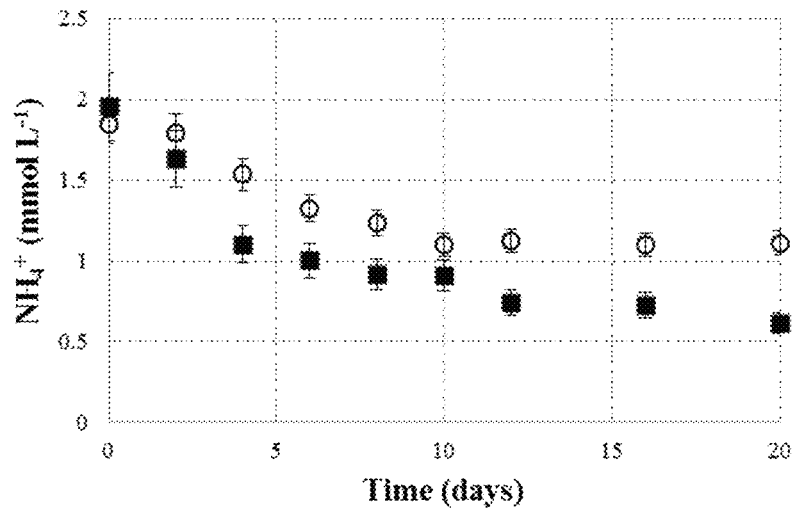
FIGS. 8A-8D illustrate concentration of $NH_4^+$ (FIG. 8A), $NO_2^-$ (FIG. 8B), $NO_3^-$ (FIG. 8C), and $N_2O$ (FIG. 8D) in the samples incubated with (open circle) or without (closed square) $C_2H_2$.
Figure 8B:
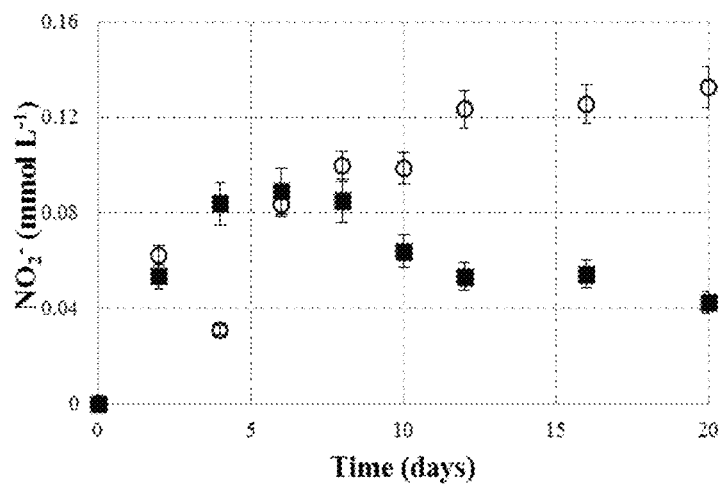
Figure 8C:
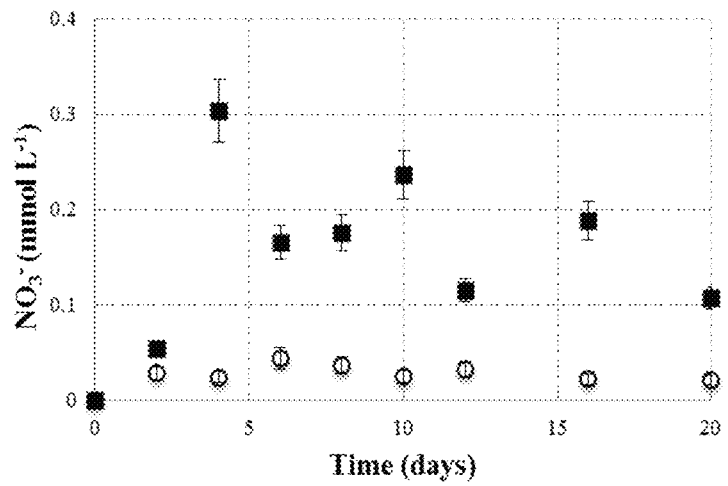
Figure 8D:
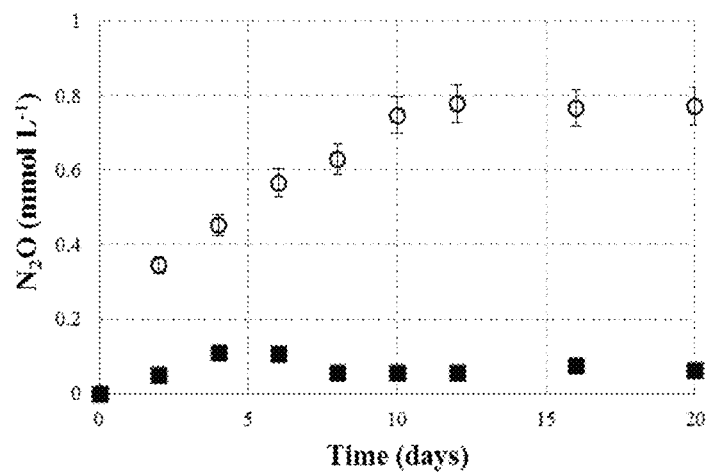

Nitrogen Species Changes in Samples Incubated in the Presence of $C_2H_2$ $C_2H_2$ can inhibit the oxidation of $NH_4^+$ to $NO_2^-$ under aerobic conditions, and the reduction of $N_2O$ to $N_2$ as well as the anammox pathway under anaerobic conditions (Yoshinari et al., 1977 Soil Biol Biochem 9: 177-183; Jensen et al., 2007 FEMS Microbiol Ecol 26: 17-26; Kartal et al., 2011 Nature 479:127-130, all of which are incorporated by reference herein as if fully set forth). To gain further insights into the nitrogen removal process observed, incubations with $C_2H_2$ were conducted. FIGS. 8A-8D illustrate concentration of $NH_4^+$ (FIG. 8A), $NO_2^-$ (FIG. 8B), $NO_3^-$ (FIG. 8C), and $N_2O$ (FIG. 8D) in the samples incubated with (open circle) or without (closed square) $C_2H_2$. The values represent the mean and standard error (n=3). After 20 days of incubation, less $NH_4^+$ was oxidized in the samples amended with $C_2H_2$, compared to those incubated without $C_2H_2$. Referring to FIG. 8A, $NO_2^-$, which is postulated to be the direct product of the $NH_4^+$ oxidation, accumulated slowly in samples incubated with $C_2H_2$. Referring to FIG. 8B, $NO_3^-$ reached a higher concentration in samples without $C_2H_2$ than in samples incubated with $C_2H_2$. Referring to FIG. 8C, $N_2O$, a product of $NO_2^-$ reduction, accumulated in samples incubated with $C_2H_2$, which inhibits the reduction of $N_2O$ to $N_2$. Fe(II) production was not much affected by the presence of $C_2H_2$, and after 20 days incubation was 4.36±0.72 and 5.71±0.67 mmol $L^{-1}$ in sample incubated with and without $C_2H_2$, respectively.

In $^{15}N$ isotope tracer incubations, detectable $^{15}N—N_2O$ was only found in samples amended with both, $^{15}NH_4Cl$ and Fe(III), with $^{15}N—N_2O$ production rates 2.14±0.059 or 0.072±0.023 µg $g^{-1}$ $d^{-1}$ in samples incubated with or without $C_2H_2$ treatment.

Referring to FIG. 6, DGGE band A5 represents dissimilatory iron-reducing bacteria, which appeared for a short time at the beginning of the anaerobic incubation. For longer incubation times these heterotrophic bacteria decreased rapidly. Referring to FIG. 2A and FIG. 4A, over a 25 day incubation period, more than three times the mass of Fe(II) was produced in samples amended with ferrihydrite and $NH_4^+$ as compared to the samples amended only with ferrihydrite, indicating that most of the Fe(III) reduction came from the Feammox reaction, and not from dissimilatory Fe(III) reduction.

Referring to FIG. 6, AOB represented by DGGE band A7, as well as the amoA gene, decreased after 30 days of incubation. Also, no AOA or acidophilic ammonia oxidizers were detected although the pH condition seems suitable for them in these incubations. Oxygen deficiency was the most likely reason for the decline in AOB in this system over time (Laanbroek et al., 1994 rch Microbiol 161:156-162). Referring to FIGS. 4A -4B, even though a small amount of AOB would be enough for $NH_4^+$ oxidation, in control samples to which no Fe(III) was added, and which AOB do not require, no $NH_4^+$ consumption was detected. Moreover, the decrease in amoA gene at a time of increasing $NH_4^+$ oxidation also indicates that neither AOB nor acidophilic ammonia oxidizers were the drivers of the $NH_4^+$ oxidation in the later incubation times.

An uncultured Acidimicrobiaceae bacterium became the dominant species during the 180-day anaerobic incubation period, increasing from 0.92% on day 0 in terms of cell numbers to 14.8% on day 160. Referring to FIGS. 1A-1B, FIGS. 2A-2B, and FIG. 6, in the incubation experiments conducted (which included controls with only $NH_4^+$, only iron, autoclaved, and various Fe(III) sources), this Acidimicrobiaceae bacterium was only detected and growing in samples to which $NH_4^+$ was supplied as an electron donor, ferrihydrite was supplied as electron acceptor, and $NaHCO_3$ was supplied as a carbon source. The abundance and activity of this Acidimicrobiaceae bacterium increased along with the Feammox activity during the incubations. Referring to FIG. 7, during the incubation period its rRNA changed from (0.22±0.01)×$10^5$ copies $g^{-1}$ dw to (0.28±0.07)×$10^6$ copies $g^{-1}$ dw, indicating a substantial increase in its activity. In the continuous flow membrane reactor, which had a high $NH_4^+$ removal and Fe(III) reduction rate, this Acidimicrobiaceae bacterium was enriched from an initial 14.8% to 40.2% after 150 days operation, and no other known $NH_4^+$ oxidizers (AOB or anammox) were detected. These results indicated that this Acidimicrobiaceae bacterium might play an important role in the Feammox reactions described in this study. According to a phylogenetic analysis, this bacterium has a 92% identity with Ferrimicrobium acidiphilum sp. F. acidiphilum, which belongs to the Acidimicrobiaceae family, and was first isolated from mine environments, and F. acidiphilum strain T23 is the only pure strain with a comprehensive characterization. Uncultured Ferrimicrobium sp. has been detected in mine water, but so far not in wetland soils. Ferrimicrobium sp. is an acidophilic heterotrophic ferrous iron oxidizing bacterium, which can also reduce Fe(III) under anoxic conditions (Johnson et al., 2009). The uncultured Acidimicrobiaceae bacterium, also has a 90% identity with Acidimicrobium ferrooxidans, a facultative autotroph in the same family that can reduce Fe(III) in anaerobic environments while oxidizing sulfide to sulfur and exists widely in soil environments.

According to a phylogenetic comparison with similar clones from studies reported in the GenBank, and taking into account its special growth characteristics (stimulated by inorganic carbon, oxidizing $NH_4^+$ coupled to Fe(III) reduction), also its gradual activity increase with increased Feammox activity, as well as a strong link with a Feammox enrichment reactor, this uncultured Acidimicrobiaceae bacterium A6 is probably a previously unreported species in the Acidimicrobiaceae family that might be either responsible or play a key role in the Feammox process described here. Referring to FIGS. 3A-3B and FIG. 7, Acidimicrobiaceae bacterium A6 was more active and the Feammox pathway was faster in samples with higher $NaHCO_3$ amendments, which, in addition to the fact that $\Delta G$ in Equation 1 is negative, indicates that if this Acidimicrobiaceae bacterium is actually responsible for conducting the Feammox reaction as depicted in equation 1, it may be an autotroph. Growth of nirS gene suggested that denitrification pathways were also active in the incubations described here. $NO_2^-$ that was being produced during the anaerobic $NH_4^+$ oxidation was reduced to $N_2$ by denitrifiers, and $NO_2^-$ did not accumulate in the system.

Referring to FIGS. 1A-1B and FIGS. 2A-2B, the Feammox reaction studied here proceeded only when iron oxides (ferrihydrite or goethite) were supplied as electron acceptor, whereas samples incubated with ferric chloride or ferric citrate as the Fe(III) source showed no measurable $NH_4^+$ oxidation. In the incubations to which ferric citrate was added as the Fe(III) source, Fe(III) was reduced rapidly by dissimilatory iron reducers, using organic carbon as electron donor. Referring to FIG. 6, the DGGE results for incubations with ferric citrate (lane 7) show that the most dominant species was an Actinobacterium, known to reduce iron under anaerobic conditions. Acidimicrobiaceae bacterium A6 was not detected in these incubations. Since acidic conditions as well as minimal dissolved Fe(II) and $NO_2^-$ concentrations are required to make the Feammox reaction energetically favorable as shown in Equation 1, the presence of iron oxides as the main Fe(III) source may have helped to maintain the concentrations of Fe(II) in solution below the detection limit through the incubation since iron oxides can sorb Fe(II) and/or incorporate it into their structure.

Various $NH_4^+$ oxidation products, i.e. $NO_3^-$, $NO_2^-$ and $N_2$, generated through the Feammox process are thermodynamically feasible, and were reported in different Feammox studies (Sawayama, 2006; Shrestha et al., 2009; Yang et al., 2012, which are incorporated by reference herein as if fully set forth). Because there was no initial nitrate or nitrite in the system, because all experiments were conducted under strict oxygen free conditions, and because of the rapid decrease of amoA genes, neither $NO_3^-$ reduction nor aerobic $NH_4^+$ oxidation could be the reason for the formation of $NO_2^-$ during the incubations. In all incubations where $NH_4^+$ was removed, the production of $NO_2^-$ was observed, although $NO_2^-$ did not accumulate. Most of the $NO_2^-$ produced from the $NH_4^+$ oxidation was reduced rapidly by denitrifiers, which were present in the incubations.

When $C_2H_2$ was used to stop the reduction of $N_2O$ to $N_2$, the total $N_2O$ (0.72±0.23 mmol $L^{-1}$) plus $NO_2^-$ produced (0.13±0.07 mmol $L^{-1}$) was equal to the $NH_4^+$ consumed, showing that $NH_4^+$ was not oxidized directly to $N_2$ in the samples. $^{15}N$—$NH_4^+$ incubations, as an extension of $C_2H_2$ treatment, showed that $^{15}N$—$N_2O$ built up when $^{15}NH_4Cl$ was added as the $NH_4^+$ source, demonstrating that $NH_4^+$ was oxidized during the Feammox process rather than be adsorbed or taken uptake by microorganisms in the system.

Although nitrification might happen in suboxic environments (oxygen<5 µM, Lam et al., 2007), $NH_4^+$ oxidation in the presence of $C_2H_2$ has never been reported. $C_2H_2$ is an inhibitor of ammonia monooxygenase (AMO), and can restrain aerobic $NH_4^+$ oxidizers from using oxygen by binding covalently to AMO (Hynes and Knowles, 1982; Hyman and Wood, 1985; Gilch et al., 2009). $C_2H_2$ can also inhibit the $NH_4^+$-activation step of anammox cells, which use $NO_2^-$ as the oxidant (Kartal et al., 2011). Therefore these Feammox bacteria might differ from common $NH_4^+$ oxidizers, by using an alternative $NH_4^+$ oxidation pathway that is not inhibited by $C_2H_2$, and AMO might not play a role in Feammox. The fact that $NH_4^+$ oxidation was not affected by the presence of acetylene is a further indication that AOB are not responsible for this process since they would be affected by acetylene. Furthermore, in the isotope tracer incubations, $^{15}N$—$N_2O$ was below the detection limit in samples to which Fe(III) was not supplied, showing again that $NH_4^+$ oxidation proceeded only when iron was being reduced.

Referring to FIG. 9, the role of anammox during the incubations was also evaluated. During the incubations the ratio of $NH_4^+$ oxidized to Fe(III) reduced increased gradually from 1:1.9 to 1:5.3, which is close to the stoichiometry of 1:6, shown in Equation 1. Although the discrepancies in the Feammox stoichiometry between iron and $NH_4^+$ are attributed in part to incompletely Fe(II) extraction, the influence of anammox activity in the earlier incubations would have contributed to a lower Fe(II) produced to $NH_4^+$ removed ratio than the theoretical value of 1:6.

The Feammox reaction became more dominant in terms of $NH_4^+$ oxidation after 125 days of incubation due to a relative increase in the activity of the Feammox bacteria. A parallel pathway to Feammox, such as anammox, could as mentioned above, explain the lower stoichiometric ratio, especially at earlier incubation times. In the samples taken before the incubation, 0.17±0.05×10$^6$ copies g$^{-1}$ dw of anammox rRNA gene were found, which decreased to 0.09±0.06×10$^5$ on day 130. It was postulated that anammox was responsible for some initial $NH_4^+$ and $NO_2^-$ removal, and denitrification became more dominant for $NO_2^-$ removal later during the incubation period. $NH_4^+$ removal via Anammox in the early incubations may also explain why the observed $NH_4^+$ oxidation rates and the abundance of Acidimicrobiaceae A6 did not change proportionally over the full incubation period.

EXAMPLE 18

Influence of Environmental Factors on Feammox Pathway in Soil Environments

Sample collection. Soils for all the experiments described in this study were taken from a series of local wetland-, upland-, as well as storm-water detention pond-sediment at New Jersey and labeled according to the samples location as L, A, P, C, B, V and W. Three soil cores were collected from 0 cm to 20 cm soil from each sample location, and transported to the laboratory within 2 hours for further analysis.

Analysis of chemical properties. Physicochemical characteristic of these soils such as soil pH; Fe content [Fe (III) and Fe(II)]; nitrogen species ($NO_3^-$, $NO_2^-$ and $NH_4^+$); sulfate ($SO_4^{2-}$); phosphate ($PO_4^{3-}$); dissolve organic carbon (DOC) were determined. pH was measured immediately using a pH electrode. A 0.5N HCl extraction was conducted for 24 hour at room temperature to determine acid-extractable Fe(II) and $NH_4^+$ concentrations in the soils. Fe(II) was analyzed using the ferrozine assay method (39), and $NH_4^+$ was analyzed using a Dionex™ Ion Chromatograph (LC3000) with a CS-16 Colum and a CS-16 guard column (flow rate=1.0 mL min$^{-1}$, detection limit=0.012 ppm). $NO_3^-$, $NO_2^-$, $SO_4^{2-}$ and $PO_4^{3-}$ concentrations were measured from anaerobic DI water extraction for 1 hour, via Ion Chromatography, using an AS-22 Colum along with an AG-22 guard column (flow rate=1.2 mL min$^{-1}$, detection limit=0.016 ppm). For the DOC analyses a Shimadzu TOC-5000(A) was used.

Batch incubation. A series of incubation experiments were conducted. Soil samples from each location were divided into 12×10 g (air-dry equivalent) subsamples, and added into 50 mL serum vials, with 30 mL deionized water. The soil slurries were purged thoroughly with a $CO_2$:$N_2$ (80:20) mixture, and then incubated under anaerobic condition in glove box.

In the first incubation experiment, Feammox activities of each sample were checked. In day 0 to 15, no $NH_4^+$ or Fe(III) was added to the incubations. On day 16, samples were amended with 5 mmol·L$^{-1}$ $NH_4Cl$ and 30 mmol·L$^{-1}$ ferrihydrite, and continue incubated under anaerobic condition. On day 45, 2 mmol·L$^{-1}$ $NH_4Cl$ and 5 mmol·$^{-1}$ ferrihydrite were added again after $NH_4^+$ was exhausted. Autoclaved sterilized soils were incubated as controls. Triplicate samples were collected from two vials every four days to analyze iron and nitrogen species.

The second incubation was conducted to check how pH and $NO_2^-$ concentration control Feammox reaction. For pH incubation, enrichment culture with Acidimicrobiaceae bacterium A6 were exposed to different pH gradients, pH=2, 4.5, 6.5, 8 (adjusted with HCl and NaOH). For $NO_2^-$ incubation, enrichment cultures were added with different concentration of $NO_2^-$ (0.02, 0.2, 1.0, 2.0 mmol·L$^{-1}$ as final concentrations). The initial concentrations of Ferrihydrite were 25 mmol·L$^{-1}$ and 2 mmol·L$^{-1}$ $NH_4^+$ was added. Triplicate samples were collected every two days to analyze iron, nitrogen species, and also the copy number of Acidimicrobiaceae bacterium A6.

DNA was isolated as described in Example 6.

QPCR was carried out for total bacteria, anammox bacteria and Acidimicrobiaceae bacteria, represented by 16S rRNA genes, using primer sets 1055f/1392r, Amx368f/Amx820r and acm342f/439r, respectively. (Harms et al. 2003; Schmid et al, 200, 2003 and Huang and Jaffe, 2013, all of which are incorporated by reference as if fully set forth) For the detection of denitrifiers, denitrifying functional genes (nirS) were quantified with primer sets NirS3/

NirSS (Braker et al., 1998, which is incorporated by reference herein as if fully set forth). Thermal cycling conditions for total 16S rDNA and nirS gene numbers were essentially as described in Example 7.

Statistical analysis. Correlations between the bacterial distributions vs. the environmental factors were analyzed with the canonical correspondence analysis (CCA) using R (22). Analyses of Spearman rank, multivariate and stepwise linear regressions of environmental and bacterial abundance variables were carried out using SPSS v12 on both raw and log-transformed data. All data were analyzed using one-way analysis of variance (ANOVA) with the significant level P<0.05.

It has been shown that anammox activity is optimal at a pH of 7.8-8.0 and temperatures between 28° C.-35° C. In anammox reactors, the DO concentration is usually maintained between 0.2 mg/L-1 mg/L to allow for partial nitritation, which is required to achieve satisfactory $NH_4^+$ removal. In soils environments, anammox bacteria are usually present under slightly oxic conditions, which again, ensures that AOB are able to provide adequate $NO_2^-$ levels. Both AOB and anammox bacteria are autotrophic, therefore the organic carbon content in soils does not affect their $NH_4^+$ oxidation rate, except for *Nitrosopumilus maritimus* (an AOB species) which was reported to be inhibited by organic substrates even at very low concentrations.

AOB and anammox bacteria usually coexist in hypoxic environments, since AOB provide the $NO_2^-$ for the anammox reaction. Hence, Feammox bacteria, which also produce $NO_2^-$ while oxidizing $NH_4^+$, may enhance anammox in environments where AOB are not active. Batch incubations of soil samples at sites where Feammox activity was observed have shown that after $NH_4^+$ was oxidized to $NO_2^-$ by the Feammox process, nitrogen loss proceeded via denitrification and/or anammox. Since, as shown by equation 1, removal of $NO_2^-$ makes the reaction more favorable, the coexistence of Feammox with denitrifiers and/or anammox may be key for anaerobic ammonium oxidation in soil environments.

Therefore, influence of the different environment factors on the Feammox presence/activity in soil environments was investigated, the relationships between Feammox bacteria and other microorganisms responsible for nitrogen transformations in soils were determined.

Chemical properties of samples collected from different locations Soil and sediment samples collected for this study cover a wide range of chemical properties: pH from 4.26 to 7.21; Fe(III) from 120 to 1243 mg kg$^{-1}$; Fe(II) from 7.92 to 356 mg kg$^{-1}$; $NH_4^+$ from 6.02 to 86.0 mg kg$^{-1}$; $NO_3^-$ from 6.71 to 274.8 mg kg$^{-1}$; $NO_2^-$ from 4.74 to 152.8 mg kg$^{-1}$; $SO_4^{2-}$ from 4.89 to 128.6 mg kg$^{-1}$; $PO_4^{3-}$ from 2.97 to 28.5 mg kg$^{-1}$; DOC from 9.37 to 28.09 g kg$^{-1}$.

Most of the soil and sediment samples selected for this study were acidic. pH value of surface soil samples (top 5 cm of soil,) was higher than that of soil below 10 cm. Concentrations of $NO_3^-$ and DOC were also higher in the surface soils. $NO_3^-$ were only showed in samples from 0 to 5 cm of soil, but hardly detected in soils collected from 10 to 20 cm in L7. On the contrary, $NO_2^-$ was found more rich below 10 cm than the upper soil samples in most of the locations.

All of these soil samples were iron rich, compared to the total iron levels usually reported for wetland soils (100 mg kg$^{-1}$ to 620 mg kg$^{-1}$) and sediment environments (30 to 120 mg kg$^{-1}$). Fe(III) concentrations in vegetation-covered soil samples were obvious higher than the other samples. In additional, Fe(III) concentrations in soil collected from rhizosphere, were much higher than that from non-rooting zone at the same location. Fe (II) abundance shown a different trend, and was found negatively correlated (r=−0.61 p=0.001) with Fe(III) in the same sample locations.

Among these samples, samples originated from a forested riparian wetland area that was 0.5 km near some agricultural lands, have higher $NH_4^+$ and $PO_4^{3-}$ contents. The distribution of $SO_4^{2-}$ in samples of this study was similar to that of $NO_3^-$ between different sample locations but shown no obvious discrepancy with sample depth.

Feammox activity and abundance of Acidimicrobiaceae bacterium A6 Fe (II) production and $NH_4^+$ consumption were checked after two weeks anaerobic incubation to monitor the Feammox activity in different samples. After 15 days of anaerobic incubation without the addition of extra $NH_4^+$ and Fe(III), all samples showed clearly iron reduction, form 2.10 to 8.86 mmol·L$^{-1}$.

The existence and abundance of the Feammox Acidimicrobiaceae bacterium A6 in soil and sediment samples were determined via qPCR analysis. Abundance of Acidimicrobiaceae bacterium A6 in the field samples shown consistent with the anaerobic $NH_4^+$ consumption in incubations, and a positively correlation (r=0.58 p=0.012) were revealed between them.

Feammox activity in incubation with different pH and $NO_2^-$ concentrations. The Feammox reaction was most active in samples with pH 4.5. When pH increased or decreased, $NH_4^+$ oxidation and Fe reduction slow down, and Feammox reaction seem to stop at a pH 2.0 or 8.0. Abundance of Feammox Acidimicrobiaceae bacterium A6 increased after 14 days anaerobic incubation in samples with pH 2, 4.5, or 6.5 and slightly decreased in alkaline conditions. There was no significant difference between number of Acidimicrobiaceae bacterium A6 in samples incubated with pH 4.5 and 6.5, which is 2.37×10$^4$ and 2.41×10$^4$ copies mL$^{-1}$, respectively.

Feammox activity was sensitive to $NO_2^-$ concentration in the samples. Feammox reaction processed when $NO_2^-$ concentrations were 0.02 and 0.2 mmol·L$^{-1}$, but it was inhibited when $NO_2^-$ reached to 1.0 mmol·L$^{-1}$. Changes of Acidimicrobiaceae bacterium A6 abundance were consistent with Feammox activities with different concentration of $NO_2^-$ were added. In samples with 1.0 and 2.0 mmol·L$^{-1}$ $NO_2^-$ were added, the numbers of Acidimicrobiaceae bacterium A6 were decreased after incubation.

CCA analysis of Feammox distributions in soil samples.

Figure 12A:
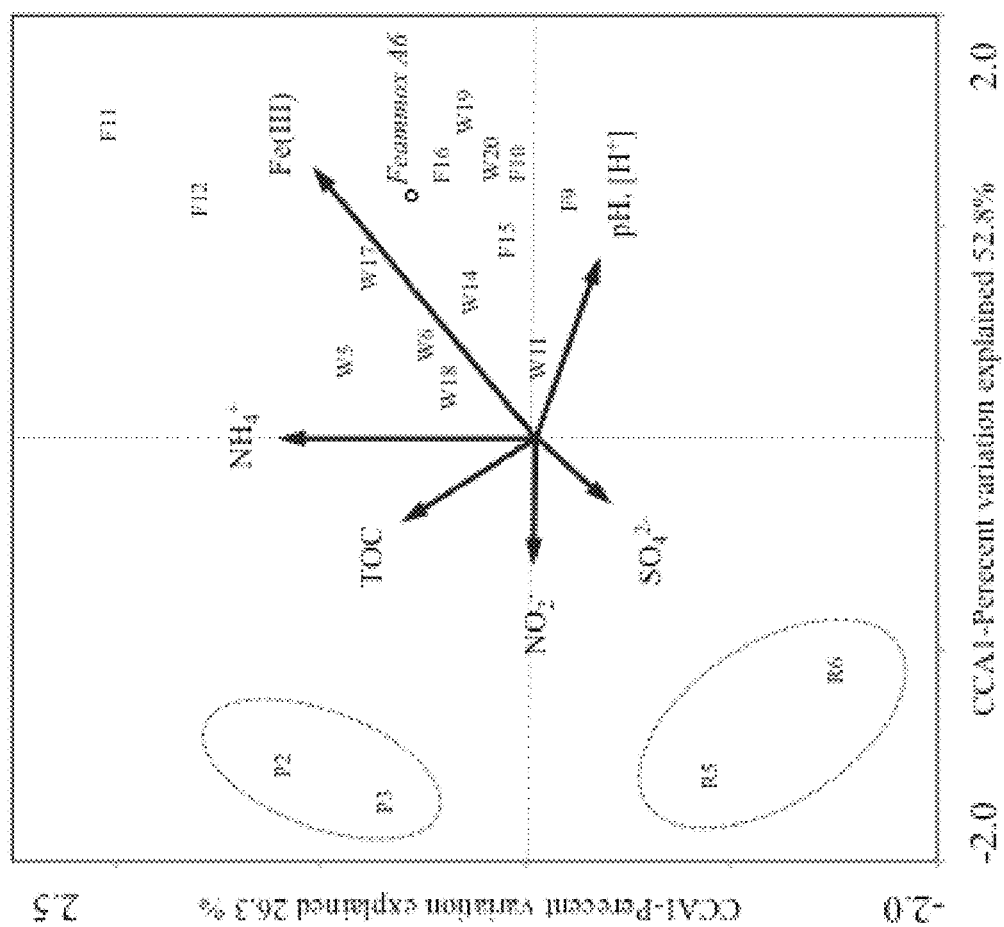
FIGS. 12A-12B illustrate ordination plots of the canonical correspondence analysis (CCA) for the first two dimensions of CCA of the relationship between the environmental factors and Feammox bacteria vs. environment factor of soil analysis and relation of Feammox to other bacterial communities affecting the nitrogen cycle.
Figure 12B:
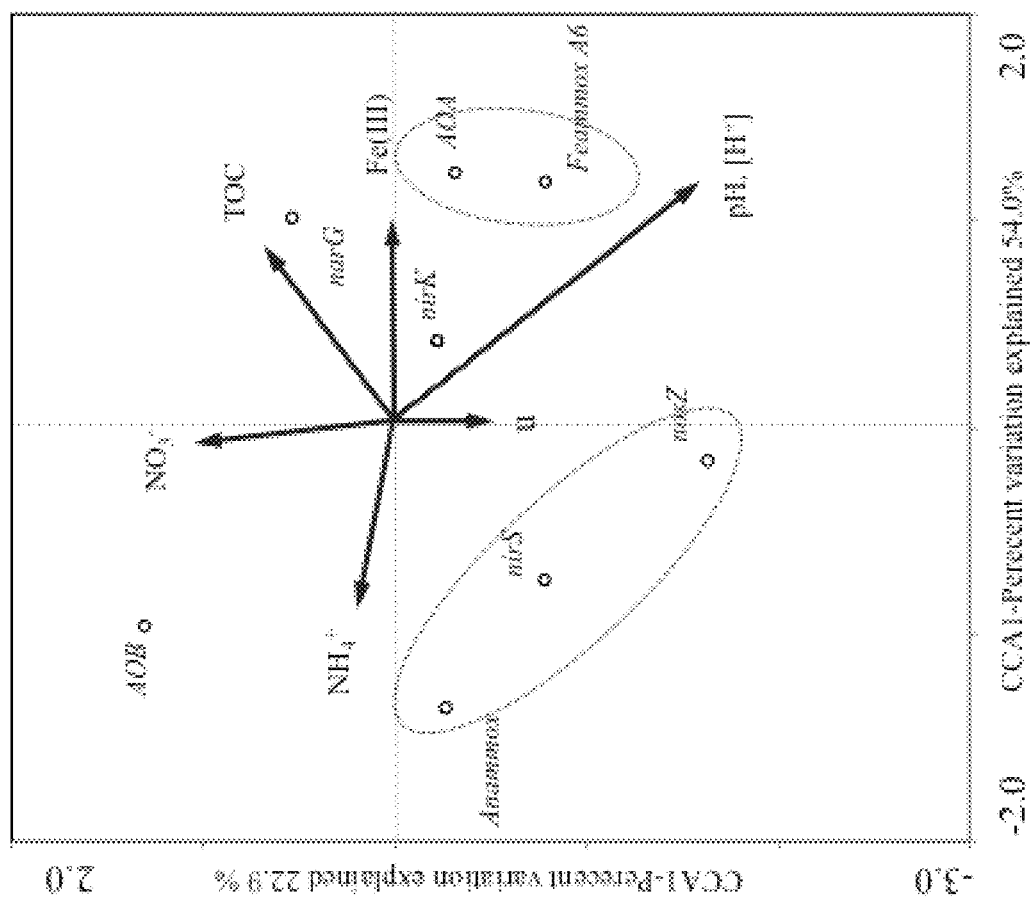

Soils for all the experiments described in this study were taken from three areas: New Jersey and South Carolina in Unities States, Guangdong province in China. A total of 52 locations were selected and cover 4 different types of soil samples, which are wetland soils (W), river sediments (R), forest soils (F), paddy soils (P). FIGS. 12A-12B illustrate ordination plots of the canonical correspondence analysis (CCA) for the first two dimensions of CCA of the relationship between the environmental factors and Feammox bacteria vs. environment factor of soil analysis and relation of Feammox to other bacterial communities affecting the nitrogen cycle. FIG. 12A illustrates the total variance in the bacterial abundance and the cumulative variance of the bacteria-environment relationship. FIG. 12B illustrates the total variance in the microbial composition and the cumulative variance of the bacteria-sampling location relationship.

Referring to FIG. 12A, the CCA analysis of Feammox bacteria and nitrogen microorganisms in response to environmental variables confirmed the influence shown in this figure. The first two CCA axes (CCA1 and CCA$_2$) explained 73.2% of the total variance in the bacterial abundance and 80.6% of the cumulative variance of the bacteria-environment relationship. pH value (p=0.030) and Fe(III) content (p=0.021) had significant effects on the distributions of Acidimicrobiaceae bacterium A6, and $NO_2^-$ seemed to inhibit this bacteria by showing a negatively correlation. Concentrations of $NO_2^-$ were supporting anammox bacterial existence (p=0.025), and the combined effects of $SO_4^{2-}$ and $NO_2^-$ affects the distribution of nirS genes. $NH_4^+$ content was not limited for either Feammox or aerobic/anaerobic $NH_4^+$ oxidation bacteria. Referring to FIG. 12B, the first two CCA axes (CCA1 and $CCA_2$) explained 71% of the total variance in the microbial composition and 81% of the cumulative variance of the bacteria-sampling location relationship. The CCA analysis showed that CCA1 represented the pH level of the soils. Referring to FIG. 12B, sample with Feammox activity assembled in a low pH area, while other soil samples distributed in the opposite pH area showed no Feammox reaction. CCA2 represents the vertical distributions of soil samples, soils collected from similar depth gathered together. More aerobic or anaerobic $NH_4^+$ oxidation bacteria were found in surface soil samples. It was observed that Feammox bacteria and denitrifiers tended to be active at depths below 10 cm of the soil environments.

EXAMPLE 19

Reduction of Uranium by Acidimicrobiaceae Bacteria A6 with Ferrihydrite as the Iron Source Acidimicrobiaceae bacteria A6 from a pure culture were prepared for uranium (U) bioreduction experiments. Twelve 15-mL vials of bacteria in their normal growth medium were centrifuged after which the bacteria were resuspended in a modified anaerobic growth medium. Of the twelve vials, three contained bacteria that had been autoclaved to establish a control condition with dead bacteria. The centrifugation and washing was repeated twice. The modified anaerobic growth medium consisted of $NaHCO_3$, $KHCO_3$, $MgSO_4 \cdot 7H_2O$, $CaCl_2$, and AQDS. It differed from the normal growth medium in that it did not contain $KH_2PO4$, which was removed due to its high sorption of U, or $NH_4Cl$, which was added separately. Uranyl acetate was added to all vials such that the initial concentration of U was approximately 64 µM.

The twelve vials were divided into four groups: three different control conditions and the experimental condition as shown in Table 1. Ammonium ($NH_4^+$) in the form of $NH_4Cl$ was added to the three experimental vials as an electron source for the bacteria. In the first control condition, $NH_4Cl$ was also added, but the microbial monooxygenase enzyme was inhibited by the addition of $Na_2S$. The second control condition, mentioned earlier, contained bacteria that had been killed in an autoclave. $NH_4Cl$ was added to this condition, as well. No $NH_4Cl$ was added to the third control condition to establish an electron donor-limited control. No iron (Fe) was added to any vials, but some ferrihydrite, a common ferric oxyhydroxide, which acted as the Fe source in the original pure culture medium remained with the bacteria through the washing process.

TABLE 1

Experimental and control conditions in U bioreduction experiment with ferrihydrite as Fe source

| | Experimental | Control 1: Enzyme Inhibited | Control 2: Autoclaved Bacteria | Control 3: No $NH_4^+$ |
|---|---|---|---|---|
| $NH_4^+$, mM | 3.98 ± 0.01 | 3.96 ± 0.01 | 4.01 ± 0.02 | 0.03 ± 0.01 |
| Initial total U, µM | 64.8 ± 15.6 | 65.5 ± 6.3 | 65.4 ± 6.1 | 59.3 ± 17.0 |
| $Na_2S$, µM | 0 | 20 | 0 | 0 |
| Acidimicrobiaceae bacteria A6 | Live | Live | Dead | Live |

In Table 1, values given for $NH_4^+$ and U concentrations are the averages of three vials±one standard deviation The extent of Acidimicrobiaceae bacteria A6 activity in each condition was monitored by measuring concentrations of U and $NH_4^+$ on the day the experiment started and again six days later. Samples for $NH_4^+$ analysis were filtered using 0.2 µm nylon filters and stored at 4° C. until they were analyzed using a Dionex™ Ion Chromatograph ICS3000 with a CS-16 column, a CS-16 guard column, and a CERS 500 (4 mm) suppressor. Samples for U(VI) analysis were also filtered at 0.2 µm to remove reduced U(IV) precipitates and were preserved in $_2$% $HNO_3$. Unfiltered samples for total U analysis were mixed in a 1:1 ratio with 0.2 M $NaHCO_3$ to dissolve any U(IV) that had been reduced by the bacteria. After a 24-hour extraction at room temperature, these samples were also preserved in $_2$% $HNO_3$. U measurement in acidified samples was completed on a Thermo Scientific Element 2 inductively-coupled plasma mass spectrometer (ICP-MS).

Figure 13:
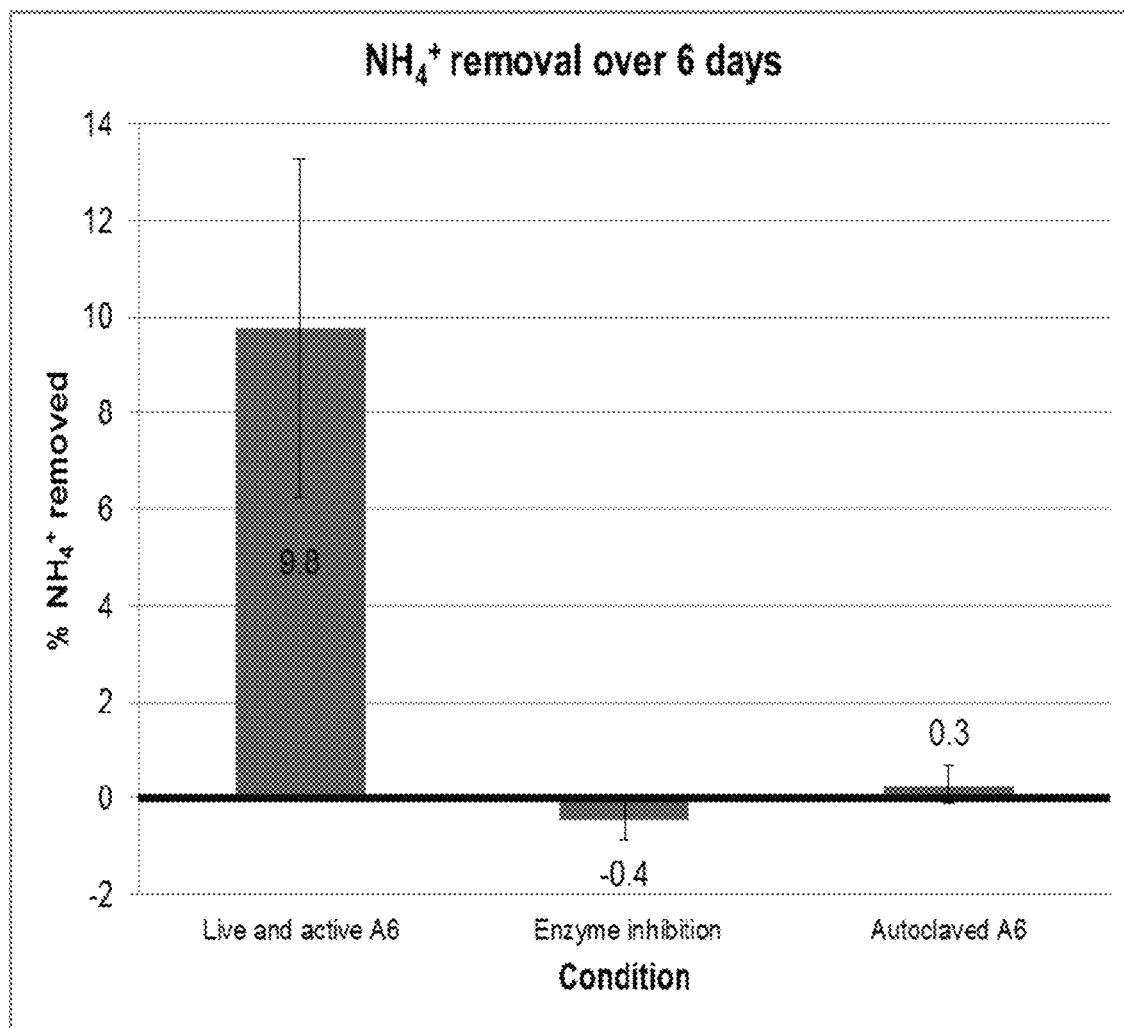
FIG. 13 illustrates $NH_4^+$ oxidized over 6 days by Acidimicrobiaceae bacteria A6.

Reduction of Uranium by Acidimicrobiaceae bacteria A6 with Ferrihydrite as the Iron Source. $NH_4^+$ analyses indicate that Acidimicrobiaceae bacteria A6 were only active in the experimental condition which contained live bacteria with $NH_4^+$ and U. FIG. 13 illustrates $NH_4^+$ oxidized over 6 days by Acidimicrobiaceae bacteria A6. Uranium (U) was present in all conditions. Referring to FIG. 13, percentages shown are an average of three replicates. Error bars indicate one standard deviation. Referring to FIG. 13, over 6 days, bacteria in this condition oxidized an average of 7.0 mg $L^{-1}$ of $NH_4^+$ which is equivalent to the removal of 9.8% of the initial $NH_4^+$. $NH_4^+$ oxidation was not seen in any of the control conditions which suggests that Acidimicrobiaceae bacteria A6 were not active in these conditions. In the control conditions in which the relevant monooxygenase enzyme was inhibited, the average $NH_4^+$ concentration increased by 0.31 mg $L^{-1}$ indicating no $NH_4^+$ oxidation. Similarly, in the control condition containing autoclaved bacteria, the average $NH_4^+$ concentration decreased by 0.20 mg $L^{-1}$ indicating no significant $NH_4^+$ oxidation. In the control in which no $NH_4^+$ was added, the concentration of $NH_4^+$ actually increased from an average concentration of 0.52 mg $L^{-1}$ to 1.83 mg $L^{-1}$. This increase was seen in all three replicates and could indicate nitrogen release through the death and decay of Acidimicrobiaceae bacteria A6 that were deprived of their requisite electron donor $NH_4^+$.

Figure 14:
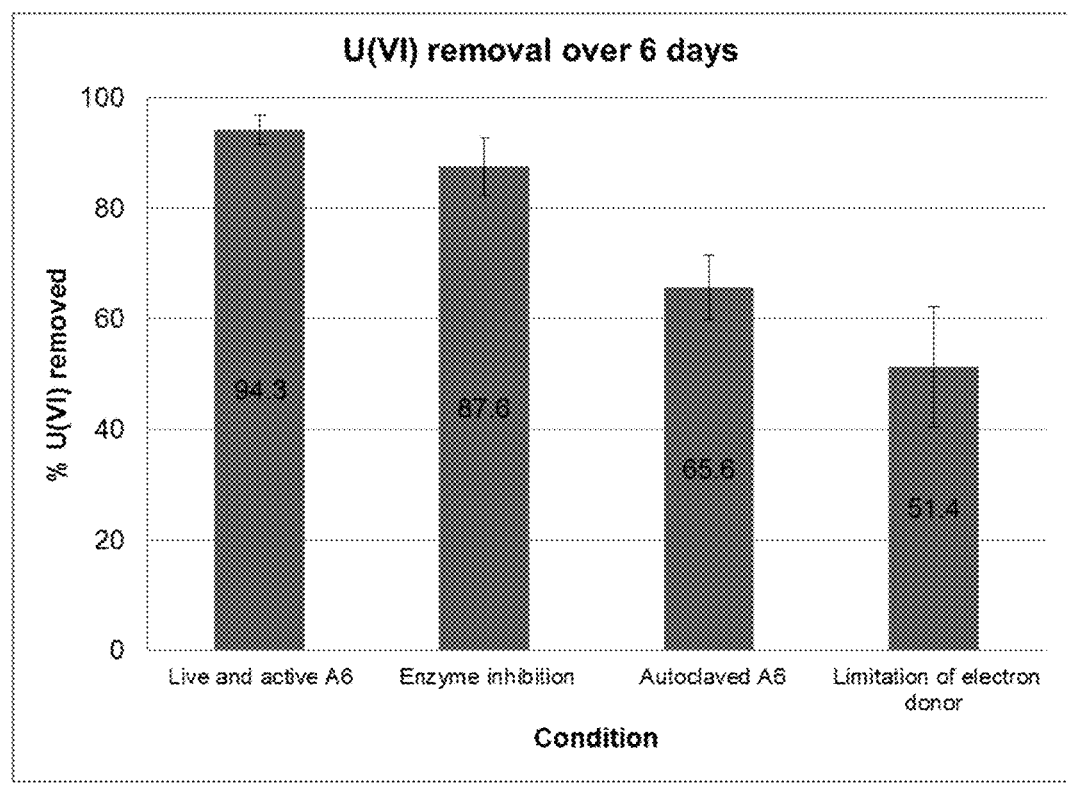
FIG. 14 illustrates uranium U(VI) removed from solution over 6 days.

Measurement of U concentrations indicates that biological reduction is one of multiple pathways by which U was removed from solution in these experiments. Across all experimental and control conditions, between 74% and 91% of the added U disappeared from solution within 2 hours of uranyl acetate addition. It is likely that this U(VI) sorbed to ferrihydrite which remained with the bacterial cells through the centrifugation and washing procedure. As a result, the effective initial aqueous U(VI) concentrations varied from 7.2 µM to 13.2 µM U(VI). FIG. 14 illustrates uranium U(VI) removed from solution over 6 days. Referring to FIG. 14, the difference between the "Live and active A6" condition and both the "Autoclaved A6" and the "Limitation of electron donor" conditions is attributable to U reduction by Acidimicrobiaceae bacteria A6. Percentages shown are an average of three replicates. Error bars indicate one standard deviation.

Referring to FIG. 14, significant U(VI) removal in all conditions continued after the initial removal by sorption. In the three control cases, the lack of $NH_4^+$ oxidation indicates that Acidimicrobiaceae bacteria A6 were inactive and thus the U(VI) removal in those cases must have been abiotic. It is likely that U diffusion into the matrix of ferrihydrite caused the removal of 51.4% and 65.6% of effective initial aqueous U(VI) over 6 days in the $NH_4^+$-limited and autoclaved controls, respectively. This two-step uranyl sorption to ferric oxyhydroxides is an established phenomenon (Hsi CKD and Langmuir D 1985 Geochim Cosmochim Ac 49, 1931-1941; Morrison, S J et al., 1995 J Contam Hydrol 17, 333-346, both of which are incorporated herein by reference as if fully set forth). In the enzyme inhibited control, even more U(VI) was abiotically removed over 6 days than in the autoclaved or $NH_4^+$-limited control. The additional U(VI) removal in this case is likely due to abiotic U(VI) reduction by the added enzyme inhibiting compound, $Na_2S$. The sulfide in $Na_2S$ is able to act as an electron donor for U(VI) reduction (Hua B et al. 2006 Environmental Science & Technology 40, 4666-4671, which is incorporated herein by reference as if fully set forth).

Referring to FIG. 14, comparison of U(VI) removal in the experimental condition and the controls with autoclaved bacteria and with $NH_4^+$ limitation suggests that biotic reduction of U(VI) by Acidimicrobiaceae bacteria A6 is significant. Without the help of reductants like $Na_2S$, the U(VI) removal in vials with live and active bacteria exceeds the highest removal in vials with dead bacteria by 25%. Since these conditions are identical except for the state of the bacteria, it is reasonable to conclude that the additional U(VI) reduction is performed by Acidimicrobiaceae bacteria A6.

EXAMPLE 20

Reduction of Uranium by Acidimicrobiaceae Bacteria A6 with Nontronite as the Iron Source Cell suspension experiments with nontronite, an Fe-rich clay, were performed to study U bioreduction by Acidimicrobiaceae bacteria A6 in an environment rich in electron accepting Fe(III) to promote Acidimicrobiaceae bacteria A6 activity. This experiment was similar to the cell suspension experiments without the addition of an Fe source as described above. Pure culture of Acidimicrobiaceae bacteria A6 in twelve 15-mL vials was washed by centrifugation and resuspension in anaerobic growth medium consisting of $NaHCO_3$, $KHCO_3$, $MgSO_4 \cdot 7H_2O$, $CaCl_2$, and AQDS.

Nontronite (NAu-2) from the Source Clay Repository of the Clay Minerals Society was selected as an electron acceptor for this experiment due to its inability to sorb significant amounts of U at slightly acidic pH. The structural formula of this clay is $M^+_{0.72}[Si_{7.55}Al_{0.45}][Fe_{3.83}Mg_{0.05}]O_{20}(OH_4)$ where $M^+$ represents monovalent interlayer cations (Keeling J L et al. 2000 Clay Clay Miner 48, 537-548, which is incorporated herein by reference as if fully set forth). This clay is 23.4% Fe by weight, of which 99.4% is Fe(III) (Liu D et al. 2011 Geochim Cosmochim Ac 75, 1057-1071, which is incorporated herein by reference as if fully set forth). A stock solution of 20 g $L^{-1}$ nontronite was prepared using a previously established protocol (Liu et al. 2011, which is incorporated herein by reference as if fully set forth). Briefly, the clay was ground by hand with mortar and pestle before it was soaked in 0.5 mM NaCl overnight. The solution was centrifuged to eliminate all but the 0.02-0.5 µm size fraction. These remaining particles were washed with deionized water and dried in an oven at 100° C. The clay was diluted to 20 g $L^{-1}$ in deionized water and autoclaved to create a sterile stock solution. This stock solution was added to all 12 vials so that the final concentration of nontronite in each vial was 5 g $L^{-1}$.

Again, the twelve vials were divided into four groups: one experimental group and three control groups as described in Table 2. To establish the experimental condition with live and active Acidimicrobiaceae bacteria A6, $NH_4Cl$ and uranyl acetate were added so that the initial concentrations of $NH_4^+$ and U were 3.726 mM and 12.5 µM, respectively. The first control condition contained bacteria that had been autoclaved, but $NH_4Cl$ and uranyl acetate were added to these control vials so that they were otherwise identical to the experimental condition. The second control condition contained live bacteria and U, but no $NH_4^+$ was added to these vials to distinguish the effects of live and active bacteria from live and inactive bacteria. The third control condition contained live bacteria and added $NH_4^+$, but did not contain any U in order to determine whether the presence of U altered the activity of Acidimicrobiaceae bacteria A6.

Fe(II) was measured at intervals of 24 to 48 hours throughout the experiment to gauge Fe-reducing activity of Acidimicrobiaceae bacteria A6. 20 µL of unfiltered samples were deposited in 1 mL of 0.5 N HCl. After 15 minutes, Fe(II) was measured using the well-established ferrozine method (Komlos J and Jaffe P R, 2004 Biodegradation 15, 315-325, which is incorporated herein by reference as if fully set forth). Briefly, Fe(II) was measured by adding 30 µL of HCl-extracted sample to 1.5 mL of ferrozine and measuring the absorbance after 30 minutes at a wavelength of 562 nm in a Spectronic Genesys 2 spectrophotometer. Absorbances were converted to molar concentrations of Fe(II) using a standard curve.

TABLE 2

Experimental and control conditions in U bioreduction experiment with nontronite as Fe source

|  | Experimental | Control 1: Autoclaved Bacteria | Control 2: No $NH_4^+$ | Control 3: No U |
|---|---|---|---|---|
| $NH_4^+$, mM | 3.726 mM | 3.726 mM | 0 mM | 3.726 mM |
| Initial total U, µM | 12.5 ± 2.3 | 11.8 ± 0.3 | 12.4 ± 0.5 | 0 |

TABLE 2-continued

Experimental and control conditions in U bioreduction experiment with nontronite as Fe source

|  | Experimental | Control 1: Autoclaved Bacteria | Control 2: No $NH_4^+$ | Control 3: No U |
|---|---|---|---|---|
| Nontronite, g $L^{-1}$ | 5 | 5 | 5 | 5 |
| Acidimicrobiaceae bacteria A6 | Live | Dead | Live | Live |

Concentrations of Fe(II) measured by the ferrozine method include aqueous Fe(II) and approximately 74% of the Fe(II) sorbed to nontronite surfaces (Zhang GX et al. 2009 *Geochim Cosmochim Ac* 73, 3523-3538, which is incorporated herein by reference as if fully set forth). Therefore, these measurements were used only in relation to each other to track bacterial Fe(II) production indicating Acidimicrobiaceae bacteria A6 activity. U, $NH_4^+$, nitrate ($NO_3^-$), and nitrite ($NO_2^-$) concentrations were measured after 0, 7, and 11 days to determine activity of Acidimicrobiaceae bacteria A6. Total U and U(VI) concentrations were measured by ICP-MS as described above. $NH_4^+$, $NO_3^-$, and $NO_2^-$ concentrations were measured on a Dionex™ Ion Chromatograph ICS3000. Columns used for $NH_4^+$ were identical to those described above. $NO_3^-$ and $NO_2^-$ analysis was carried out with an AS-22 column, an ΔG-22 guard column, and an ASRS 300 (4 mm) suppressor. It had previously been determined that $NH_4^+$ could sorb to nontronite, so total $NH_4^+$ was also measured. Sorbed $NH_4^+$ was extracted from nontronite by adding 20 µL samples from each vial to 1 mL of 0.5 N HCl. After 20 hours, the acid extractions were filtered on 0.2 µm nylon filters and preserved at 4° C. until the $NH_4^+$ concentrations were measured on a Dionex™ Ion Chromatograph.

Purity of bacterial cultures was confirmed after the experiment using DNA isolation and quantitative polymerase chain reaction (qPCR) assay. 1 mL samples of the slurry containing bacteria, growth medium, and nontronite were centrifuged at 1000 rpm for 10 minutes before DNA was extracted from the pellets using the FastDNA® spin kit for soil (MP Biomedicals, USA) as described by the manufacturer. Total bacterial abundance was represented by the number of copies of 16S rRNA genes quantified by qPCR with primers BACT1369F-PROK1492R and the TaqMan probe1389F (Suzuki MT et al. 2000 *Appl Environ Microb* 66, 4605-4614, which is incorporated herein as if fully set forth). Acidimicrobiaceae bacteria A6 bacteria were enumerated with the primer set acm342f-439r (Huang S and Jaffe PR 2015 *Biogeosciences* 12, 769-779, which is incorporated herein by reference as if fully set forth). Several other U-reducing species were also targeted to check the samples for contamination. To investigate the presence of sulfate and Fe reducing bacteria, δ-Proteobacteria was enumerated by qPCR using primer set 361F-685R and the TaqMan probe 1839F (Stults J R et al. 2001 *Appl Environ Microb* 67, 2781-2789, which is incorporated herein by reference as if fully set forth). Geobacter, the dominant Fe-reducing microorganisms in sediment environments, was enumerated by qPCR primer set 561F-825R and TaqMan probe Gbc2 (Stults et al. 2001, which is incorporated herein by reference as if fully set forth). Anaeromyxobacter spp., a metal-reducing group of bacteria, was enumerated with the 60E-461R primer pair (Petrie L et al. 2003 *Appl Environ Microb* 69, 7467-7479, which is incorporated herein by reference as if fully set forth). All qPCR experiments were carried out using a StepOnePlus™ Real-Time PCR System (Life Technologies, USA). For DNA quantification, each qPCR mixture (20 µL) was composed of 10 µL of SYBR Premix Ex Taq® II (Takara, Japan), 0.8 µL of 10 µM of each primer, and ~10 ng DNA template. Each assay contained a set of standards produced by serial dilution of plasmids containing specific target genes, independent triplicate templates for each slurry sample, and triplicate no template controls (NTC).

Figure 15:
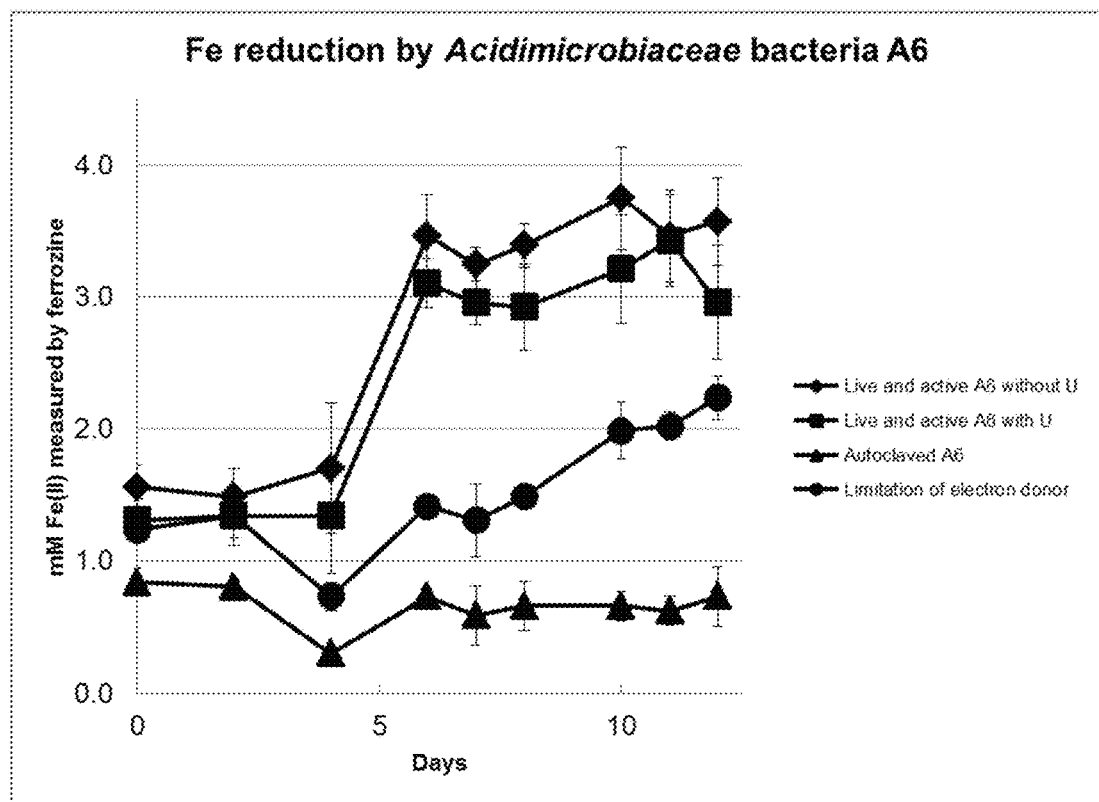
FIG. 15 illustrates reduction of Fe in nontronite over 12 days.

Reduction of Uranium by Acidimicrobiaceae bacteria A6 with Nontronite as the Iron Source. Measurements of Fe(II) confirm that Acidimicrobiaceae bacteria A6 remain active in the presence of U and nontronite. FIG. 15 illustrates reduction of Fe in nontronite over 12 days. Values shown are averages of three replicates. Error bars indicate one standard deviation. Referring to FIG. 15, Fe(II) production was similar in rate and extent in conditions with and without U, indicating that the addition of 10 µM uranyl acetate is not toxic to Acidimicrobiaceae bacteria A6. In cases with and without added U, Acidimicrobiaceae bacteria A6 were able to use the Fe(III) in nontronite as an electron acceptor for $NH_4^+$ oxidation. Still referring to FIG. 15, in the condition with autoclaved Acidimicrobiaceae bacteria A6, the Fe(II) remained constant throughout the 12-day experiment. This result indicates that there was no abiotic Fe cycling occurring in the vials.

Figure 16:
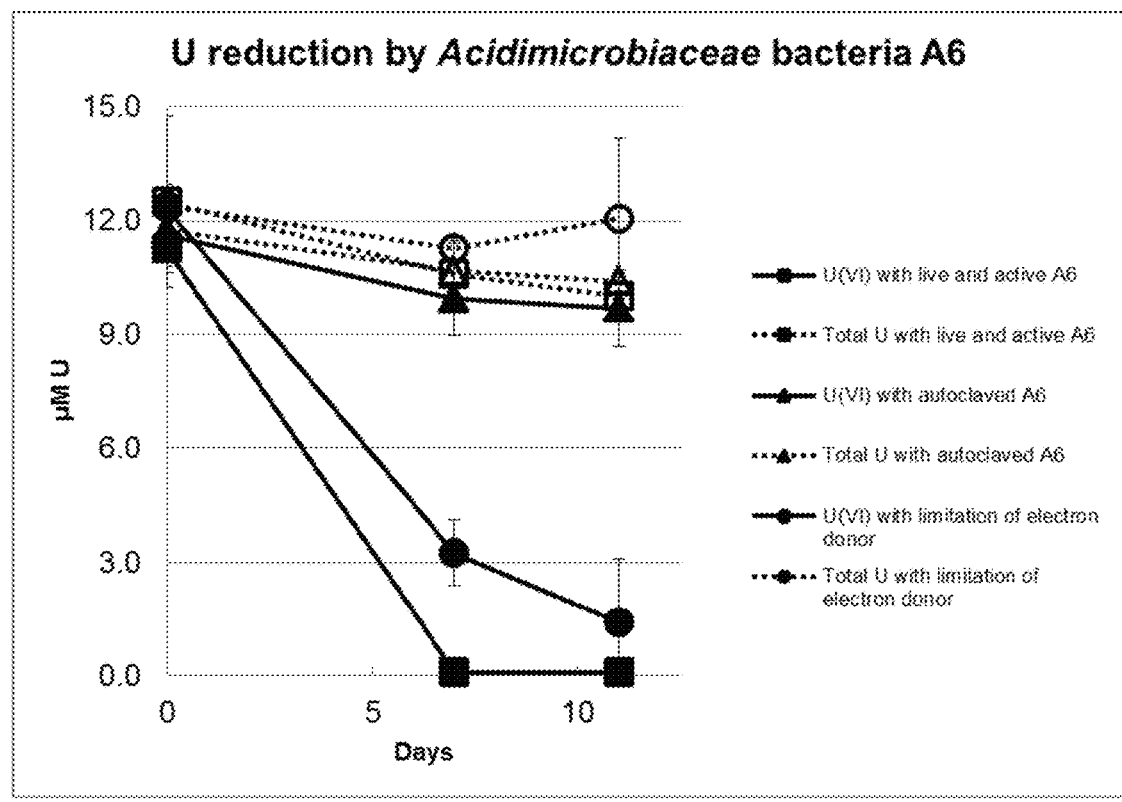
FIG. 16 illustrates total U and U(VI) concentrations over 11 days.

Results indicate that Acidimicrobiaceae bacteria A6 can reduce U in addition to Fe. FIG. 16 illustrates total U and U(VI) concentrations over 11 days. Values shown are averages of three replicates. Error bars indicate one standard deviation. Referring to FIG. 16, essentially all of the U(VI) disappeared from solution in 7 days in the condition with live Acidimicrobiaceae bacteria A6, $NH_4^+$, and U. This change cannot be attributed to activity of other bacteria, as qPCR results indicated that only Acidimicrobiaceae bacteria A6 were present in all vials with live bacteria. Referring to FIG. 16, this change in U(VI) also cannot be attributed to sorption of U to nontronite or ingredients of the growth medium because the aqueous U(VI) concentrations remained essentially equivalent to total U concentrations in vials in which Acidimicrobiaceae bacteria A6 had been killed. The similarity between U(VI) and total U in the condition with autoclaved bacteria also demonstrates that no abiotic U reduction occurred. The difference between vials with dead and live Acidimicrobiaceae bacteria A6 indicate that Acidimicrobiaceae bacteria A6 can reduce aqueous U(VI) to U(IV) solids. It has previously been determined that *Shewanella oneidensis* MR-1 are also able to completely reduce U in the presence of nontronite (Zhang GX et al 2009, which is incorporated herein by reference as if fully set forth). *Shewanella oneidensis* MR-1 are only able to reduce U in the presence of AQDS; though this present study did not examine the effect of AQDS on U reduction by Acidimicrobiaceae bacteria A6, it is likely that they similarly require AQDS (Zhang GX et al 2009, which is incorporated).

In all vials except one, the total U measured by bicarbonate extraction decreased over 11 days. This change likely resulted from the slow incorporation of U into the structure of nontronite where it would be unaffected by the extraction.

Unexpectedly, Fe and U reduction occurred in vials without $NH_4^+$ for the live Acidimicrobiaceae bacteria A6 to oxidize. In these vials, the Fe(II) increased and U(VI) decreased more slowly and to a lesser extent over 12 days than they did in vials with $NH_4^+$. These results could indicate that the live Acidimicrobiaceae bacteria A6 area able to use a structural component of the nontronite as an electron donor rather than $NH_4^+$. Alternatively, biomass turnover and decomposition could provide the remaining live Acidimicrobiaceae bacteria A6 with $NH_4^+$. In this case, the lower proportion of live bacteria and the lower concentrations of $NH_4^+$ would explain the slower rates and smaller extent of Fe and U reduction.

EXAMPLE 21

Bioreduction of Cu(II) by Feammox

Figure 17A:
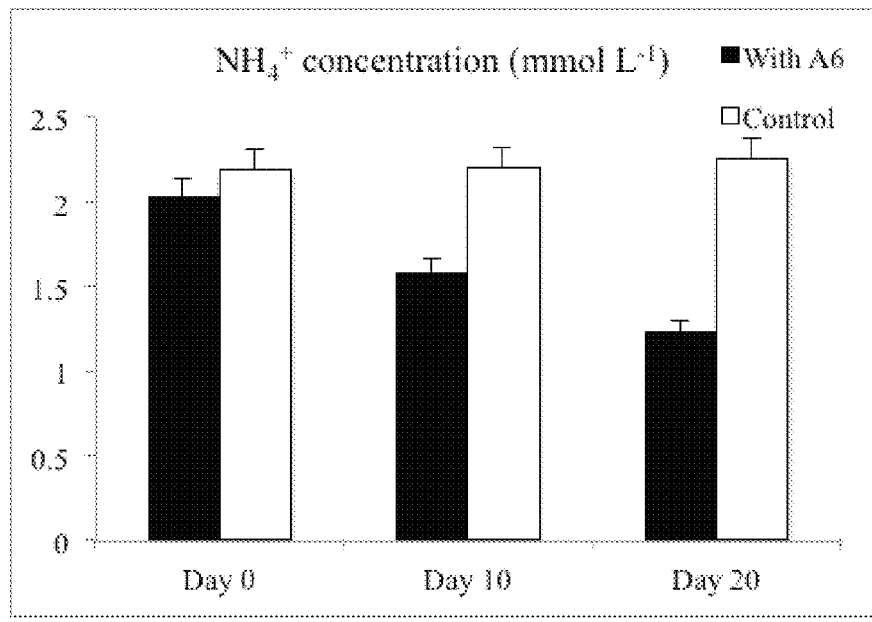
FIGS. 17A-17B illustrate oxidation of $NH_4^+$ (FIG. 17A) and bioreduction of Cu(II) (FIG. 17B) by Feammox. Filled bars are for results with A6, and open bars are controls.
Figure 17B:
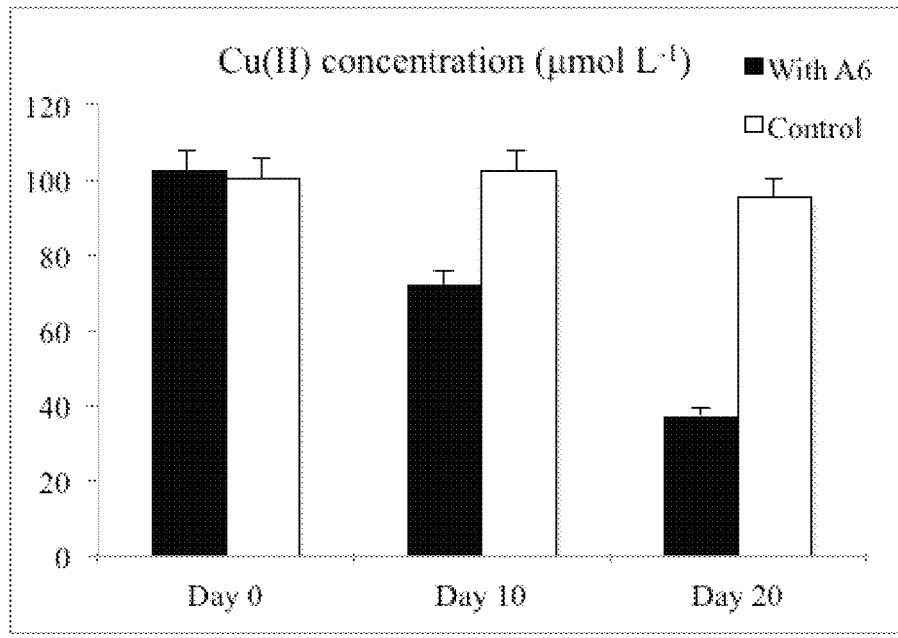

FIGS. 17A-17B illustrate oxidation of $NH_4^+$ (FIG. 17A) and reduction of Cu (II) (FIG. 17B) by Feammox. Around $10^4$ cell per ml of pure A6 were incubated in inorganic $NH_4^+$-Ferric iron liquid medium with 20 ppm Copper (II) chloride ($CuCl_2$) under anaerobic conditions for 40 days. Referring to FIG. 17B, 64.2% of Cu(II) was reduced and the total dissolved Cu [including Cu(II) and Cu(I)] decreased by 23.1% over the incubation period, while the concentrations of Cu(II) and Cu(I) remained constant for the autoclaved treatment.

After the incubation, the samples were aerated to reoxidize the reduced copper. This resulted in full recovery or the initial Cu(II).

EXAMPLE 22

Investigation of Selected Organic Contaminants Biodegradation by Feammox

Around $10^4$ cell per ml of pure A6 were incubated in inorganic $NH_4^+$-Ferric iron liquid medium with 1000 ppb Trichloroethylene (TCE) /1000 ppb tetrachloroethylene (PCE)/100ppb benzene/ 100ppb phenathrene under anaerobic conditions for 40 days. Six 15-mL vials of incubations were conducted for each organic contaminant. The six vials were divided into three groups: two different control conditions and the experimental condition as shown in Table 3.

TABLE 3

Experimental and control conditions in selected organic contaminants biodegradation by Feammox

|  | Experimental | Control 1: Enzyme Inhibited | Control 3: No $NH_4^+$ |
|---|---|---|---|
| $NH_4^+$, mM | 2.96 ± 0.12 | 2.97 ± 0.05 | 0.02 ± 0.01 |
| Initial total TCE/PCE/benzene/ phenathrene, ppb | 1000/1000/ 100/100/ | 1000/1000/ 100/100/ | 1000/1000/ 100/100/ |
| $Na_2S$, μM | 0 | 50 | 0 |
| Acidimicrobiaceae bacteria A6 | Live | Live | Live |

Subsamples were taken on day 0, 12, 22, 30 and 37 under anoxic conditions. Samples for $NH_4^+$ analysis were filtered using 0.2 um nylon filters and stored at 4° C. until they were analyzed using a Dionex™ Ion Chromatograph ICS3000 with a CS-16 column, a CS-16 guard column, and a CERS 500 (4 mm) suppressor. TCE, PCE, benzene or phenathrene were measured with a Thermo Scientific Vanquish UHPLC system. FIGS. 18A-18D illustrate an effect of biodegradation of trichloroethylene (TCE) (FIG. 18A), tetrachloroethylene (PCE) (FIG. 18B), benzene (FIG. 18C) and phenanthrene (FIG. 18D) by Feammox. Around $10^4$ cell per ml of pure A6 were incubated in inorganic $NH_4^+$-Ferric iron liquid medium with 1000 ppb Trichloroethylene (TCE) (FIG. 18A), 1000 ppb tetrachloroethylene (PCE) (FIG. 18B), 100 ppb benzene (FIG. 18C), 100 ppb phenanthrene (FIG. 18D) under anaerobic conditions for 40 days.

Figure 18A:
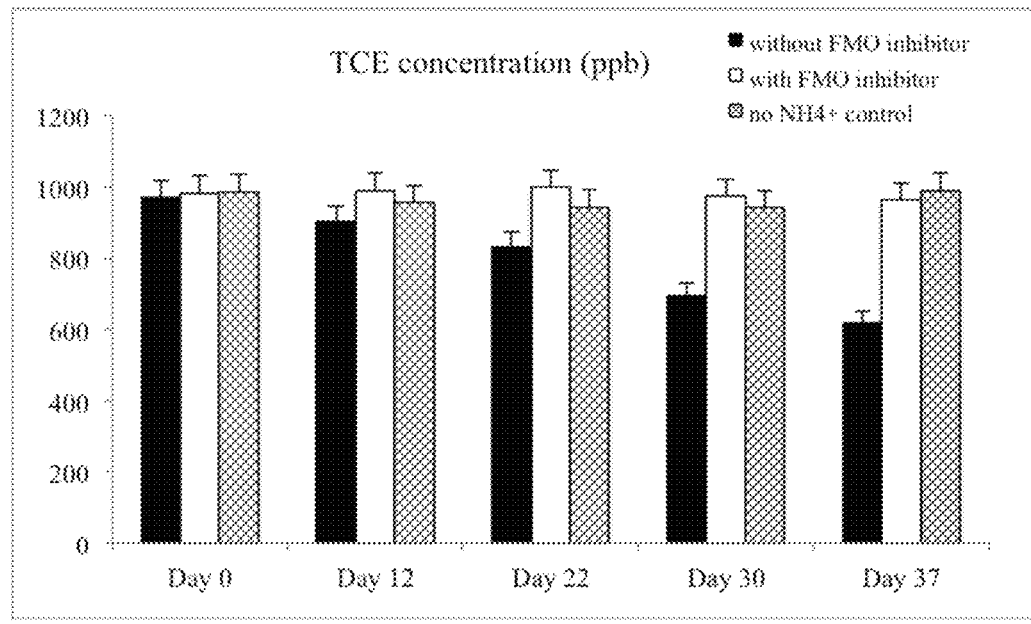
FIGS. 18A-18D illustrate an effect of biodegradation of trichloroethylene (TCE) (FIG. 18A), tetrachloroethylene (PCE) (FIG. 18B), benzene (FIG. 18C) and phenanthrene (FIG. 18D) by Feammox. Filled bars are for results without FMO inhibitor, open bars are for results with FMO inhibitor and crosshatched bars are no $NH_4^+$ controls.
Figure 18B:
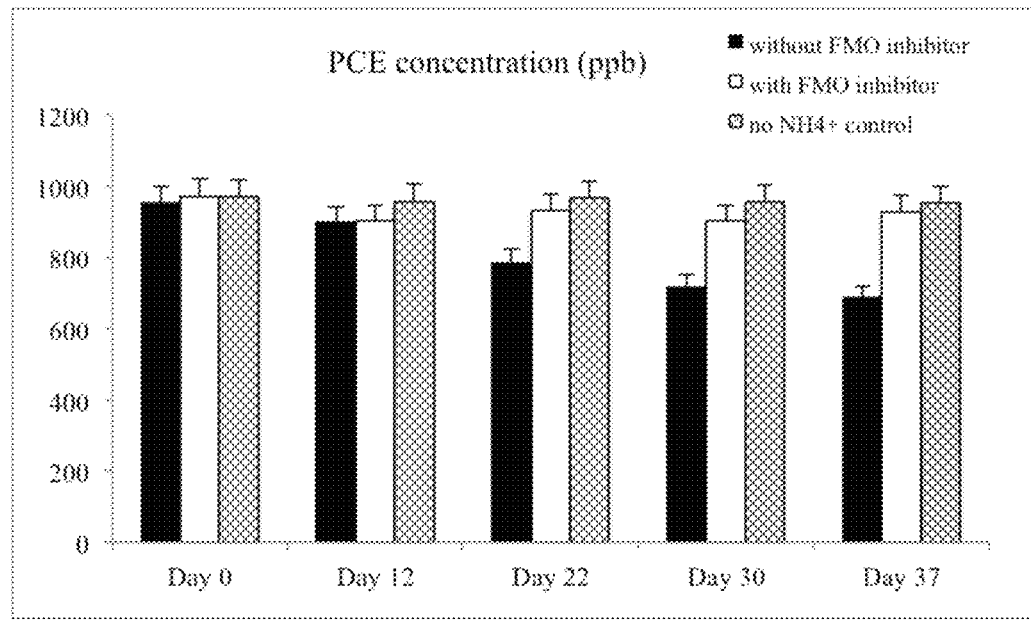
Figure 18C:
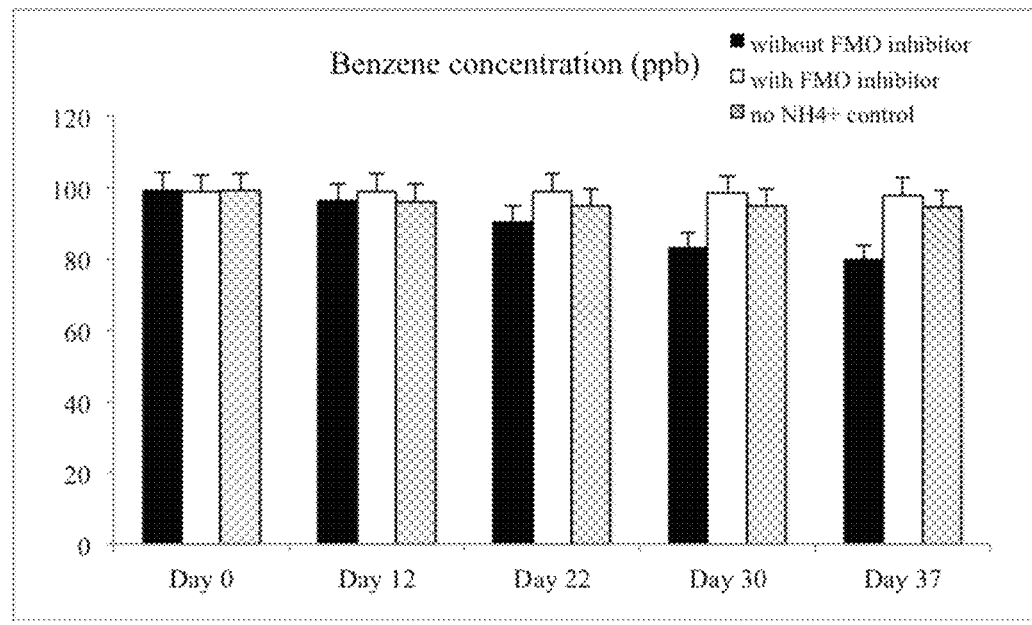
Figure 18D:
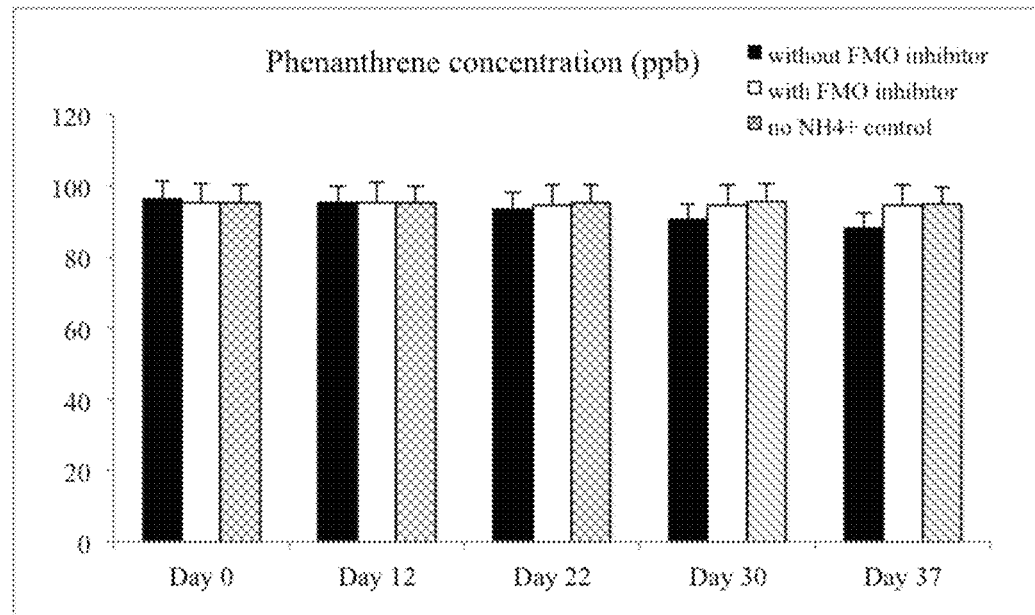

Referring to FIGS. 18A-18B, TCE, PCE, benzene and phenanthrene degradation were found in all Feammox active samples, but not in the samples that included Feammox enzyme inhibitor (sodium bisulfide) and samples without $NH_4^+$. It was observed that 36% of TCE, 28% of PCE, 20% of benzene and 8.8% of phenanthrene was degraded over an incubation period of approximately one month. $NH_4^+$ oxidation was not seen in any of the control conditions, which suggests that Acidimicrobiaceae bacteria A6 were not active in these conditions that also did not result in the degradation of the organics.

It should be noticed that all of the above are extremely recalcitrant compounds, especially in anaerobic environments. Higher degradation rates can be achieved by having larger bacterial numbers. The bacterial numbers for higher degradation may be $10^6$, $10^8$ or $10^{10}$ cells per ml of pure A6.

EXAMPLE 23

Characteristics of Feammox Acidimicrobiaceae Bacterium A6 and Enzyme Identification Feammox bacteria were isolated in inorganic $NH_4^+$-Ferric iron solid medium from wetland soils collected in New Jersey as described in Examples 2-17. The bacteria were cultured in liquid and solid media.

Inorganic $NH_4^+$-Ferric iron liquid medium contained the following components per liter: 177 mg $NH_4Cl$, 77.9 mg $(NH_4)_2SO_4$, 19.8 mg $NaHCO_3$, 71.0 mg $KHCO_3$, 9.00 mg $KH_2PO_4$, 100 mg $MgSO_4.7H_2O$, and 60.0 mg $CaCl_2.2H_2O·3.37$g ferrihydrite, 18.42 mg antraquinone-2,6-disulfonate (AQDS) and 1 mL trace element solution and vitamin (ATCC®). Inorganic $NH_4^+$-Ferric iron solid medium was prepared with liquid medium and 0.8% agar, 0.2 mL 3.37 g $L^{-1}$ ferrihydrite was spread on the surface.

Figure 19B:
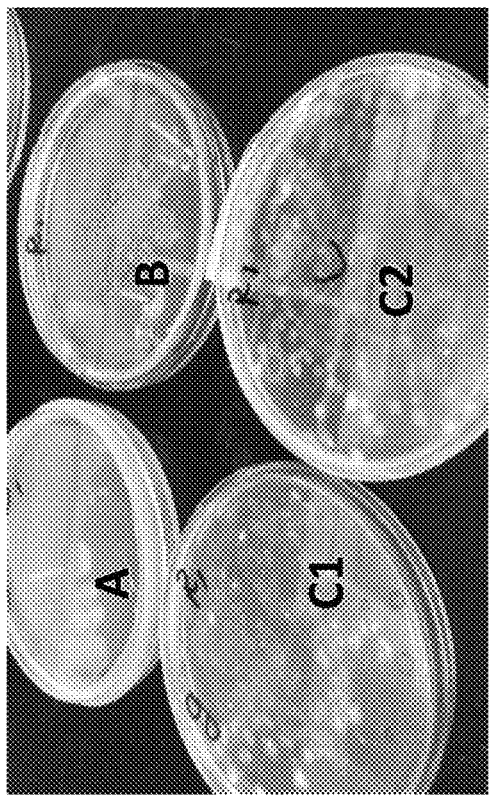
FIGS. 19A-19D illustrate A6 bacterial cultures and cells.
Figure 19D:
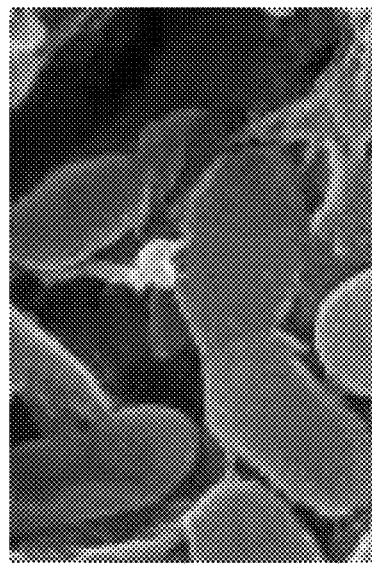
Figure 19A:
Figure 19C:
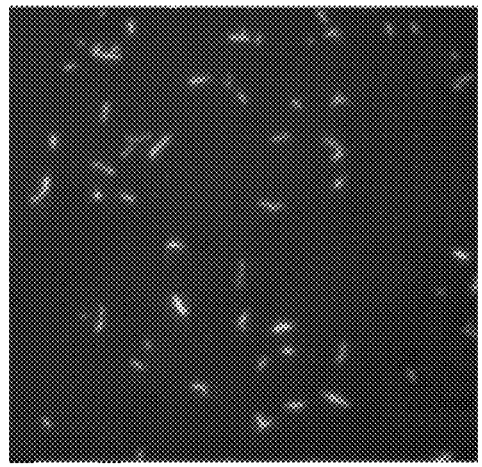

FIGS. 19A-19D illustrate A6 bacterial cultures and cells. FIG. 19A illustrates growth of the A6 bacterium in the liquid medium. Cultures of A6 became increasingly turbid and black-colored (due to accumulation of ferrous iron) during incubation. Culture doubling times of the A6 isolate were 10.2 days. FIG. 19B illustrates A6 growth on the solid inorganic $NH_4^+$-ferric iron medium. Colonies of A6 are displayed with black spot (iron-encrusted) on the solid medium. FIGS. 19C-19D show rod-shaped A6 cells. The cells were 1,5-3 mm long by 0.5 mm wide. The A6 bacteria are gram-positive bacteria. On the solid medium, colonies with black spot (accumulation of ferrous iron) were collected and transferred to inorganic $NH_4^+$-Ferric iron liquid medium. Their Feammox activity was verified by the $NH_4^+$ oxidation and iron reduction rates. A strain of Actinobacteria was isolated and identified as Feammox bacteria, and named Feammox Acidimicrobiaceae bacterium A6. The pH optimum for growth of A6 was 4.5, but reasonable activity was detected from pH 2 to 7. Its temperature optimum was 25° C., and a doubling time of 10.2 days. A $^{13}C$ labeled $CO_2$ amendment was conducted, and the $^{13}C$ in cells of A6 increased from 1.80% to 10.3% after 14 days incubation. In a separate incubation, $^{15}NH_4Cl$ was added with a final concentration of 0.5 mmol $L^{-1}$, and 0.133 mmol $L^{-1}$ of $^{15}NO_2^-$ was detected, while no $^{15}NO_3^-$ was produced.

The genome size and guanine-cytosine content of A6 are 3.3 mega base pairs (Mb) and 52%. The Feammox ammonium Monooxygenase (FMO) gene (SEQ ID NO: 8), was identified. FMO is considered to be the functional gene coding ammonium oxidation coupled to ferric iron reduction in A6.

Isolation, purification and cultivation of bacteria: Continuous flow membrane Feammox enrichment reactor Soil samples from wetland soils collected in New Jersey were inoculated into a continuous flow membrane reactor, which was operated under anaerobic conditions by constantly purging $N_2$ trough the reactor's headspace at a room temperature (25° C.), and with a 48 hour hydraulic retention time. FIG. 11 illustrates a scheme of a membrane reactor for $NH_4^+$ oxidation via Feammox. Referring to this figure, 1 refers to the feed solution, 2 refers to the feed pump, 3 refers to the membrane module, 4 refers to the floater connected to an electrical on/off switch, 5 refers to the ceramic diffuser, 6 refers to the $N_2$ supplier, 7 refers to the water bath, 8 refers to outflow, and 9 refers to the outflow pump. Inorganic $NH_4^+$-Ferric iron liquid medium contained the following components per liter: 177 mg $NH_4Cl$, 77.9 mg $(NH_4)_2SO_4$, 19.8 mg $NaHCO_3$, 71.0 mg $KHCO_3$, 9.00 mg $KH_2PO_4$, 100 mg $MgSO_4 \cdot 7H_2O$, and 60.0 mg $CaCl_2 \cdot 2H_2O$. 3.37 g ferrihydrite, 18.42 mg AQDS and 1 mL trace element solution and vitamin (ATCC®). pH was controlled at around 4~5, and dissolve oxygen was <0.10 mg/L. Samples form the outflow were collected every two days, and sludge samples from reactor were collected and kept at −20° C. for molecular biology analysis.

454 pyrosequencing was performed with samples collected from the membrane reactor after 150 days of reactor operation with Domain-specific primers, targeting the V3-V5 region of the 16S rDNA of bacteria were amplified following methods suggested by Pinto et al. 2012, PLoS One 7: 43093, which is incorporated herein by reference as if fully set forth. And the results were compared with samples from previous incubation on days 0, 30, 90, 160. Acidimicrobiaceae bacterium A6, which belongs to the Actinobacteria phylum, was the dominant species in the incubation experiments after 180 days of incubation (14.8% in terms of cell numbers) and increased in the membrane reactor after 150 days of operation (40.2% in terms of cell numbers).

Growth on solid media: Inorganic $NH_4^+$-Ferric iron solid media was prepared with liquid media and 0.8% agar, 0.2 mL 3.37g $L^{-1}$ ferrihydrite was spread on the surface.

Figure 20:
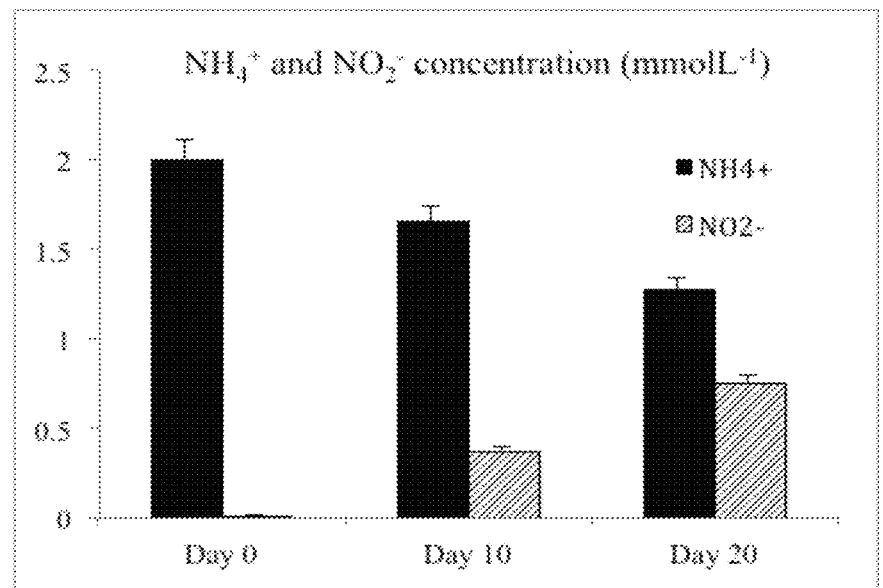
FIG. 20 illustrates anaerobic oxidation of ammonium by the A6 isolate. Filled bars are for results with $NH_4^+$ and stripped bars are results with $NO_2^-$.

On the solid medium, colonies with black spot (accumulation of ferrous iron) were collected and transferred to inorganic $NH_4^+$-Ferric iron liquid media. FIG. 20 illustrates anaerobic oxidation of ammonium by the A6 isolate. Referring to FIG. 20, bacterial cells were incubated for 20 days on the inorganic, $NH_4^+$-ferric iron media, pH 4.5. The A6 concentration was $10^5$ copies per mL. 0.738 mM of $NH_4^+$ was oxidized and 0.710 mM of $NO_2^-$ was produced. Still referring to FIG. 20, the Feammox activity of the bacterial cells was verified by the $NH_4^+$ oxidation and iron reduction rates. A strain of Actinobacteria was isolated and identified as Feammox bacteria, and named Feammox Acidimicrobiaceae bacterium A6. Referring to FIGS, 19C-19D, microscopic examination showed that cells were rod-shaped, 1.5-3 mm long by 0.5 mm wide, gram-positive.

Growth on liquid media: In ferric iron-containing liquid media, cultures of A6 became increasingly turbid and black-colored (due to the accumulation of ferrous iron) during incubation. Microscopic examination showed that endospores were produced. The pH optimum for growth of isolate A6 was 4.5, and its temperature optimum was 25° C. Under optimum conditions of pH and temperature, culture doubling times of isolate A6 were 10.2 days.

Anaerobic Oxidation of Ammonium—Ammonium Oxidation Rates

The A6 isolate was incubated for 20 days on the inorganic, $NH_4^+$-Ferric iron media, at a pH 4.5. The A6 bacterial concentration was $10^5$ copies per mL. FIG. 20 illustrates concentrations of $NH_4^+$ and $NO_2^-$ during anaerobic oxidation of ammonium. After incubation, 0.738 mM of $NH_4^+$ was oxidized and 0.710 mM of $NO_2^-$ was produced.

Figure 21:
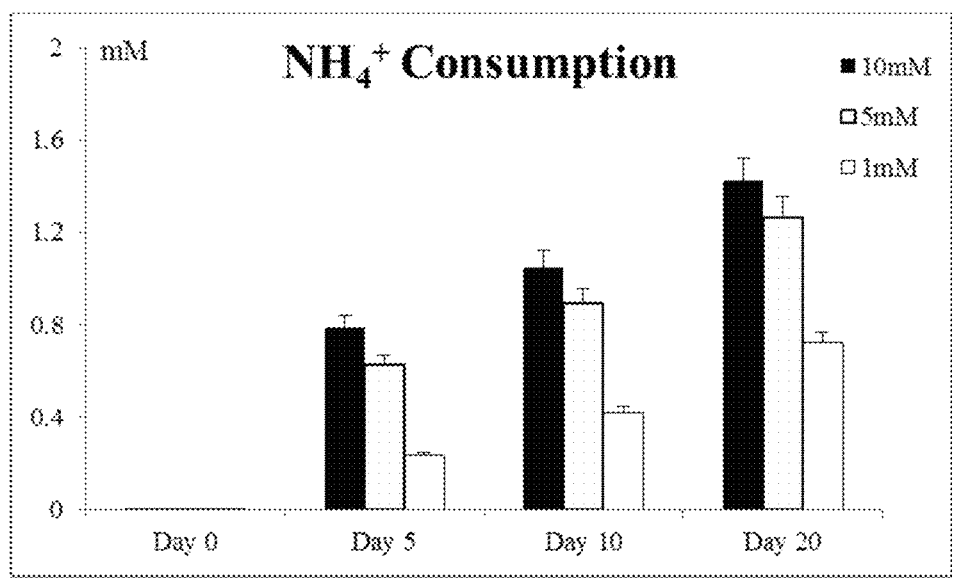
FIG. 21 illustrates an effect of $NH_4^+$ concentration on its consumption by A6. 10 mM $NH_4^+$ results are reported in the left filled bar of each of days 0, 5, 10 and 20 panels. 5 mM $NH_4^+$ are reported in the middle dotted bar of each of days 0, 5, 10 and 20 panels. 1 mM $NH_4^+$ is reported in the right open bar of each of days 0, 5, 10 and 20 panels.

Effect of $NH_4^+$ concentration on Feammox. FIG. 21 illustrates an effect of $NH_4^+$ concentration on its consumption by A6. Referring to this figure, the isolate A6 was incubated for 20 days in the inorganic $NH_4^+$-Ferric iron media, pH4.5. A6 included $10^5$ copies per mL. 10 mM ferrihydrite and three different amounts (10 mM, 5 mM, 1 mM) of $NH_4^+$ were added initially. Higher $NH_4^+$ consumption rates by Feammox were found for higher $NH_4^+$ concentration incubation.

$^{15}N$ isotope incubation $^{15}NH_4Cl$ was added with a final concentration of 0.5 mmol $L^{-1}$ and 0.133 mmol $L^{-1}$ of $^{15}NO_2^-$ was detected after 7 days incubation, while no $^{15}NO_3^-$ was produced. The data was summarized in Table 4.

TABLE 4

Summary of $^{15}N$ isotope incubation

|  | $^{14}N$ | $^{15}N$ |
|---|---|---|
| D1-$NH_4^+$ | 0.892 | 0.108 |
| D1-$NO_2^-$ | 0.995 | 0.005 |
| D1-$NO_3^-$ | 0.995 | 0.005 |
| D7-$NH_4^+$ | 0.847 | 0.153 |
| D7-$NO_2^-$ | 0.757 | 0.243 |
| D7-$NO_3^-$ | 0.992 | 0.008 |

|  | D1 | D7 |
|---|---|---|
| 15N-NH4+ | 0.5192 | 0.3862 |
| 15N-NO2− | 0.0001 | 0.1330 |
| 15N-NO3− | 0.0001 | 0.0001 |

The data confirmed that $NO_2^-$ is the main product of $NH_4^+$ oxidation in Feammox reaction.

Figure 22:
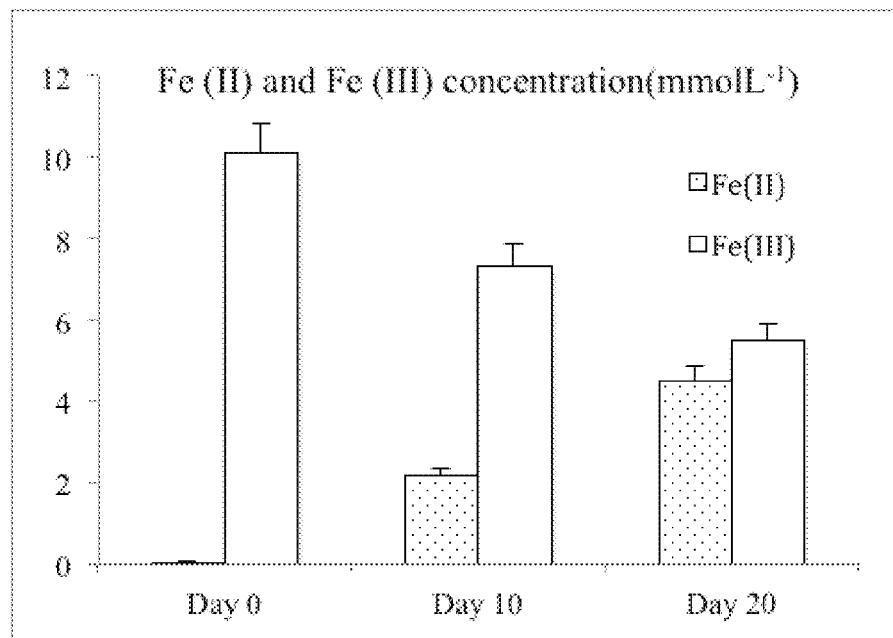
FIG. 22 illustrates iron reduction rates. Fe (II) results are reported in the left bar of each of the day 0, 10, and 20 panels. Fe(III) results are reported in the right bar of each of the days 0, 10, and 20 panels.

Reduction of ferric iron reduction rates: FIG. 22 illustrates iron reduction rates. The A6 cells were incubated for 20 days on the inorganic, $NH_4^+$-ferric iron medium, pH 4.5. The A6 concentration was $10^5$ copies per mL. After incubation, 4.330 mM of $NH_4^+$ was oxidized, and 4.317 mM of Fe(II) was produced.

Figure 23:
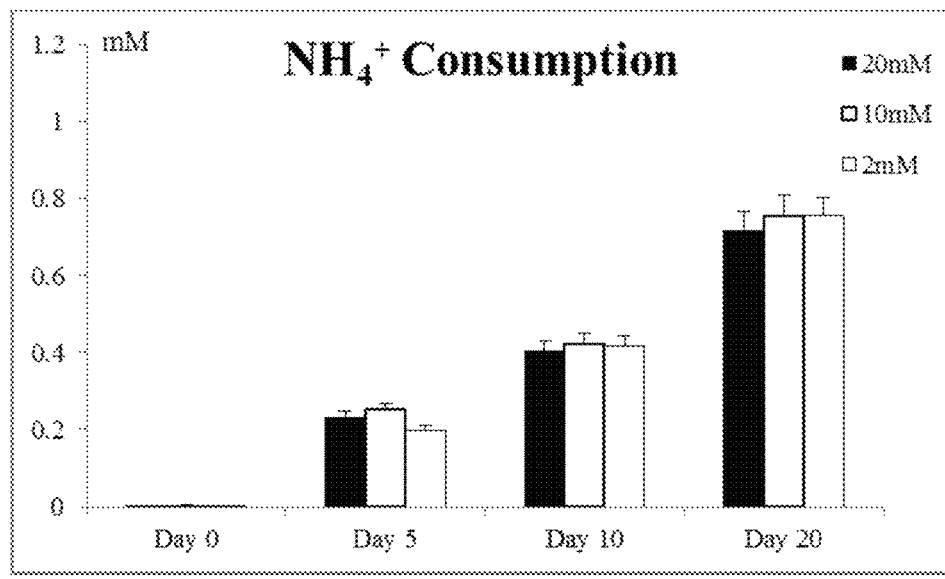
FIG. 23 illustrates an effect of iron concentration on Feammox. 20 mM $NH_4^+$ results are reported in the left filled bar of each of days 0, 5, 10 and 20 panels. 10 mM $NH_4^+$ results are reported in the middle dotted bar of each of days 0, 5, 10 and 20 panels. 2 mM $NH_4^+$ results are reported in the right open bar of each of days 0, 5, 10 and 20 panels.

Effect of iron concentration on Feammox: FIG. 23 illustrates an effect of iron concentration on Feammox. Referring to FIG. 23, the isolate A6 was incubated for 20 days in the inorganic $NH_4^+$-Ferric iron media, at pH4.5. A6 included $10^5$ copies per mL. 2 mM $NH_4^+$ and three different amounts (20 mM, 10 mM, 2 mM) of ferrihydrite were added initially. No significant different of $NH_4^+$ consumption by Feammox with different ferrihydrite amended during incubation was found. As long as there was sufficient iron included in the media, no effect of iron concentration on Feammox was observed.

Figure 25A:
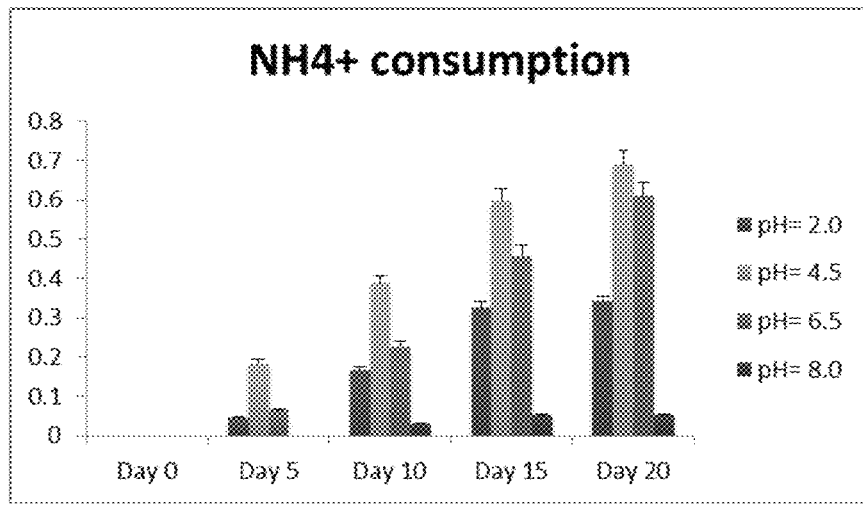
FIGS. 25A-25B illustrate determination of the effect of pH on $NH_4^+$ consumption (FIG. 25A) and bacterial growth (FIG. 25B). pH=2 results are reported in the far left bar of each of days 0, 5, 10, 15 and 20 panels. pH=4.5 results are reported in the left middle bar of each of days 0, 5, 10, 15 and 20 panels. pH=6.5 results are reported in the right middle bar of each of days 0, 5, 10, 15 and 20 panels. pH=8 results are reported in the far right bar of each of days 0, 5, 10, 15 and 20 panels.
Figure 25B:
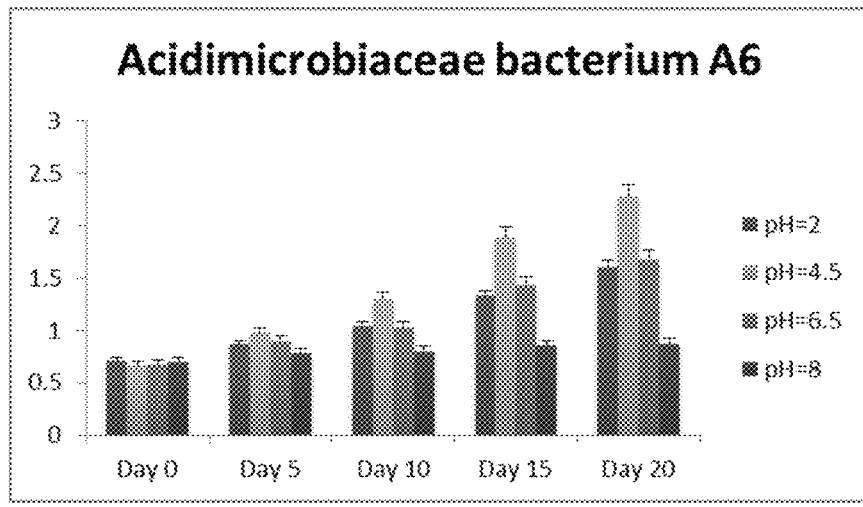

Determination of pH and temperature optima: Isolate A6 incubation for 20 Days under different pH gradient in inorganic, $NH_4^+$-Ferric iron media. A6 is 105 copies per mL. pH adjust to 2, 4.5, 6.5, 8.0 by HCl and NaOH. FIGS. 25A-25B illustrate determination of the effect of pH on $NH_4^+$ consumption (FIG. 25A) and bacterial growth (FIG. 25B). pH=2 results are reported in the far left bar of each of days 0, 5, 10, 15 and 20 panels. pH=4.5 results are reported in the left middle bar of each of days 0, 5, 10, 15 and 20 panels. pH=6.5 results are reported in the right middle bar of each of days 0, 5, 10, 15 and 20 panels. pH=8 results are reported in the far right bar of each of days 0, 5, 10, 15 and 20 panels. The pH optimum for growth of A6 was 4.5, but reasonable activity was detected from pH 2 to 7.

Figure 24:
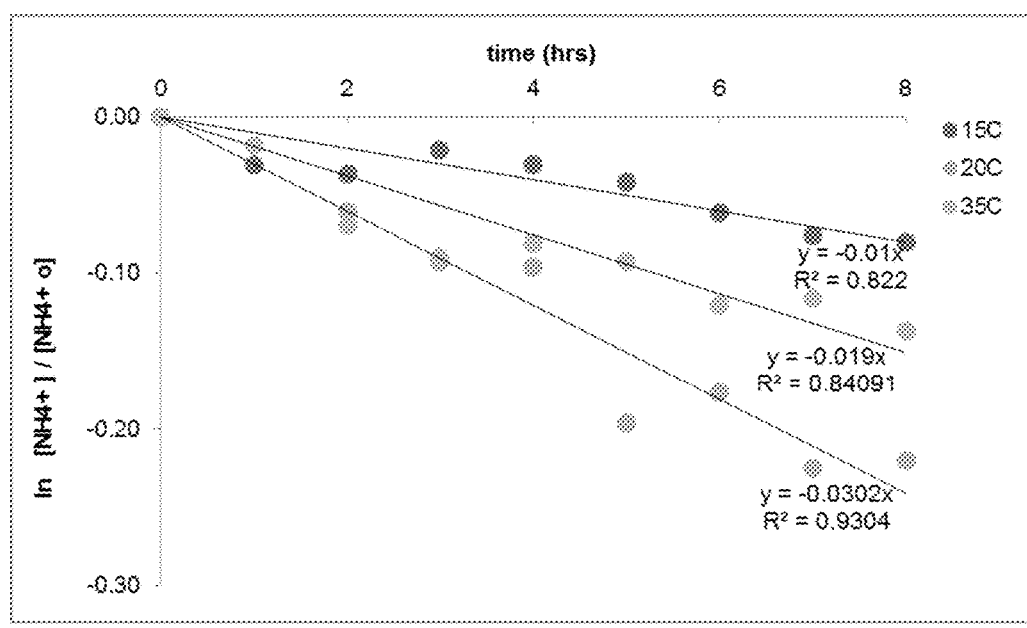
FIG. 24 illustrates the relative ammonium removal rate constants (k) by Acidimicrobiaceae-bacteria A6 at 15° C. (top line), 20° C. (middle line) and 35° C. (lower line).

Temperature gradient: FIG. 24 illustrates the relative ammonium removal rate constants (k) by Acidimicrobiaceae-bacteria A6 at 15° C., 20° C. and 35° C. Referring to this figure, the highest rate was measured at 20° C., k=0.03 $hr^{-1}$, followed by 35° C., k=0.019 $hr^{-1}$, and 15° C., k=0.01 $hr^{-1}$.

Utilization of organic substrates: Growth yields of isolate A6 have no growth difference in media containing glycerol, citric acid and glutamic acid with in control cultures $NaHCO_3$ added. The data shows that A6 is an autotroph utilizing inorganic carbon but the presence of different organic carbons does not affect its growth.

It was observed that culturing of the isolate A6 in yeast extract media required one or more additional growth factors.

Heavy metal tolerance: This gram-positive isolate was able to grow in media containing elevated concentrations of the heavy metals tested. The A6 isolate was tested for the ability to grow in the media supplemented with 100 μM-100 mM of copper, 10 -200 mM of zinc, 20 -100 μM of uranium, 10-200 mM of ferric iron or 10 -200 mM of ferrous iron. It was observed that the isolate A6 grew in 260 mM on ferric iron. However, addition of ferrous iron did not inhibit the bacterial growth. Growth also occurred in the presence of 100 mM, but not 200 mM, copper. It was also observed that 50 mM zinc inhibited growth. The A6 bacteria was growing in the presence of the tested concentrations of uranium but it was found that uranium was toxic to the bacterial cells at 200 μM.

Autotrophic growth and CO2 fixation-assimilation of $CO_2$ in cultures of isolate A6:A6 was able to grow in organic carbon-free liquid media. A $^{13}C$ labeled $CO_2$ amendment was conducted with a Thermo MAT 253™ stable isotope ratio mass spectrometer, and the $^{13}C$ in cells of A6 increased from 1.80% to 10.3% after 14 days incubation.

TABLE 5

Summary of assimilation of $CO_2$

| | Cell (with methanol wash) | | DNA | |
|---|---|---|---|---|
| | $^{12}C$ | $^{13}C$ | $^{12}C$ | $^{13}C$ |
| Day 0 | 98.2% | 1.80% | 98.9% | 1.10% |
| Day 14 | 89.7% | 10.3% | 82.0% | 18.0% |

Screening of RuBisCo (ribulose-1,5-bisphosphate carboxylase/oxygenase) genes: RuBisCO genes were amplified from cell lysates of A6. Both cbbL and cbbM genes were successfully amplified.

Figure 26:
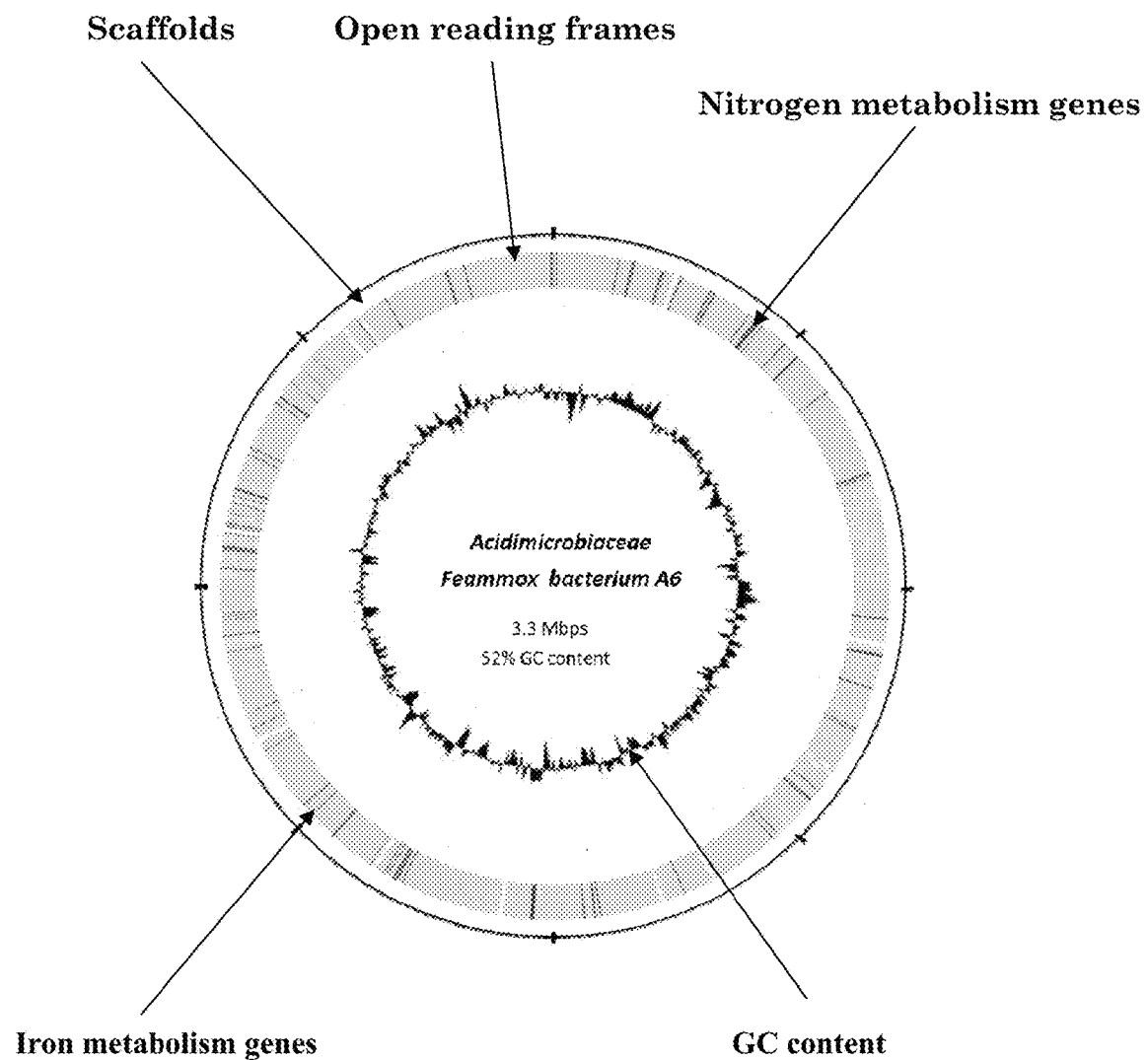
FIG. 26 illustrates a schematic representation of the genome of the Acidimicrobiaceae Feammox bacterium A6.

Full sequencing and functional gene-single-copy gene analysis: FIG. 26 illustrates a schematic representation of the genome of the Acidimicrobiaceae Feammox bacterium A6. The genome size and guanine-cytosine content of A6 are 3.3 mega base pairs (Mb) and 52%. Genotypic traits are summarized in Table 6.

TABLE 6

Genotypic traits

| Attribute | Value |
|---|---|
| Genome size (bp) | 3,106,468 |
| Plasmid size(bp) | 106,011 |
| DNA Coding region (bp) | 2,991,461 |

TABLE 6-continued

Genotypic traits

| Attribute | Value |
|---|---|
| DNA G + C content (bp) | 1,709,039 |
| RNA genes | 42 |
| rRNA operons | 2 |
| Protein-coding genes | 2032 |
| Pseudo genes | 58 |
| Genes with function prediction | 1579 |
| Genes assigned to COGs | 1392 |
| Genes assigned Pfam domains | 1497 |
| Genes with transmembrane helices | 538 |

Functional gene: The gene encoding Feammox ammonium Monooxygenase (FMO) having a sequence of SEQ ID NO: 8 was identified. The gene was located in the bacterial plasmid. The FMO is considered to be the functional gene coding ammonium oxidation coupling to ferric iron reduction in A6.

Figure 27:
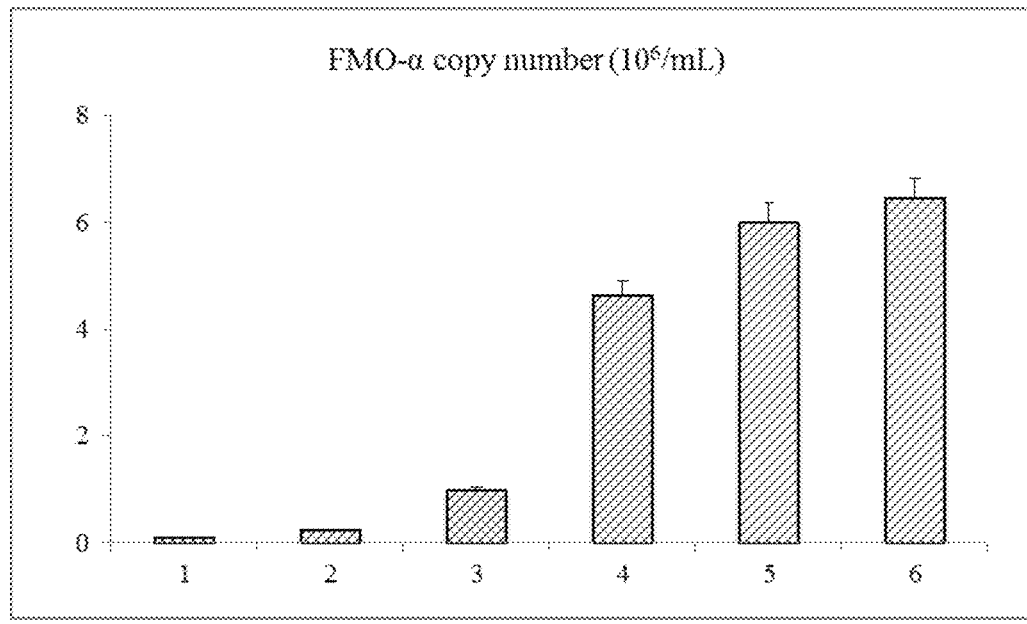
FIG. 27 illustrates the FMO activity.

FMO activity. FIG. 27 illustrates the FMO activity. Referring to FIG. 27, isolate A6 was incubated for 20 days under pH 4.5, in inorganic $NH_4^+$-Ferric iron media. Copy number of Feammox gene, FMO-a, was analyzed during the incubation which showed active Feammox reaction. It was observed that that FMO activity increased as total microbial as well as Acidimicrobiaceae Feammox bacterium A6 activity increased.

Figure 28:
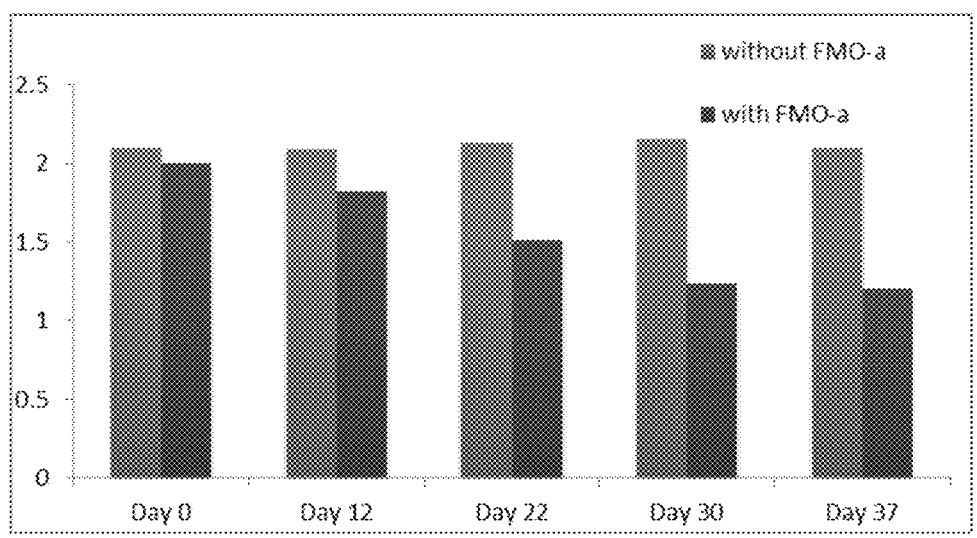
FIG. 28 illustrates oxidation of $NH_4^+$ by Acidimicrobiaceae bacterium A6 when the FMO activity in the presence (left bars for each of 0, 12, 22, 30 and 37 day panels) and absence (right bars for each of 0, 12, 22, 30 and 37 day panels) of a broad enzyme inhibitor (NaS).

FIG. 28 illustrates oxidation of $NH_4^+$ by Acidimicrobiaceae bacterium A6 and the FMO activity in the presence (without FMO-a) and absence (with FMO-a) of a broad enzyme inhibitor (NaS). Referring to FIG. 28, it was observed that the $NH_4^+$ oxidation rate decreased in the samples without FMO-a.

Phylogenetic analysis: According to the phylogenetic analysis, Acidimicrobiaceae bacterium A6), belonging to the Acidimicrobiaceae family, whose closest cultivated relative is Ferrimicrobium acidiphilum (with 92% identity) and Acidimicrobium ferrooxidans (with 90% identity).

EXAMPLE 24

Feammox Applications

Feammox process could be applied for waste water treatment for ammonium removal without the need to supply oxygen. Oxygen supply is the highest energy cost in waste treatment plants. The process may also be used in the design of engineered wetlands for nitrogen removal. That would be important in the agricultural and livestock industry. There might be many other applications.

Ammonium oxidation requires oxygen. Anammox process works with nitrite, but it requires high temperatures (around 82° F.). Since the bacterium was isolated at a New Jersey wetland, it is reasonable that it will function at lower temperatures. This is important for waste treatment, since in the winter waste water temperatures are around 40° F. Feammox may be applied for developing more temperature robust treatment processes that do not need aeration. Means to recycle iron and/or use scrap grounded up iron may be developed to be supplied for Feammox. The process similar to the one tested in incubation experiments will be utilized in a simple prototype reactor. Table 6 describes $NH_4^+$ removal using the reactor illustrated in FIG. 11 contrast Anammox and Feammox.

TABLE 7

Comparison of Feammmox and Anammox reactors

|  | Feammox reactor | Anammox reactor | Conditions |
|---|---|---|---|
| Temperature | 20-25° C. | 28-35° C. | Feammox con work if T ~15° C. |
| pH | 4.5-6 | cirumneutral | Feammox can work if pH ~2 |
| Aeration time | 0 h/day | Non or 1.5 h/day | Feammox require Fe(III) |
| Doubling time | 8-12 days | 10-12 days | Both are slow growing bacteria |
| $NH_4^+$ removal | 85% | 41% (no aeration) 72% (with aeration) | $NH_4^+$ inflow concentration 5 mM; Retention Time 48 h |

It was shown that the Feammox reactor is as efficient if not more than the anammox reactor. Finally, sludge was mixed from the Feammox and Anammox reactors, showing that a combined Feammox/Anammox mode is feasible and does not require partial aeration, which is required by Anammox to convert some $NH_4^+$ to NO2-, which in the combined process is done by Feammox. Operating conditions were different for the Feammox/Anammox reactor.

A combined Feammox/Anammox process results in less iron demand than a pure Feammox process. Anammox with 20% Feammox sludge may result in 70% NH4+ removal without aeration.

EXAMPLE 25

Feammox in Electrogenic Microbial Reactors

Electrogenic microbial reactors such as Microbial Fuel Cells (MFCs) and Microbial Electrolysis cells (MECs) are bioelectrochemical systems that extract energy from a substrate (Call and Logan 2011 *Biosen. Bioelectron.* 26(11): 4526-4531, which is incorporated herein by reference as if fully set forth). This process harvests electrons biologically, which are then transferred to the anode that functions as the terminal electron acceptor for the microorganisms in the system, and 112 is produced at the anode. FIG. 29 illustrates a scheme of the electrogenic microbial reactor. Referring to FIG. 29, the reactor includes a vial, a graphite anode connected via titanium wire to the positive terminal of the power supply, a stainless steel catod.e connected via stainless steel wire to the negative terminal of the power supply. MECs require a small potential applied from an external power source ($E_{AP}$>0.25 V), resulting in $H_2$ production at the anode (Logan, Hamelers et al. 2006 *Environ. Sci. Technol.* 40(17):5181-5192; Call and Logan 2008 *Environ. Sci. Technol.* 42(9):3401-3406; Call and Logan 2011, all of which e incorporated by reference as if fully set forth). When the anode in a MFC or MEC works in place of a finite electron acceptor (i.e., Fe(III)), the bacterial growth is no longer limited by the consumption of that electron acceptor.

Some electrogenic iron reducing microorganisms; e.g., Geobacter sp., are capable of transferring the electrons to an anode instead of Fe(III) and grow in MECs (Logan 2009, which is incorporated herein by reference as if ully set forth). Thus, we have tested A6's ability to grow in small MECs has ben tested. It was found that under constant mixing, and with a voltage input of 0.7V, MECs seeded with a pure culture of A6 to which 5 mM ammonium was added produced a current density (I) that increased from 0.02 $A/m^3$ to up to ~36 $A/m^3$, while the autoclaved control increased to only 1.3 $A/m^3$ (Call and Logan 2011, which is incorporated herein by reference as if ully set forth). The A6 biomass increased from $10^4$ copies of DNA/ml to $9\times10^5$ over 14 days of operation. An electron shuttling compound, AQDS (Anthraquinone-2,6-disulfonate) had to be added to the solution, since unlike Geobacter, A6 does not seem to colonize the anode. When an electron shuttling compound like AQDS is added, the electron will be transferred from $NH_4^+$ to AQDS in solution and then to the anode. Hence, MECs and MFCs may be the ideal Feammox reactor configuration for $NH_4^+$ removal from wastewater via Feammox that solves the Fe(III) supply problem. Other configurations and materials can also be used to construct MECs as well as MFCs.

Although the equation in FIG. 29 shows that the solution pH should decrease while $NH_4^+$ is being oxidized, it was observed that pH increases. Our hypothesis is that this is due to the $CO_2$ consumption by A6, which is an autotroph. Hence, $CO_2$ control may be for the growth of a pure A6 culture. $CO_2$ addition should not be needed when organics are degraded simultaneously since $CO_2$ is produced during the biodegradation of organics.

The references cited throughout this application are incorporated for all purposes apparent herein and in the references themselves as if each reference was fully set forth. For the sake of presentation, specific ones of these references are cited at particular locations herein. A citation of a reference at a particular location indicates a manner(s) in which the teachings of the reference are incorporated. However, a citation of a reference at a particular location does not limit the manner in which all of the teachings of the cited reference are incorporated for all purposes.

Any single embodiment herein may be supplemented with one or more element from any one or more other embodiment herein.

It is understood, therefore, that this invention is not limited to the particular embodiments disclosed, but is intended to cover all modifications which are within the spirit and scope of the invention as defined by the appended claims; the above description; and/or shown in the attached drawings.

SEQUENCE LISTING (8 sequences)

SEQ ID NO: 1 - DNA, 2165577 bp, Antimicrobiaceae bacterium A6
  misc_feature (216)..(577): Antimicrobiaceae bacterium genome sequence
gactcgtcgcgtcgacccggagacgttgtccacaggacagtgtccacagctgtggagcatcttgtggataggaggaggttagaggagtgagcgcacccgaggcatcgtgggaggcgatcgcccaggcgttccgaacggcgtcctgaccacaccgtcaccgctcgccaaggaacgtctcgagaccaagtaccgcgacgtgctcgaggacgtgtcggggaagccacgtggctgacgtggttccgaaccactaatctttgaccctgcgacttgccccagccccctggcgccccaggagctctccgaccagcagatcgattcccgttacccagggtcggagggcttcccatcgatcctgaccacaccgtcaccgctcgccaaggaacgtctcgagaccaagtaccgcgacgtgctcgaggacgtgctgacgcccatcatgggagcgcgagtgcctgtcgcggtacgggtccgcgccgatgtccccgacgagacaccgaccacggcgcattcgctgttcgactcctcacccacatcctcgcccacaccgtcgcggcgtaacggtcgcgggtcctcttcgaccttcgatccccgctataccttcgaagcgttcgtcatcgggtcctccaatcgcttcgcccacgccgcggccctgtccgtggccgagacgccggctcgctcctacaaccccctcttcatccacggcgacgctggtcttggcaagacccatctcctccacgcgatcggcaactacgcccgtgagaactatccgaacctgctgacgacctacgtttcgaccgagaccttcctgcctagccctccgagccctcgtcgggacttttcacccaacgagttcgtcgacgccatcaagcgaaaccagacgcccgccctcgaccgcggtaaagtcgattcgtgagagtgagttcaaggcccgctaccgtgcgtgcgacatcctcctcgtcgacgacatccagttcctcgagggcaaagaagcgatccaagaagagttcttccacacgttcaacacgctctacggggcacagaagcagatcgtgctcacctccgaccgtcccccacgtgcgctggcgacactcgaggatcggctccgaagccggttcgccatgggcttgatcaccgacgtgcaaccgcccgatctcgagacgcgagctgcgatcctccggcgaaaagccgaggatgcgggcgtcaccgtacccgcaacggtcatcgagttcatcgccgcctccatcaccgacaacatccgagagctggagggagcactcactcggctcgccgcattctccacgctcagccagaccggcatcacgctgacgatggccgaacaggtgttatcggatctcatctcgcagcacgccacccaacgtcaacgcacgcctgccgaggtcatcgctgcgacggcggccttgttcaacctcacccctgaagacatcaccggcgcatcgcgcaagcggccggtcgcggtagctcgccagatcgcgatgtacgtcgttcgcgaactcaccgaactcagctacccggagatcggccgcgccttcggcggcaaggaccacacgacggtcatgcacgccgtcagccgggtacaagagctgatgcaagagtctgtggagatctacgaacaggtcgatcagctcttcaagagtcttcgaggtccgcggccgtgagcctgtggatgtccctgaggacggacggtggacgaccgcccgctcatccacaggctcgaggagcccgacgagtccttcgaacgacgacggcctcgcggctccacagcactgtgcatgtcctggggacgagttcatggccgctgcgctgggaaaacgggtgtcgtccacagttcacaggccttactaccagtgctaccgtacacatagataggggaggacatcggtgaagtttctctgtgaacgcgacgaactcgcatcggcgctccaggcggcgtcacgagcgctctcgtcacgctcctcgctcgcgggtgtgcgctggacgcttcgaggcggcgaactcgaggtcgagggacgagagagcgacctcgcgattcgcagtgtgctgggtgcgatgggaaccgagggttcgttccagacgccggcgtcgctcgccgtcgatctcgttcgtaccatgccgagcgaccaagtcgaggtggtggtcgaggacgcatcggtcgtgctccgatcgggtcgggccgaagtgtcgctgcagctgctcccgacgctcgaactccccggaatcggagagggcacgacgccgagtgcgacggtgccggctgccgcgctggcccaggggattcgtcaggtggccgtcgcggcggctcgcgacgacggtcgcgacctcatctattccagcatgctcttctcctcgaccaatgacggcttgcggctggtcgcgacggacgggacgaggcttgcgcttcgtgacatcgcgaatctctctgtcgcgggttcggaagctcgcgacgtcgtgatcccgaccagggccgttcgcgagctcgagaggctcgtcaccggtgcgggtgtcgacgagatccacgtcggtatcggcgagcgcgatgccgtgttcgtggtcggcacgaccacgttggccacccggctcgtcgacgagccctttcgcgactatcggcggctcgtggaggccacctatccgaagaagctcctcctggatcgattgtcgctggtcgatgccatgcggcggcttcgccgtatggccaaggaggcgcggaacagttcgtcgatccagatgaacatgacgccgacggcctgcgagctcagcgtgcgcatcccgtccgtcggccaggtgcacgaggtcctcgacgcgaacttcaacgatgccgagttcaccatcaacttcgacccggacatgctcgccgatggcgtcgacggtgtcgagggcgacgtcatccggctcgagttcatcgaggccaaccgtgcggcgtgcgtgagttcggcggacacccgcgagtacctgtacatcttgatgccgatcgtggcccgctgagtatgtgggtgcgcagtctgcgcatcactggcctgcgcaatctcgacctcaccatcgatcacgtccccgacgacatcatcgcggtggtcgggagcaacggacacggcaagacgagtctgctcgagtcggtcagcgtggtcctggcagggcgatcgttccggacccatgatcggtcggcgctggtcagggtgggccatgacgaagcggtcgtcgtcgcggacgtggagcgcgagctcgctccgccggtgcgagtcggccgtcgggtcgatcgggagggacgactcgagacccgtgtcgacggacagcgggagcaacggggcccgtcgttgccggtggtgagctttcatccagacgacgtccagatcgcgagcggcggcccggagcagcgccgtcggtttctcgacgagtgcgtcgtcggactcgatcgaggggcagcgatccggctgcgtcaggcggagcgtgtcctgcggcagcggaccgaggctctgcgggcgccggtcttggacgaggtgacgctcagcatcctcgaagagcggctcgcgcgcgcgtcggtggaggtagccgagctccgggcccgtgctgccgaggtgatcgctccgcacgctcgggcggtgatcgacgagatgctgatgtcggcgggtcgcgtggtggtgacctatcgaggcgctggcgacgaggcgacgctcctcgaacaactgcgtgcgcgtcgcggagacgatcgacgtcgtggcgtcacgagcgtcgggttccaccgcgacgacgtcgagatcctcctcgacggcgagccgatccgtcgcatgggatcgcaggggcaggtgcgtaccgtggtcgtcgccctcaaggtggcgctggcacgcgcgatggaggcggtgacgaaggagccgccggtgctggtgctcgacgatctgctcgccgagcttgatgccgagcgggcgcggcgagcggtcgcgatgatggaggggatgcaggcgttcatcagtcacaccgcaccggtggaggggtcgggcttcgagcttcggatcagccatggagccctcgtcgacgcgtgatcgaggacgagtgccggggcccgtgcccatcgctgaggtgctcgcgaagctcgataccgctcagcgggccggcgtggacgtcgtgcgtcgtggcgaactcaagaccgtcgtgcgcgaggcgctgggaccagccctcgtacgtcgatgctcgttggtcaggctcgccgaggacgagatcgtcctcggcgccggtggtgccggtctcgtcgccctacgtggtgcggcagcacggctccgcgtggcgcttgcggaggcgggttaccagggtgagctgcgtctcgttgcgatcccgggagagccgcgaccctggtcgcagctaggctgaggtgggctcgagcgcccgtgggtgtgagtctgctcgcagtgtgtctgcatcgccacgagcgtggatgacgcatcgagcagcgtaggtggtcgatcgaggaaggatcaagagcttggagcccgaggcaagctacaccgcagccgacatcgtggtcctcgagggcttggagcacgtccggctgcgcccgggcatgtacatcggctccactggtccgagcggactgcaccacttggtgtgggaagtcgtcgacaacgcagtcgacgaggtcatggccggcgcctgcaccgagatcgacgtcaccatcctcgccgacggcggctgtcgggtcgaagacaatggtcgcggtattcccgtcgacccacatccatcagacccgtcgaagtcggcagccgaggtggtgctgacgcagctcaacgctggcggcaagttcggcacgggtggttataaggtttctggcggtctccatggcgttggcgtgtcggtcgtgaacgcgctgtcggcacgcctcgtcctcgaggttcaccgcgacggtagcacctatcgcatggagttcgtcaagggtgggacgccgacggggccgctcgagcggatcggctcctctggaggccggcgaggcacggtggtgaccttctggccggatccgacgatcttcgaggacactgagttctctgcccagaggatcctggagcgcctccaggtcatcgccttcctcaacaagggcgtggtcgtgcgcttccgcgacgagcgtcctggtcgagaacatgaacagacgttctcctacgcaggtggcatcgtggacttcgttcgccacctgaacgagcccaagggacccctctttgcgaaggtgggctactacgccgcgagcgaggaggacatggaggtcgaggtggcgttctcgtggaacaccaccttctacgagacgctgttcaccttcgcgaacggcatctccaccgaagaaggcggcatgcacgccgagggcttccgcaaggcgctcacgcaggtgatcaatcgctacgcgagggcacggaacctgctcaaggagcgcgatgagaatctcgaggggaacgacatccgcgaggggatgaccaccatcgtgtcggtccgtctcgtcaacccgcagttcgagggccagaccaagacgaagctcggcaacgtgtcggtgcgatcgttcgtcgagcgtgtgaccaacgagcacctggcgacctggctggaggagaaccctcgcgaagcgcaggcgatcgttcagaaggccatcgtggcacagcgtgctcgcttggccgcgagacaggctcgcgagctcacgaggcgtaagtcggggctcgagagcgcgggtctgcccggcaagctcacggactgcacctcgcgcgatccctccgagtcggagctgttcatcgtggaggggaactccgctggtggcacgaccatcaagggacgtgatccgaagacccaggcagtgcttcccatccgtggcaagatcctcaacgtcgaacgtgctcgactcgacaagatgctctcgaaccaggagatccagtcgttgattgcggccatcggcgctggagttggtgacgagttcgacatcaagaaggcccgctaccacaaggtgatcatcttggccgacgccgatcctgacggatcgcacatccgcacgctgctgctgacgttcttcttccgtcagatgcggccgctcgtcgaggcggggatggtctacgccgcacagccgccgctgtactccacgttgctcggcacggagaaggtctacatcaagaacgaagccgagcgcctgcgctttctcgaagcccaccccaaccacaagaagccattcctgcggttgaagggtcttggcgagatggacttcgacgagctgcgcgacaccacactccatcaggatcggcgaaccttgctgaaggtcaccatcgagcaggcggcgatcgccgacgaggtgtgcagtgtcttgatgggcgacgacgtcgagcagcgccgtcgtttcatccaggagaacgcgggcgacgcgcgtttcatcgacttctaggtaagcgacatcggcccacgaggagatctgcgtgcctgacgaacccacccccgacgcttcgaacgtcgagctcatcgagttgcaggaggagatggagcgctcctttctggagtactccctctcggtgatcattgcgcgagcgctccctgacgcgcgcgatggtctcaagccggtgcatcgtcgcatcctctactcgatgtacgacgctggctatcggcccgatcggccccacgtgaagtgcgcgaaggtcgtcggggacgtcatgagtcgcttccacccacacggcgacgctgcgatctacgacgcgctcgtgcgcatggcgcaggacttctcgctgctccatcccttgatcgatgggcacggcaacttcggttcgcccgatccgtcgacgggtcccgcggcgtctcgctataccgagtgccgcctcgccccgatcgcccttgagctgctcgcgggtatcgacgaagacacggtcgacttcgtcccgaactacgactcacagaccgtcgagccgtccgtactgccggcgcggttcccgaatctgctcgtcaatggatcacaaggcatcgccgtcggtatggcgacccagatcccatcgcacaacctcggtgaagtggtcgacgcgattgcgtacctcatcgaccaccccgaggccaccgtcgacgagctcatgcgcttcgttccgggccccgattttcccacgggtggcatcattctcgggcgagatggcatccgcgacgcctaccgaaccggccgggggagcgtcaagcttcgcgccgtggccacgatcgaggaggctcgatcgggctaccagatcgtcgtcaccgagattcccttccagacctcggtcgaggtgatcgccgacaagattcgccacctcgtcgaggagaagctgctcgaagggatccgggacatgaagaacttctcggcagggtccgagacgcgcttcgtgatcgagctcaagcgtgacgcgaatccgaacgtcgtgctcaacaacttgtatcgactgacgccgctccagacgagcttcccgatccagatgctggcgctggtcgatggcgcgccgcgcaccttgaacctgcttggcttgtgccagatctacgtcgatcaccaacgcgaggtcattcggcgtcgctccgagttccgtctcggcaaggctcgagagcgactccacatcgtcgagggtctcctctcgtgcatcgaccaactcgacgccgtgatcgcgaccatccgagcctctgaggatcgtgcggctgcccgtgccgcactcatggccgagccgttcgggttctctgagctccaggcgaaccacatcttggacatgacgctcgggcgcctgacccgtctcggacgtgaggagctcgaggaggaggcggcgacgctccgagcaaccatcgctgaactcgaagcgatccttgccgacgcccaacgactgtccgcggttgtcaaggacgagatgctcgcggcgactgccgagtaccgccaggcgcggcggacccgcttcgaggtggacccgggcgacttcgccgcggaggacctcatcgaggacgagcccatcgtggtgctcatcagccgttccggctacatcaaggccgtgcccgagtcctcgttcaaggcgcagggccgaggcggccgaggcgtggtgggggcgcgagtcaaggacgaagacgagatcgcccacgtcatctcgtcgtcgatgctctcgaggctgctggtcttctcgtcgcgtgggcgggtctaccaactccggggttacgagctgcccaagctcgagcgatcggcgcgggggacggcgctcgtcaatctcgtcccgttggccgacgacgagcgcatcacctccgtcatgggcacgaaggacttccccgaggacgctgacctcgtgttcttcacgcgcaacgggatggtcaagcgaaccgccatggccgagtacgcgcgctcgcgtcgtgatgggatcatcgctatcgacgtgcgaggcgacgacgagctcgtgagcgtcgtcgtcgcgaccgaagagcacgatggcgtcgtgttcaccaagcgcggccaggtcctgcgcttcccactcgctgaggtgcgtcgtaccgggcgcgcgacggcgggcgttcgctccattcgccgagcggacggcgactggatcgtcgcgggcgggctcatcgaagacggtgtcgaggtcctgctcgtcacgagccgcggttacggcaagcgaacccccctcgattcgttcccggtgcaccatcgaggcggcgccggtatcagaggcatcggcttgaccgagcgcaagggagagctggtcgccgcggccttcgtgaggccggaggacgaggtcctcatcgtgagctcgcagggccagatgatccgcgtgcgcatcggcgacatctccaaccagggtcgctacgcaaccggggtcaagctcatctcgctacaagccgaggagtccgtggcgtccgttggcgtcgtgccagagagcggtacggacgcataaagattcgaatcggtccgtgccgatgccatcggtgcaagggagtgcgcgatggcacggtggaccgctcggtggcttctacaagtcgcctcgactgtcgcgatggcgggcgtgctcgccgtggtgcccggtgcccgcggctcgggcacaaagaccctgaccggatcacaggtcagttggagcatcgcctgggtgccggcttcggtcccgtcggtcgcgctcccgagcgtgagcttcgccagcttcgaggaccccacgaacccgaccgagggtccccagccgacgttccctcatcccaacatcgctacccccgaaggcgccgccctgtccgtgggccaacccatcatcgtcgcgccacagacgagcgagctcgggacgaccctgtcgggatctgcgaccgtcgccggtgggatcgtcgtcaccgtcacggtgaatggggtggccgagcccccggtcaccgtgtcgaacgtggcgagctacgcgatgagctggcaggccagtgtcgaggacgtctacgtgtcggccggcacggtgccggcgtcggccccgatcctcgctggcacgaacgtgctcgcgcccaccgccaacgacgtcacgccgacaggctcgctcgcaccgggcacgtttgggtccctgtgcgacgctggcgcggtgagcgcatccagtgatctcttctcccgcctcacgccggccctcgcccagtcggcggcgggcaagctcagtccgctggtgtcgacgccgaccagcgaggatccgggcacgtgcgccatcgagttcgctgcaccgtctggactctcgggtggttctacctggaccgtaaacgctcagctcgccgcggccttcaccgcgacggcgacggcacgactccagaccgtgcatctgtccgtcgatggtgtagccgtgacaattcctggcggtacctacagcgacgtgacgctcgacgttccaccttgggtgctcggcccggcgacctccatcgacgagcaggtggccaccgtcgagtcgcttccggtgggcgctgcggtgttcggaggctagggtcgtggccaccatcgcacccggggtcggacgaaccgagagccttgcgcctcgatcgctcgccgagctgatcgagcgcggcccgttcgagcgctacctgcgcgagacgctcacctggtcgctcgtgtcacgcttcctcgtcgatgcgcagcgccacgctgacgacgagcgtcaggccgcagagttcgaccattggcacgagcgttatcgggctctcttctctcgggccgccgacgaggttctccagacggtgagccaggagatgctcgaccacctgagtgtgctcgagaagcgggcggccttcaacgccaactacgtcgccatcggcgagcgcatccggacgctgctgcaagcgcgtccggatgccgacgagatccagcggctgccgaacgtcggaccgctgctcaccatccgtctctacggggagatgttcgatctcgggatcgtgttgctgtactacttcgcgtccgaggtggagaacatccacatcgtcgacgagcgcgtcaccgtctacacgagtgatggtcgagcgtggctctcgatgatcgatgcggccgccgacgggcgcgccctcaaggaccgtggtgcgcagttcgcacagatctccgggggaggcgtacctcaacggttcgaccccgtgcaccacgccccgaacctgacgagcccctacgggatccgcatggcgctccgccagcgcaccactcgatcgggggagtttctcgctgcgttgcgcctgcaccatgcgaccaatatcaccttcgatgccctcatcgaacagggggtcctcagcgaagaagcgggcctcatgctcgcgcaggcggtacgagctgcggtgccgatcctgatcgcgggggcccctggatccgggaagaccacgctcctgcgcgcgctcacgaagttcatcccgcgcgccgaaccggtgctggtggccgagaactacgaggaactgcatctcgaggagctggtcgacgaccgcggcaggccctggttctacgtgctccacagccacgtcgagcaggaggccaacgccgagggtgcgggctcggtcacgatgaagaccatcctcgaacgcggtctccaggaggatgtccgtcggctcgtgatcggtgaggtcaccgacccggagacgatggaggtgctgttgcaggccgccaacacgggcacgagcggcgtgctggccacgatccacgccgagagcgcgctcgacacggtgaaccgcgtcttcgggctgttgctgcgcacgacccgttacacggaccgggccgctgcctatctcatcgagagcacgttgaacctggtcgtgcactgcgccttggtgcgcaacgagcagagccgtcggcgggtcgtcacggggatcgggtgggtcgttccccatccgggccaggtcggtggcatgccacggatgcagatggcgttcgtgcgcgaggggtcggctctcgtgcgtgccgtggaccatgccaacgtcgcgcaccggctggaggagctcgtcgcgcggaggcgctcgtgagcgctcaagttctgacgccgagagtgacgatgcttactacgacgggtggtcaagcatcgtccgtcgagagacggcgcgagcgaaaggagcgtcgaaatgggaaggcgcatggtacgtggcgcagcgtggtggctggcctcggtggttcggtcggtgatggcagtggtcaccggtgggcctgctgcactggtgtcgctggcgagcgacgagtccggggcggagacctcggtggcgacgatcgcctgggtcgtgctcgggctcatcgtggtggcgttcgtcgtgttcttggtgttccagttcacgggcagcgcaaccagcgcggcatccaataccaacaatcagctcagcacccttccacagggatagcgggcatgttcgctcgtcgcctgctcgtcgacgagcaggcgacgagcacggtcgtggggccggtggtcgtggtggtgtttctcatgctcatcgcgctgaccatcggcttcggcgcgttgtgggtcgggcacgtcgaggccgtgtggggtgctgaggcgatcgccgccgacctcgggatcggtggctcgcccgcccaaggtttcgccttcggggtcctgcgcgacgtgacctggtcgatccagccggtcagcgtgagtggtccggacgcgccgggagctgcgtccatggtggtcgtgcacgccgatctcggcggtctcgtgccggtgacgagccaggtcgcgctccagccgcccagccagctcggaacgggagcgtgatgcgacggctcctcaccgacgatcgagccgagagcgatgcggtggttgcactgccagcggtggcggccgtgatggtcgtgctcgcggtctcggtgggcgtcgtggtgtggtgggcggccgcgcaatcggcccaggcgatcgccaatgccgccggattcgaagccctgagtctcccggtcctcgggactccggccgccgagtcggcgctcggtgccatggtcgcggccgagaccgcagcgcgctccttcccgccgctcagctgcgccctgagtgggctcgacgtcgccgccgcccagattccagcgtcggtgaccgtcacggtgacctgttcgacgaccgttcccgtgctcgggttcgtgcacttcgagcggtcggtgacgctgggcctgaacccctcacacctcatcgccgggagtacgccgtgagggcgccgagcgagcagggagacgcgacgcccgcgctgctcgcggtcggatcgatcctgctcgtcatgggactcacggtggcggccctcgtgctcgagagcatcacgatggccgagaccatggcgcgggcggcggcgcgggcggcggcgcacgccgctgccaacgtgctctggcagacggctgggaacgcggggtcgccagggctcgtgacgatgcggaatccgtcgttctacgatcccaacctccagagcgcggcctcggcagcgctcgcgggggtcccacacggggtcggtacgagcgtcgtgtcgtgctcgggcgggctcgtccccaacggacacggcctccagcgctattacctcgacgtacgggcgacctgcaccgtggtgttcgtcccgcccatgagcgatctcatcaccgtggtggccatcagcccgatcacggtcacggcctccgcccacctcgtggggagcctcgcgtgagcgcgcgtcgtgtggccatcggtctcgctgggtcgatcgcggaggtcctcgtcctgacaccgtggtcgctcccgaatgagcgcgtcgtggcccaccccgtcgtcgtcggggccgcggcggtgtgcgccatcgctgcgcttgcgctgtggtggcggtgggtgctggggcgaggtggtggcgaccattcatcgatccccgacggagtccgcgccccggcgcgagcgtcggtcgcggtcgatctcgatctcgacgcagtcccagccatcgaggtgcccggcgtcgggatcgtcgcgatggaacgctcgacgtcgcagtgggtcctcgaggtcgccgccgagcaggagctccaccgcgtggcggagcacgcccggctgcatcggccgcgagggatggtgccgctcgcagtgccagatcgcaacccggccgccgaggacctccgcgccctcgtccgccttgaccatcgcgtccgctcctcgccagcgcacgagggctcgctcacgccgctgcgctctggcgaggtcgtagggggtcagcgccacacacacgccgacgcagggtcggcatgcattcgcgtcgtcgaccggctgggccagcttcgcgtgctcagcggactcgtcggcatcgagcccggcaccggtctcgacctcatcgtccagcatcggctcttgccgtggctggagccggttcgctgtgtcgtggtcgggatgcgacgtgaggaggtcgtggccttggcacgatcgtcggtgctggtcgtgtccgacatccggcgggcacaggcggtgctcgacgaggcagtgagtgcgacgaatggattcccggtgctggtggtcgtgcatggtgtcaggcttgcaatggatgacgtgcgtgcgctcggtgcggccggacgcgtcgtggtcgtcgagacgagtggacctcccgacgtgtccttcgcctccatcgatcgtgggcgctggcacggcgcagtggagcggttgagtacgttcgcgccgaccccccttctgccaggtcaactgccaccgcccccacgacccgggagaccctgggtgcgcctgtgcggcctcgagccacggctcgagggcgtcgccgcgagccgagacgccgcacagttggtcgctgcgctcgtgctcgacggcggccgcgccacgatcgacgcgttggccgacgcgctcgagcgtccggcgcggaccgttcgatccctcgcacgcgaggtgcccacctgtgtggacgacgagcgtgacgggctccggttgcgcccaggtgtgggatccgatctcggcctcgtccaccgggtcgacgaggcgatccgcatcgtcgacctcgtggcgaggccgccacttgccgcctacgagcagccgtggtttcgcgctcgagcgccggtcctggaggcggtcctcgtcgactccctgctcgccaccgcggaggcactcgagcgcgcggacgctcgtggtgaggcgaaggtgatcgtgcggctcgtccgccggacattcggaccgctcgagcggctcgaaggcggcggtctgcgccccgacgggaccacgggtgcagacgagggcgtcgcccggagcgaggaggtcggcacccacgtgccacgagcggcgttggtgaggccaggagccgtggggtcgtggtgagtagcttcgatgagcggcagccatcggccctcgggtgggagggtgtcgatcaggcgccgtcgacgggcctgtcggagaccgaccaacatgtgttctgggtcgaggtcggcgatcggatcggcgaaggcctcggcctgatcactgctcgcagcgaggttgccgaggtggagctcatcgtcgggccgggtgacgagcatcgcacggtggccgagccggtgggcggcgccccgtcgaactggggcgacttcggggatctcggaggggtcgctcgggacgaccgcgacgacgagccgcggaggctggtcgtcgcggcgacggaacccacggccgagaccggaacggtcgcggcggtcgacgtcgtgacggcgccgctgatgacgcgtccgcgacgctcgcgatggcgcacctggtcgatggtgctggcgtcggttgcgctgatcgtcgcggcgcgcctcctgctcttcgtcgccaccaccggcggacggcacccatgatcgcagcggtgtggctccttgctggcgtcggcgtgatgggtgcgcacctcgtcgggcccggacgcgaggacgctcggagccatcgcctgcgccgacgtggttcgctgtggatcgttactctcgtgtcggcgctgtacgccgtcgccggcctggcccttgggttcgagccgcttgggtggctcccgctcgcactcgggctgtggctgatcctcgtcgtcgcgttcgtggtgctcttccagcgtcgtcacgtgggaggtgccgacgtgcgctacgtcggcggggcgctctggctggtcgccgtcggactcggtccggtcggtctcgtgtggttgccgctcaccttgctcggcgcaagcctcgcgcagctcgcgtggtcggcgatctcgggtcagcgagggccgtgggcgatggtggcgtggctgagtgcagcaggactcgtccttgcggtcgttgctctgattgctgaggtggcactgcgataggcgctcaatgggagccgtcgtcgtgccgacagtagtcgagagcgaaggaggcggacgtggctcgagatgacgccgcacggcgactggtgatcaccggcgtcggcatcgcgttcctcggcttggcgatcgccgggacgagtgtctactacctcgagacgcgtgtctttcgcgaggtccagatcgtggaggccgccgccgagctgctccctgggcaaccgatcgctcgatcggagctcaccgtcgtgacgaccccggcgcagatcgcctccgggagcggggtcgtgctggccggtgcgctcgacgccctcagctcggggagctataccgtgtcggtgccggtcgcccccggcgcgccactcgaggttcgcgagctcgccaagcgtcctcctcgaggggaacgcgtcctctacttcacgccgcaggtcgcgccccccaacctggaggcgggctcggtgatcgatatcctcgtgcctcagccgagcaccgtccagacgcagtcgtcggcgcacgtcccctacgacgttccggtcgcgaccggcgtgacggtgctgtcggtgacgcatccctcgtctggatcatccggttcgctcggcatcgaggtcgcactacctcccgccgaagtcgcggccgctgcggccgccgcgaccagctcgcagtgcgtcgtggtgttctcgttccctggtgcccgacccgttccggtgggctagccatgctggtggtgttcgggctcgatgcgaacgtcggtcgcaagcgagtcgccgctgccctgacacgtgctgttccggggacccgcctgctggtcgaactcggcgtgtcgggtacgacgtggtccatggcgggagccgagttccagaagcgcaccccgaccctcgaaacgatctacgaggtcctgcgcgagcgcaacgacggcatgcggcgggtgcgcgtgcacctcgacaccgtggtaggtgcgctgagcgacctcgagagcgcacggcccatcagcgccgccgatgcgtcgcgtcgcgatgtcgtgcccgtggtgcgcgcgcccgtcagttcgaccgaggccgccgagcgcgcgctcgagttcggctcggcgctcgtcgagctgttcgtccagctggaacgctccagcgttctcgggcccaccaccgtgctcgccgacgcgggctgggtggcgccgggtctcgtcgggcaggcggcgtgggccgctgcggcgagcgatctggtgctcgtggtcggggagcggccggtggcgatcgcctcgctcggctacttcgagcgggcgttcccgcaggctcgggtctgggtcgtcgcgctggcggcgggtcgtcgtcgccgtcgtctcgctgaagtggctcgcttcgcactgcgcgcgcgtcacggcgtcgaggtcatcgccgtagaacccgatcagctcggatcggggaccgccctcgagcaggtcctcgagcccatcgtcatgggatcggctggttcgaccctcggggagctcggagcgtgacccgggccctcgtcatgatcgccgggagcttcctcggtatcggtgtcgtgggggcgttgatcgcgatcgccgtggctctccgccccccgagtgggggtcgagtcgaggaggtcgaacgcgtcggactcgtgtcgcgtcggccatcggcgctccggtctgcgcttgcgacgatgcacccattcgccatcgaccatcgactcgccatcggcgtcgcgcttgcgctgctcgccgggctggctggggcgtggttgctggtcgtcccgtcgatcctcatcggctacgtgctcggcgacctgttcctacggccggcgctcgccgagtcggtcgacgagctctcgtcgatgctccagttcatcatcgactttcgctcagggctcctctccggaggtgtgtcggttccggcggcactcgagctcgcgatcgatgcacaaccagcgggtcgcttcacgcgagatcgtcgcgtgccgtaccaacagatggccgatccctccgctcgcgagggggaggctcgtgttgcgttgagccatctcatcgagcgcacgaccaatccgttgatccacatcaccgacgtgttggtgtacctggcgctgcgtgcgacgaacctgcgggtggcgaaccagctcgatctcctcggcgacgtgctgctacagcaggtccaggcctatcgagggctcgtggtcaccgagctgctctcgtcgctcggcgaggtgcggctcatcaccatcatcaccatcggggcggtgtatgcgacgctcctcgcactcggcggctcgctcggcagcgacatcggactgtcactgctcgcgcaggtcgtcgcccttgcagggagcggggcgcagctcttgtgggccctctcgttgcgtcgtgatctcgagttcaaacttcggtacctgtgaggtcgtgacccatggatgcacggtggctgatcatcggggtcggtatcgcgattggtttggtcatcgccggagccggcgtcgcgctcgccggaggcagcaccctacttgcgctcagacgctatgcggcagcgctgccctcgatcgcgtcgcgctcgcgtgtgccgctcgcgcggcgagtcgttgccgccctggcgcgacggcaagccgacttcgatgccacgctctggatcgcgcactggtccaccgaggatgccgtcgcgcgcctccagcagctgtggctggtgctcgctgttctggctggtggcctcgtgctcctcgcgaaggccgtcgtgccgaacctgtcaccgttcgtcctggcgatcgtcgcggcggcggcgctcgcccttgccgcggtcgttgctcgcgtggtgctggtgtggcaggttcgcgccgaggcccgcatcgcgcgccagcgcatcgacaactccctggccaacctggcgctcttgatccgggtgtacgtccagggcggtgcatcggcgaccgaggcgctgaccgccatcagcgagcttcgaggcgtcatgagcgacgccggtgcgcgcgatgtcgacgcgtggatccagggatcccagcgcaacgaccagaacatcggggccgtgctcgagcgcttcgggaacacctatggtgtgccccgcatcgcgcaactcggctcgtacctcgagcagtcgatcctgtcgggtcggccggtctccgacaccctggacgtggccattcgagacgcttaccaggccctgttcgagtccaccgtcgcggcggtgaaccaacgggtacgcatcgcgtccctggtgttcatccctggcgtcatcgcgatcggcgtggtgttcatggcgtcgatgatcgcatcgatgcacggcatcgggcaggtgacgaagctgttcggcggcggaggcctctagcgagatcagttggtggccgtcagcggcggctcacccgggtagctccagagcggctgccagggagagatcgtcggatcggccatcgcggaggccgggctctgggcctggttggcccacttggcctgataaggaagaccctcgaactccacgacctgaccgggttggtacgtgacggtgggctcccaagtcggatcggcccctggaggcagcgtcgggagtgtcggtgcgtgatcgctctccagcaccggtccgaggagttcccatggcgtctggtaggcatactcgaactgctgcgtgggctgttggccctggttgtaccacttggcctcgtagatgtagccaccccacaccaccttgtagccggcgggataggggaaggacgcgctccagatcgggaagggcgcgttggctgggttggcgctcaccgtggtcgtgacctggatcagcccgcgaccgcgttgcacggacgcagggatctgatgctcgatctcgctcgagaacgcgagcggggctgtctgtgcgtcggagcaggtgttcgagtagacggcttcgttcgccagcgatgcggcgcacggcgcatcacggttcagcgaccagaacgagacccgcccgatcgcctgtgacgtcgaccacgccacgagctgcgacgcgccctggaggctcacccgttgaccgacgacgttgttctgaccgatctggaacgtcacacccatgtggttccagatctggtgggagttgagggggatacggtactcggcgaacagggtcgtgagctgctggtgtgccgccgtgagtgcgctctcggcggtttggacgaggcccccgggcgtcgaggtgaagtccattgtcatcacgttgacgccagcgagaggaacccgcttgaggagcatcgcgcggatcgccgcgatgcctgggtccgacagtccctggggtgtcgctggtagcgtgagccagatctggatcccggggtcttcgtgagccacgatcgacagcgcggctgcccgtcggagcgtcgccgcttgactcgtgagcgcggggccctcgatatcgaagtcgacgatgtgttggtcgtactggcggatgatctgctggtacgcggcggccagcgacgtcggcgtcgtgcacgccatcgacaagtgggtgtgggcttggccgccgaaggacacgatcgcggtcccgccgatgctggcgtactcggcgagccgggagttcagggcgaggtcctggttggcggcgctcggggtatagacgccaccccaggtgggtgagcagccgttcgtgccgctcgcgacgacgaacccgagcaccgtctgcttcgcgtcgttctgggtcggatcctggaacgcataggtcggcgacagcgtggcgtcgacgtacggggcgaagtaggtcgcgtggaccggcgctgcgtcgatgatccgctggtggatgcgccacgccgccagcgagccagctccaccgagcaccatgaggcccatgaggatccgcacagggctgtagcggcgcaggcgctccccgagcggcggcttccgatccggaccgtctccctccagctcgtgcggcatcacgagatcactgacagtgatcaaaggctgcaatgagtggtcaccaagcggagagagctcgtcgtgtgacatcgctactcctgtcgaaacgggtcgttgtcggtacggacgagtgtagcgtggagcggtcgtgtcgggccctcgatcaccctccgtggggttcaattctcagttgagcccacaatgtgggttcgagtacggtctttgccctccgcaacaagctacactctgcgtgagggtggttctaccgtggtgggcggtctgcggtcggtctcctacgagcacgggagggagaacaggttgagtcgccaaccagccggtacgcatggacagcgagcgcaggttcggctcgtcggtcaggccgctcaggtccccgagtcccgcatcgtgacggcgcgcctcgcaattatgaccactattggtggttgggtcggttacctgatctactggttctactcacagttcctgcgccaaggggcctacacgacgcaggcgaaggccgaggcgatcgcctacctcgccatgatcaccctgctcgaggcgtcgtcgttggcgtacctcgtggcgaggctcggccatatttaccgagctcgcgagcatcgtcgggtaccgcgggctcacctcgacggctacttctggcagcgtcgaccgagcctcaccatgatcatcccctcgtaccgcgaggagactcgcgtcattcgcaatacgttgctgtcagcggcgctacaggagtatcccgacaagcgcatcgtgctcctgatcgatgatcctcccaacccgacggaggaacgccatcgcgtcctcctcgaagcggcacggtctctgccgagtcagctcgagtcgctcctcgcgtaccctgccaccgcggctcgtcgagcttacgacgagttccgcgagcgtgtcggttccagagtgagccagctgcccgcgatcgttcacgagggtggatcggactccggtgccgcgtgggacggcgtggtggtcgacccgagcgagctcgaacagctcgccgatacctatgccctggcggcgagctggctcacccttcagagcgaagaactcccgatcatcgaccacaccgacgagttccttcgagacgaagtgttcgtccggctggcccacgaatttgcacagatcgccgacacgctgcgagagggcgcgagctacggccgtgaggtcgacgcggctcgcctcgcgcagctgtacgaacggctcctcaacgtctttggcgcgcgcatcacgagcttcgagcgcaagctctacgcgtcactctcgagcgagccgaacaaggccatgaacctgaactcgtacatcggcttgatgggcggtgcctatagcgtccatcgcacgctctcgggtcaggtcctcgtgtccgacgaccccgagcacgcggacctcgtcatccccgacccggactacgtgctcaccttggatgcggactcgaccctgctccccgagtactgcctccggctcgtctacttgatggagcaggaggcgtacgcgcatgtcgcggtcgcgcagacgccctactcggcctatccgggccccgcgtcgcgtctcgagcggatcgcgggtgcgaccaccgacgtccagcatgtggtccaccaagggctcgccaactaccgggcgggtttctgggtcggcgcgaacgccgtcattcgcaagcgcgcgctcaactccttggaggagatcacctgggaaggcggctacccgatcaagcgctacatccgcgaccgtaccgcgatcgaggacacggagtcgtcggtcgacatcgtcgcccagggctgggaaatctacaactaccccgagcggctgagctactcggccacccccccgacttcggtgccttgtgcatccagcgtcgccgttgggctgatggcggcctgctcgtcgtgccgaagctgtggcgttaccacaagcgggccaaggagaccgggcgtcagtcgttcgccgagttcttcctccgcatgaactacctcgcgtcgatcacgtggacgaccgtcgccctggtcgtcctcctggtgttccccttcgcgaacgagctcgtgagtccctggatcgccgtgctcgccctcccgtacttcttcgcgatgtcgacggacctgaagtacgccggctatcaccgtcgcgacatcttctcgatctatggtttcaacctgatcctcgtcatggtgaacctggctggcaccgtcagctcgatcggccaggccgtcaccggggctcgagcttcgttcgcccgaaccccgaaggtgcgcaagcgcacagtcaccccgctcatgttcgtggtggctccgtacgcgctcgtggtgttgtcgatctacaccctcttgcatgactgggagcaccacgcactcaactcgatgctcttcgcggcgatcaacctggtcctcgcggccgttgccatcgtcgccttcatcggcgtgcgcaacagcatccaggacgtgtggatccagatcctcccatggttccagcggcgcacgaagaaccgtcccgtccgcacgacacgccatcaagaggtgcccgtcggagtcgggggcacccaactgggaacctgggagcacgtcctcgatctcggtgcgtcctcgatcgggttgggcgaggccgtcgataccgacgggcctggtcggttgcgcgtcggttcgcgagcagagcgcgaacgggcgcggcgccggctagccgactacgggctgagcgcgctcgcccagccgatccgtgacattgaggccgacgagatcgtcggctacgagatctatcaacgggtcaacggtgaggcaccgccagcccagctcgccaggctcgacacggtcgaagcggccagccttgagcagcggctcctggagcgcgccgcactgctggcacgtgacatccctgagggcgcgtggctgagcgtgaatgtgtcgtcgcgattcttgaccctgatggaagggcggcgacgcttttccctgacggcgcgcgaggggctgttcctcgacgtgtcgttcaccggcgtgctcgacggccctcacgtcgcggccacagaggacacgctctcgcgtgcgacgaaccggttcgcgatcgccctggacgatttcgtccccgatgcaggatccctggcggtggttcgtcgggtgcggccgagcatggtgaagctcgatcccgactgggtgcatgatctccccaagagtgccgcgaagcgtggccagaccgaactcctgctgcgtctcgctgcgccgcgtacgctcgtggtcgccgagggcgtcgaggacgagcgagagcttgcggcgctgcgcgcgctcggggtgcggtttgcccaggggtacctcctcggtcgaccggtcccgctcgaggagaccaagagcatcgctcctcgcgattaggcctcctcgcccgagtgggaccgccaccactcgaggaggcggcgcctcgcctcgtcgggatcgttcagcccctcgtcgatcgtgaggtcggtgaggaagcgcatcgcgcggcccacggcaggacctggtgggatctcgaggatgcgcatgacctccagtccgtcgatcggaggccgacgcgctcggagcgcgtcgcgctcggcgagctcccgtgcgcgctcttcgaacgtcgccatgcgctcggcgaacatgcgtcgtcggcgctcgttgcgggtggtcgcgtcgcaggtggtgagctcgttcaggtcctcgaggagctcgcctgcgtcgcgcacgtagcgacggacggcggcgtcgctccaaccctgagcataggtgtggaagcgcaggtgaagctcgacgaggcgagcgacgtcgtcgacgaggtcgttggggtagcgcagctctcgcaggatgcgacgggccatacgagccccgacaacgtcgtggaagtggaaactcacgccgttcggcccgatctcgcgagtcgcaggcttgccgatgtcgtggaggagggcggcgagcctcaggcggagccgcggtgagcagcttgcggtgaccgcgatggtgtgggcgagtacgtccttgtggtgatggatggggtcctgctcgagcctgagcgccggaagctccgggaggaactcggcggcgaggggcgtgtcgacgaggaaccagagacccttgctcggatcgggcacgacgagcagtcgagagagctcgtcgcggatgcgctcacgcgagacgacctcgaggcgcggggcgagttcgtggaccgcgtcgacgagcgcgcgctgcggctcgagatccaagcgcgcgatgaagcgtgcacagcgcaacatgcgcagcggatcgtcgctgaaggagcgtcgggggtccatgggagtgcgcaatcggcgcgcgagaaggtcctccatcccgccgaacgggtcgatcagggtcgggtcatcgctcgtgacctcgaccgccatggcgttcaccgtgaagtcgcgtcggaggagatcctcggcgagcgccgagacgaagtgcacggtcggcttgcgggtggaggagtcgtaggcctcgcctcggtgggtcgtgacttcgagcggcacgccgtgatagtggaaggcgaccgtcccgaagcggaggccggtcaggttgaagtgcgtcgcgacgggtctgacgatctccacgatctcctcgggcgtcgcgtccgtcgtggcatccacgtcaccgttcggctcgatgccgagcagtgcgtcgcggaccacgccgccgacgaggtagaggtggcgttgtcgttcgtcgaagcgtgcggcaagcggtcggagcgcctcgatgagtgggcggagtagggcggggagcacgtgccgagaggctacccgcgctcgttcgcgagacctcgctcgagtgcggcacgatgcagccgttggagggtcgtcacgagctcgtggtcgacatcgcggctcggggcctcaccgacgtcgaccgccgcatgcaggagcgtcgcgaacgtgaccagcgtcgagtgctcgagcgcttcgaggtcgtagccaccctcgagcgcgaggatcaggcggcctgggggaacggcgtcgcgcgcgatggcgatcaatggtgcatagtcgggggcgcgaaagtcgagttcggtgagcggatcgtcgcgatgggcgtcgtagccagcggacacgatcgcccacgtcgggccgaacgtggtgatggcggggagcgcgatggtttcgaggagtgcccgtgccgtctggcccgacgtctgcggggggagcggcaggttgatcgtggtgccgaccccagggccatccccgacgtcgccgatgcgcccagtccctgggaacaaggggtactggtgtgtggagacgtagagcacacgaggttcgcgctcgaagatcgcggcggtgccgttgccatggtgcgcatcgatatcgagaatgaggacgcgctcgccctggtcgatcagcgcctgggcggcgatggcgacgttgttgaggaggcagaaccccatggcctggtcgaccgtggcatggtggccgggcggtcgtacggcgaggaaggcggcgtcggcctcgccctgtcgaagccgctcgatcgcgtcgagcccagcgcccgcggcgagctgggcggcctcgaacgacgcgtcgttcaccgaggtgtcggggtcgatcggaccgccacccatgaggcagtaacgctccagtgcctcgacgtgcgctggggtgtggaccgcttcgatggcggctcggggtgcaggtgtcggcgtgacgatcgtgacggcgtcctcgaagtggctgagcgcatggcggacgacctcgagtcgctcggcacgctctgggtgccacgctccagcgtcgtgctccaagaaccgttcgtgcgtggcgtagaggatccggcccacagcgtcatcctacgccacgggggcttctcgacccgagtcggaggtcagctaccataggcctcatcggaaccccgttcgctcacccatacccagagccggccaccgtgcaggtcgcgggccgcagtgtccggctgtctccgtggtatggcttcgacggcgccgtgctgctcggcctcgcaccggcgctgtggctgcgtgatccggcgtggctcgacatcgctcgtcgtgcagcagccgcccgcggttggcgccgatttctcgtacaggcgacgactcctgcgcagcgtcttgcgctcgacgcagcagggtgggtcctcgtcgacgaactctacgtcttgtttcgacgagggtcactcgagctcccgccggtaccccacacggcccggggcgtcgagatgcggcgcgggagggcggccgacaccgcagagctgctcgaggtcgaccatcggtgcttcgagccgttctggatgatgaacgaggcggcgcttcgcgaggcgctccaggcaacgcctcgcactcgcttccgggtacttgcgagcgccgacgacgatcgagttgttgggtacgctatcttcggccttggcgccggtgagggctacctccaacgcatcgcggtcgaccctcgctaccagggccgggggctcgcgacgcgattgatcgtcgatggcctgcggtgggcgaagagatggagagcgcgccgagtcggtgtcaacacacaacgatcgaacgagaccgcccttcgcctctaccagcggcttggcttcgagatggagccgaacggcatcacgatctatgcctggccggatcactagtcgtctcgtcctcctcctcgccctcgtcgtgctgggtgtgtggttgcccaggggcgcagcgctcgtcagtaccgcgcgggaggccgtgaccgtggtctcggcgcccggcgtcgtcgtcggctcgcagccgatcgcggcgacctttcgcctcgcgcatcgtctccacgacgcggaggctttcttcgtcgtctatcccgccacgacgtcggtgagcggccttggtgcggtgctctcgggcgcacagctcgggtacccgatcgggatcacccacgccgtcgccgtgtccccgcacgcctcccagatgcacctggtggtgccagacccgatccctgccagcggctgtggcacgagctgcagcggcgtctacccggtgcagcttcgggtcgcgagcgcggtgagcgggcagaccctggcgtccgtgacgttcgcggtgccgtacttctcgacgctgagcggcgtcgttccgctgcacctcgccgtcggggtcatcgccgagacccctgccgtgacagcgtcggcgatcgaggaactcctcgcccgagacccgagcgtccaggtcggagtgagcgccgaaggcccggttggcctcggagcgctgcgctcgctcgcgcacgccgtgcctcttcgtgcatctctgctcgcgcccaccgttggcgtcgcacgcgcgtgtgtgggggcgctcgggcccttgtcgtcgttcgcatcgtcggttcagctggcgcgtaccgtcgttggcacggccagcgcgccgctcgcgttcgccaccgtgccgacgtcggacgaactcgaaagcctccgagcgctcggtatccacgaggtcatcctcccggcgtcggcccttgcgtcggcgtcgccggtcctgacgctcagcaacgcggtgcgcctcggcgcaggtgtggtggcactcggcacctctgcgatggtcagcgacgggctgagctcggtgacgcagcctctcggggcgcagctgctcatggccgaactcgcacaggtctacttcgaagctccctcgagacctgggcgggtactcgcgggtctcgtcgccgtcgcgagcgatgcgcgtatggcggcgttcgctcgcgggttggcaagcctgggcagcctccccttcctccagctctccaccatcgatggcgcgatggccaccgcgagctcgaccgtcgttcggccgaacgtcgccgccgagagggcgtgcccgcgcccactcgaggccctgcgcgtcgccgcgcgtcgtgccgcggccctcgccgaggctgcgcccggggtccgcccggagctcacggcgttggtgctcggtgccctggctcatcccgaggcaagccagctggcgcgtcacgccatcgatcgcaccctggatgcgatcacggtcgcctccgatcagctgacgctcacgagcgctcgcgagacggtgcccatcgacatcacgtcgcatctatcggtccctgccagcatccgagtcgtgctcgtcgacaccaagctccggttcccggagggctcgacacgcacggtcaccgtggcgtcgaagaccgtgacggtgcccatccctgtcgtggcacgcacgctcgggacctcgccgctcctggttcgcctcgagtctccctccgggcagctcatcgggcagaacgtcctcgtggtggactcgaccggtttctcggtggtgggcgtcgtgctgaccggttcgtccgcagccctgctcgccgtgtggtgggttcgcaatcggggtcggcgccagcggggccgacacgcgaagcggagctgatggtgcaggcgcgtctcgtgcggctgctggccggtcgcggtcgttcggtgggcgagaacgccaccgccatggcgatcgggacggcggcaagtcgtctcagcgggttcgtgcgcctgatcgtcctcgcggtggtgctcggggtgcgtccgttggccgacgccttcaacctggcgaacaacacgccgaacatgctctacgacctgttgctcggtggagtgatcagctcgacgatccttcccgtcgtggcggctcggatcgcgagggcgggggagcgagccggcgagcgctcgctcgctgcgatcatgacgatcggggtggtgggcctcctcgtggccacggtgctcttcgaggtcctcgccccggccgtcgtcgatctctacctcatcggcgaccatcttgcggctgcgggcacggagcgcgcggtcgcgatcgagctgttgcgcttgtttgcaccgcagctcttcttctacggcacgatctccctcgccaccgcggcgctcaacctgcggggcaactttgccgcccccgcctttgcgccgatcgcgaacaacgtcgtggcgatcgcggtgctcgtcgcgttcagggtcgctgacggctctgccaccctcgacgaggtcgcctcccgtccggacgcggtgctgctgctcgggctcggaacgacgctcggggtggcggcccagctcggcgtgctcatgccggtgatggcgaggctcggtctcggactgcgtccacgtctgcgcgtcagcgaccccgcggttcgcgaggtcgtctcgctgtccggctggacggcgggctacgtcgtcgccaaccaggtcgctctcttcgtggtgctcgcccttgccgcgacgcgggccggctacgtgtcggcctacaactacgcctacctgttcttccagctcccgtatgcggtggtgtcgctgagcgtgatgagtgcgctccagcccaggctcgcacgctcgtgggcagctggcgatcgagcgagattccggcgtgatctcgccaaggcgctcgccgtcggcgtcggtgccaccatccctctcgcggtgctcgcgtgggtggggggacctgccggcctcgatctcctcgtcggctatggggcggtcaacgagcacggcgtcgccctcatcgcgggtgcgctccgcggcatggcggtcgggttgcccggtttctcgctctttctgatgctgatccaggcgctccaggccatgcgcaatgctcgagctgcgttcgtcgcctacctggtcgagaacggattgaacatcgtcctcgccgtcgtcgcgctcggtccgctgggggtcgagggcctcgggctcgcgctgggactcgcctacaccatcggcgccatcgtcgcgatcgtcatcgttcgctcgctgcggggactcggccccatcgcgccgctcctcggctcgtgggtgcagctcgccgtcgcaagtgtcgtcggtggcgccgtgctggccgcgctcctccctagcacgctcgtcgcgccgaaccttggttttgccctgcgtgtcctcggcgggttggtcgcgggggtggtagtcttcggcgctgcggtgatcggcctccgcacaatccgagtggccgtggcgaggggagtcggacggtgagcgtcgtcgtcgttgcggattcagcgagtgatcttcctgccggggtggcagaggcgctcggtgtgcagatcgtgccgctcaccatcgaggtcggtggtcgggactgggccgacggcaccgagctcccgcgcgagcgtttctgggagctccaggcggcccagtcggagctgccgaagaccgcggccccatcgtcggcgcagttcgcggccgtcttcgaacgcgcgctcggtgagggcgctgaaggcgtggtggccatcaccttgacgcgcaagctctccgcgaccttccaggctgccgagcacgcctcgcgagactatggcggtcgggtgcgggtgatcgactccgagaccctcaccctcacagaaggcctgatcgtcgaggaagcagcacgcctcgctgcgagcggtgcggatctcgaggaggtcgcggcagcggtcgaggacgtgaagacgcgcgcgagaacccgtggcaccctcgacacgctcgagaacctccgccgaggcggacgcatcggcgcggcagcagcgctgctcggcacggtgatgtcgttcaagccaatgatcgacatcaccgacggcgaggtgaagccgggcggtcgccagcgcacgcggcgtcgagcgatcgacgatctcgtcgactgggtcgagggcctcggtccgctgacgcggctcggcgtcgtgcacgcgctcgctgacgacgtcgacgaggtcgtcgagcgcgtcgctcgcgcagcggcagtcgatcccgccacggtggcagttgcggtgatgggtgcgacgatcggcacccacgccggtccacgagcacttggagtctccgctctcgtggcctccaggtaggctgggagcgttccacgcgagagcggccacaccagagtccgtgagacgagcccagagaggagccagcatggcgaccttcgaaacgggaggggagcagccggacgtcgcggctcgcgtcgctacctgggttggcgaagcggtgtcgctcattcggtcgcggaccgtcgatccggcggcgttcgtggcccgtgtgctggtgtacggactgctcgcggctgcggtcggtgtcgtggtgctcatcttgtcgatcgacgccgtcgtgaagctgctcgatgcgtatgccttcggcaatcgagtctggatcactgagttcgtcgtcgcagccctctcgctcgccggatcggccgtggcgtggcggcggatgggacgtgcgcgtcggcgtctcggcgcttgaaccagcgcaccacgttgaggaggtagtcgtgcctgagcacgtcaaggtcgtcatcatcgggtcgggtccagctggcctcactgccgcgatctacgccgcgcgagcgtcgctcgagccggtcgtcatcgagggagagccctcctcgacgtccgaccagcctgggggccagctgatgctgaccaccgagatcgagaacttcccagggttccccgaaggcatccttggccccgagctcatggccaacatgcggcagcaggcggagcgcttcggggcgcgctttcggggcaccaaggtctcccggctcgatcttgcggagcggccgttcgcggtccacaccaacgacgatcgaagcggcgagccggcttatctcgccgacgcggtgatcatggcgaccggggctcgctcgctcatgctgggactcgaacgcgagtacgaactgatcggccacggggtgtcgacctgcgcgacgtgcgacggcttcttcttccgtggccacgacatcgcggtggtcgggggcggtgactcggcgctcgaggaggcgctgttcctcaccaagttcgcttccagtgtgaccatcatccatcgccgtgatcagctgcgtgcgtcgcgcatcatgcagcagcgggccttcgcgaacgagaagattcggttcgcatggaaccgtcgcgtcgtcgaactgctcgagcgcgacggtgtcctggtcggtgttcgcaccgaggacaccgtgaccggcgagcgcgaggatctcggagtcactggactgttcatcgcgatcggccacgccccgagcacggagatcgtcaagggtcagctggagatggacgatgcggggtatctgatcacgaagcctggctcgaccgagacgagcgtcgacggcgtgttcgcagccggggacgtgcaggatcacacctatcgtcaagcgatcaccgctgcgggctctggctgtcaggcggcgctcgacgtggagcggttccttgctgcgcgcgagtagcgggaagcatcgggtcgcagggggcgttcgttgctgatgcaacaagataagggaggtgcgcgatggcgggacatgaggtcatcctcacggacaagaacttcgacgagacggtcaaggcatcagagctaccggtcctggtcgatttctgggcagagtggtgcgggccatgcaagatgatcgacccgatcctcgaggagctggccgacgagatgagcgacaagctggtgatcggcaagctcaacgtggacgagtcgctcgagatcgctcgtcgcttcgagatcatgagcatcccgacgctgatgctcttcaaggagggcgagccggtgaagcgagtgatcggcgcgatgccgaagcgagccctgctgaaggaactccagccggctctcgaggactagcgcctgggcacgtccccgtgccgttcgtctctttgcgagggggcgagcgcagcgagcgtgtcgaggacttgtgtcgacggttgcggcgcctcgggttcgagctcgaggttcgtgacgagttcgacgatgaggtggccgaggccatcgtggccttccaacgacgtcgcggtctgccagagaccggggtggtcgatctcgtgacgtggcgcgcggtcgtcgaggcggggtttcgtatcggtgatcgtctcctctatctcaagcggcctgcgctccgtggcgacgacgttgcctggctccaaggcaagctgggctcactcgggttcgaccctggtcgagtcgacggcatcttcggtccgcgcacgcgcagtgcgcttatggagttccaggccaatatgggcctgcctgccgacggcatgtgtggtgcggcgaccatcgaggagctgcgacgggtcgatctgcatcacggtgcgcacgtacatggcgtgatcgagcgactcagccgcgccgaccgtcactctcggttcagtgacgtcgcggtcgtcgtcgccgccgaggcggcgctcgaaggcgtcgcggatctcgtcgcggctcgggtgcgtcgccgagggggccgctccgtcgtgctcgtcagcgacgtgcagtcggaacttgcccggacgatcaacgatgtcgcgccagacgtcttcgtccatctcgggtactcgctcggtggtcgttacgtggcctactactcgggctacaactacgtctctccggtcggtcggcaactcgcagaggtcgtctcccaaaccgccggtgcggtgcgaggactggtggagcgaggcatgagcatcccgatcttgcgcgagacgcgtgctcccggcgtctccattgcgttctccaacccccacgagtggtggatgctggcccccgatctcagcgacatcatcgtgacgagcgtggaggcggtggtgtgtcgagcgaggccgacgggaaaccatcgcgactgagtggctcgtgcgtcgtcatgagcgaactcccggtccgtgccgatggcacgccttgcgctggtccgcgggcgcgaacgggtatgatcggagatcccggggctatagctcagccggttagagcgcagcactgataatgctgaggtcgctggttcgattccagctagccccaccgtcctgacgagggttgtttcggcggaccggtcggcgatccgggcgttcgcaccgcatcggcaccacacgaggtcgcgggcctgtcgcgggacggctgtgtcggggtgccagctggattccttcgaaccgcagccccagtctgctggaaggtccttccaccctgactgcgatgctcgacgcgtcccgctcgagctgctcggaccgtcgatcggtggccttcccgccgtctgctcgacagtccgaggtgaagccagggccatctccccgcgggcccaggcaagctccgactcgaccggcggcacgtacccgaggcgcgagtgcagccggacagtgttggggcgccggatccagggagcgatgccagagggggccccggcgaggttggcgaagcggccgcaagctaccagctcgcgctcgcaagctcccgaagaaggcctcggccacggcgttgtcgtcgcaggtcgcgatcctgcctaccgactggcgaagcccgagcatcgcgctgagcgcgcgtaccgtacgggagaggcatggctccagtgcaacgaccggtcgcactggacggtaaccgacacgtccgcaccttggaatatcgacaatccgctatggtggcggcatggacagcgtcggcgaggtgctgagggaggcccgacgtcgtgccgggctgacgcaggcggaactaggtcgacgcgccggggtgacgcagagcgtcgtcagtgcgtacgagtccggtgcgcgccagccatcggtgtcgatgctggctcgtctggtcgccgccgcgggcgccgagctgcggatggagctgtccgaacctgcgggggccgcagcgccaggcggtgaactcggccagcggctgcgagaccgccgcgccgagctccagaggatcctggcccgctacggactgcgcaacgcccgcttgttcgggagcgtcgcccgcggcgatgcgggtccagacagcgacatcgatcttctcgtcgacgtgcctggcggagtgggcctcgtgactcttggacgctgccaggctgaggtcgaacagctcctcggagtccacgtggacctggtaccggcgagcgatctcaaggctggcgtcgctgccgaggttctcagcgaggcagtgccactgtgagccctcgggaacgtcagcgccttcaggacattctcgtcgccatcgccgtcatccgctcacacctcgagcgtggtgacctcaatgacgggctcgtcgtcgacgcggtacgagtccggctcatcgagatcggccaagccgtcaaggctctcccccaggagctgctcgcacaggagccagccctcccctgggcgcagatcgccggcatgcgagaccgtctcgcccatcgctacttcgacgcctcgcacgccatccttgccgccaccgtcaacgaggacctccccatcctcgaggcggctgttggccgtctcgagcggatcgtggcggatgcggccgtctggccacggccgtgaacttccgccgagcgagcctcgcagccgagagaccggctggcgaccacggccgtcgctcgggtctggctaggtgtctcgttcatgccttcctcctctcgcaggtgtcaccctggaggggggacagcaacggtcgtgggaggatccgctgcggcgatgagatcgcctccgtggacgccacgccctcgaccatggccgccggtgcctgcgccgtgcgtgggcggcccaggcgatggcgatcgcaggaggtgaggcgggggagcgagctcaccaggggcgtcgtcgacgcagctacgccctctcgcgcagtgcggtgaggaactcgatgagccccgccatgtaggtcgcctggtcgtcgtacatgcacatgtggctcccgttcggacataggaggaactggccctgcgggagacgctctgccatctggcgcatgtggtccgggtccatggtgtcatgagtcgcgccgatgacgagcgtcggcacctcgatggataccagatcgtcgaagcgatcccagtccttcagcgaggcgtcgcccgccatgcccatctcgctcgggccctgcatcggcacgtagatgtcgcgattggtgtgggcgaaggcgcgtaccaccggctcgggccactcgtcgagcggcatgcgcagcgtgtgttcgaggtagtagctccccatgagcagttcctcgtagcggccgctctcggtgtcgccggcggcctcgagcgctcgtgcttcggcgacgatcgctgggtcgagggccgggatgaggacctcgtcggcgtaacggttgtaggcgggagcactcgccatcatgttggagatgaccagccctcggagcgtgtcgccgtgtcggatggcgtactccatggcgaggatgcctccccaggagtgcccgagcagcacgaagttggacgcgtcgaggccgagggctcgtcgaacctgttccacctcgtcgacgtagcgatcgagtgtccagaggctggggtcgtcgggacggtcgctgcggccgcagccgagctggtcgtagtagatgtactcgatcgcagcgagcggcaggtagctgtcgaagcactcgaagtactcgctcgtcgcgccgggaccgccgtggagcagcaggactcgcaggtcaggggcgttgcccactcgcttggtccacaccgagaaggtccctcgaggcgtgtggatcgggatgcggcgggcaccacccgagagagcgtcgtcgcgggtgcgcgcgtcgagatagtcgtgcaggtccatcgctgcccccttgcggtcgagacgtctcgacgctagtgcgacgagcggggcgactggggccgaaacccctggcgagcgatcgcacgtaggctcgatgcatgacccaagcagcaacgtggcgtaaccgtgatgtgtggctgatctcgttgtccgctggttttgccgacctcggctaccaggcgatcgtcgccggagtaccgctgctgatcgtcgtcgacctgcgtgcgagcgccctggtgtacggcgtcgccgccggcctcggctacgggctggggacgttcgcgtcgctcgcgggtggtcggctcgccgaccgcatcggtcgacgtccggttgcgatcggcggcaacctcggcatcttgctcctgtcgctgatcgctctggcgagaagtgtccccatcgtcgtcctgctcttcgtgctgggctggctcgcgcgcaacttccgctcgccggttcgccgggccatgctcaccgaagccgtcgcgccggagtggcgccgcaatgcattcggccttctgcacgccgtcgacgtgggtggcggcgtgctctccgcgcttgcggcggtcgtgctcgtcggtgcgcacgtcgtcggtctgcggggcctgttcgccttcaccgcgatcccgatcgcgatctcgagcctgctgctcgccagcgcgcacccgcaccgtacgggcggcgccggcgcgcgtcgcgacgtcccgacggcgccggcgagcacgcttcgtcgtgcagtcctcgtcgcgaccgccctctatggcttcagctcctatgcgctcggctttccggtcctcgcggtcgcggcgcgctcaggatctgccaccgagggcttcggcgcctatgccttgttcctcggcgcctcggcgatcactggctacgtcatcggtgcgcgccgcgggtccccgatcggttggctcgcgcttggcggctacggcctctcggcacttggctcggcgctcctcgtgcccgagagcgcgatggtctcgatcatcggggttggactcctcggggtggggctcggcgtcatcgagacgttggagccgaccgtcatctcgcgactggcaccggacgcggctcaaggaggtgcgctcggtgcgctctcggcggcgcggagcgtcgggctcttcgtcgctgacgtcgtcgcgggtctgctgtatgcctcccacggaggtgtggcgttcgtctacggtgcggtgctcgcggcggtcgctgcgatcatcatcggcgcccaagcgccgctggcccgccggacgttcccagcgggccagtggtgagcgaagagcgcgtctagcgatcggcgtcgccgcgggcgaactcctccaccgcgcgtcgcgcatcctcgtcgtggagctggcgcggcggtgacttcatgaagtaggccgagggtccttcgaggggcccgccgatgccgcggtcgagggcgatcttggcgcagcgaacggcgtcgatgatgaccccggccgagttcggcgagtcccagacctcgagcttgagctcgacgttcagcggtacgtctccgaagttgcggccctcgaggcggatgtaggcccacttgcggtcctcgagccacgcgacgtggtcggacgggccgatgtggacgttgtgggagtcgatgccgtgctcgatctggctcgtcaccgactgcgtcttcgagatcttcttcgactcgagtcgcgagcgctcgagcatgttcatgaagtccatattgccgccgacgttgagctggtaggtgcgatcgaggacgagtccgcgatcttcgaagaggcgagccagcatgcgatggacgatggtcgcaccgacctggctcttgatgtcgtcgccgatgatgggaacgccagcctcacggaagcgctctgcccagaccgggtcagaggcgatgaagacagggatcgcgttcacgaaggcgacccccgcctcgagtgcggcctcggcataggcacgttgggcttgctcggagccgaccggcaggtaggcgacgaggacgtcagcacgggcctctcgcagacgcgccgcgacgtcgacgggcgggaggggcgactcggtgacgacttggcggtagtaggtgccgaggccatcgagcgtcggtccacgatcgacggtgacacccgcctcggggacgtcggcgaacttgatggtgttgttgtggctcgcgaagacggccttcgacacgtcgaggccgaccttctcgtcgtcgacgtcgaaggcggcgacgacctcgatgtcgcgcacgtggtaacccccgagcgtgacgtgcatcaggcccggtacgtcttggtcgtcagtggcgttccggtagtactcgatgccttgcaccagcgagctcgcgcagttgccgaccccggcaatcgcgaggcgaatcgttcccattctgttccccttctcctttctgagcgccgatggtctgagcgtcgatggctcgccgtcgtcggccgcatgtgacgacgttcgcatcgtcacgaggtcgtcgatgcgccgtagccagccggcgcggcgtcgaggaccgcgagttccgaggccgtgcgtgcccggacgatgtcgagccagaggtcgggcatctcctgctcgagccggtcgagctcctcgagacgctcgacgaggctgcgccgacgaccgcgcagcagtgcgcggcgcgtctctggcgcgaccagcgaactcgccaccagcgcgatggtcgcgatgcgatcgtcggccatgtcggcgaactcgagcgcggtgcgcaggcgcgcacgtccctcgtcggtgatgcgataggtccgtcggctccggccacctgcggtgctggcagccaggaccaactcggccgcgaggacgccggggaggcgagctggatcgaggcgacccaccgcaccgacggaggcgatgagcccactgcgcgccaagcgagcgagcgccggatagatcgaaccgtacgagaagcgaccgatctccccgaaggtcgcctggagccgacgggcgacctcgtacccatgggccggcgccgcctcgagcacgacgagcgtcgcgagttcgaccgccgtcagctctttcgcgcgctcggacgagaccatggtgcgtagcatagtggctgatacgagatatcgattcgatatagcggccgaaaccctgattccggccatcgtgcggtggaggcgctaccatggcgtcgtggatcaaggtcgcgcgcgcgaggtcggtggtcggctggccaccagcgtcgatcaccgcctactcaggtggcgaacgctgcgcgccctcgctgccggaaccatcgtcagagaagacgtgtgtgatgccggtttcgagctctcgcgtgcggcgagcgcgttcggcattccccgaggggtcgtgtgtcctgtgtgtgctgccgatgcgttgcgtgaggttgcattcgccttcggcaaggggctcccgcacgagggccaggtcgtcgggggcacgctcgtcgaggaggcgctcgacgcggtgccggatgttcggctgtttcgtgtcgaggtctgtctggcgtgccgttggaacttcgtgatcgaagagcgcggtcacaccggcgtgcgatagggttggatcgatgccggtgtcacccccggcagagcgcctgtagcgcgaggagcgcacgggacctcggagagggggaaacatggagtcagcgtcgatgagcgaccgtatcgcgacggtcccggccatcgctggatcgaaggtacgctccgggagtcggccactcgtcatggtgaccgcctacgacgcgccaggggcgcgcattgccgacgacggtggcgtcgacatgatcctcgtcggcgactcggtggcgatggcggtgctcggcatgcccgacacgctcggggtgcgggtccgtgacatcgcccaccacgtagcggcggtgcggcgggcgcagccgagagccctcgtcgtcgcggatctgccatggttgagctaccaccgcggacgtcgccgtgcagtcgaggccgccggcaagctcgtgcgcgccggcgcgcaggccgtcaagctggaggggggtcgcgaacgccttgacgtcatcgacgcactcgtgcgcgcgcagatcccggtgatgggtcacctcggcctcaccccccagagcgcgaacgtcttcggtggcatggtcgtccaaggccgttcgatcgtcgcggccgaacgcatcctcgcagacgccatggccctcgagcaggcgggggtcttcgccatggtcctcgagggaattccggccccgatcgcctcggtcgtgacggctcgcgtcggcgtcccgaccatcggtatcggtgcgggcgcaggttgcgatgggcaggtcctcgtgttccacgatctgctcgggttcgccgatggccatcggccgcggttcgtcaagacctatgcggagctcggcgccgcggctcgcgaggcggtcgccgcctgggccaaggacgtgacggagggcgcctatcccgatgacgcgcatgcctaccgcgcctctaccgagctcgctgcgtgggccgagcgacagctcacgagcgaggagcgtcgtgggggcgcgcctcgctcctagtcgctgggcgcgatatctgcgaagcgggtccagtcggcgatgaaggccaggttgacggtgccctggggaccgttgcggtgcttggcgacgatgatctcggcgacgccgcgatcggtggtgtcggggtggtacagctcgtctcggtagatgaacatgaccacgtcggcgtcttgctcgagagagttgtgcacgatgacgccgtcggcgacgaacgcatgcgtctcgggtacctcgatatcgaagacgagctccgtgccgagttcgtcgaccgactcgacgacggtcgtcgccaccgtagtcgcatccaggaggacgtggaccacgtcgccggatacgagggtcccggcctcccgccatcccgacgatgtggcgatcgggtgattgccggtcgcgcggaggatcgagccgttggcgagggtcaggcgtcgcagtggcttgaggccggtggccacgacgcgtgtacccatggcgaccgtcggcacgccctcgggggtgacggatgcgagcggaacggatctcgcccccttgctccagagcatgccgatgggaacctcggtaccgtcggcgaggcgtaccttggcgtcccacgagaggcaaccggactcgcggaggtccgcgagttgcgggcgacgatcgctgcgtgattcgaggttgcgcgacagctgggagagcgcgatgatcggcacgtcgagctcgcgggcgagcagcttgaggccacgggagatctcggagacctcgagctgccgtgactcgctctggcgtcgactgctcatcagctggaggtagtcgatgacgacgagcgagagtccttgctcggccttgatacgccgcgcgcgcgtgcggaggtcgaggacggtcaggttcgggtcgtcatcaatgaggatcgggcgcgtggcgagttcgccggcggcgttggagacctgatcccactcgcgttcgttcagacggccggagcggaggcgttgcgaattgacgcgcgcctgcgacgcgaccagccgctggccgagctcgatgcggttcatctcgagcgagaacagcaggacgggctcgctctggttgcgggcgacgttcagcgccatcgagagcgcgaaggacgtcttgcccatgcccggtcgagcaccgacgatgatgaggttcgatcgatgcaagcccgtgagcagctcatcgaggtcgcgaaagccggtcgggacggcgaaggcgcccagatcgtcggagccggcgacctgctcgagctgctcgaggacctccatcagcacctgctcgaggtgcgccgcggactcgtgactcgtgccccgcgcgacgttcaggatgctggcctcggcgtgatcgagcagcgcgcgtacgtccttcgggaggccgtaggcctcctcggcgatgtcagaggcggtccggatgaggcgccgaaggatcccgtagtcgcggacgatctgggcgtagcgcccggcggacgcgatggctggggtctggatgaccagacggttcagcccctcttgaccaccgagcgcctcctcgatgcccaggcgacggagttcgtcgcccaccgagaccgggtccgtggtctcaccgcgggcgtagaggtcagcgaggacgcgaaagagctctcggtgtgacggtcgaaagaagtcgtcggcttcgacgagttcgacggcgtccccgatcgcttctcgcgacagcagcatggccccgaggagcgactcctcggcctcgatgttgtgcggcggcagccgatcctcgggcccttgcgagcgggccatcgcggaccggggctcagcgctcgctggccgcgaccgaaacggtgatcgccacgtcgacgccgtggcccagcgcgatcacgacggggtgctctccgacctgcttgatcggagccggaatgcgcacgtgctcccgttcgatcgtgacgccggtggcttcggcgatcgcgcgcacgatgtcggcggccgtgatcgacccgaacagcgtgccctcctcggaggcgcgagcactgagtgcgagctcgatgccggcgagctgacgcgccgtggcctcggcctcggcacgctcgcgctcgcgtgcgagctgtgccttcgctcgcatcgcctcagcttggtgggcgatcttcggcgtggcggcaacggccagccgacgcgggatcaggtagttgcgggcgtagccatcggcaacgcggacgatgtcgccacgatcgccgaggccttggacccgcgcgcgcaggaggacgttcatgcctgttcctcctcggctgctggcgtctcttcctcgtcggcgctggtgcggtcggtggcctgggcgcggttccgcgagcgcagctcgcggtcaccgacgggctggtcgccctggttgcggcggcttcggtcggagaccggacggatcacgtagggcagcagtgcgagctcgcgcgccaccttgatggcgttggcgacgtcggcttggtgctgggcacagttacccgtgacccgccgggcgcggatcttggctcgctccgacgtgaaacgacgcaggagatcgacgtccttgtagtcgacccagtccacgtgctgctggcagaaaacgcagggcttcttcttgatgcgcttggtctcgggtgcctcgcggccccgacgcttgcgcttggtcgctgtcttcggcattgcttagaacggctcctcttcgtatcccacgcccccgtcggcgacaggggacggctcgttcgtcacgggtctgcccgatccggtccgacgctcggtgcggtgcacctctgcggttgcccaacggagcgacgggccgacctcttcggccacgacctgaaccttggatcggcgctctccctctggcgtttcccagctgcgctgttcgaggcggcccacgatgatggcgcgagaacccttctcgaggctcgtcgagacgttgtcggcgaggtcgccccagcagatcacctcgaagaacgaggtggactcttcccactcctgggtctgctgattgaggcggcgtcggttcaccgcaatggagaagagcgcctgggcccgaccctgggcggtgaagcgcagttctggctccttcgtgaggttgccgacgagtgtgacggagttacctgctgacatggtggcctttcgctcggttcacccggcctaggcgcggcctggcgcgccgaggagggggatcttgccgttcgcggcgagcgcgtcagggagccgaatggtcttgtgacgcaggacaccgtcggcgatcgagagcacacgatcgagttcatcgatcgtcgctggttcggcgtgcagccgaaggaagctgtaggcaccatcggtgcggtgtgcgatcgggtaggcgagcatgcgccgaccccagtgcgcttcttgggtgatggctccaccgccctgattgacgatggaacgaattcggtcgaagagcgcggtgcgcgcttcctcgtcgagcgctggtgacgtgatcagcgcgagttcatactcccgcatgtgggttcctcctgtggacctgggatgccagggccccatgatggggcagggtggcgccgagcgccacagcgagcatagcgcacctaggagtgcgcccgcgcctgaccgatcggcggttcgtcgtgtcgatggaggggaagttgcgcctcgagctcgtcagggatcagtcgactgagggaatggaagaggaggaacgagaagccgatctggaagatcacctcaccctggaacagaaccatgatcccgtcgttcggcagcgagagcagcgccatgacaccaccgacgatctgcatgacgatcatcgtcgcgttgaaccaggagcgcgcgtagcgccaccagatccaccccgacatgagcagttgctcgacgaagaggatggagccgagggtctggtgggtccagtcgaagagggtgccccaggtgtagggggtgaacgcgatgccgacgatcagcaccgccatcatccggagcgcacggcgcagcacgccgagcccgccggtcgtggggaggtcacgtccagccctccacgagaggacggcacagagcacgaagccgatcgcgagcgggatgaagctgtcgaggtgggtcaggtagtagctgatgccgtagccatcgatcgccgaactcgggtaccagatcgcgacgagcagcagggcgccgaagagggcgaggtcggcagcgaggagccggtcgagtgtcttcgtccgaagcatcgctcgcctcccttcgcggtcaggacttcatcgtcgctgtgccatctcccaataacgttgcattatacaaccgtaatcccgccccgcgaagccacagctggtgttcggtcgctgaactgccagcatggctcatcgatggcgtcctagactcctcgcggaggtggtcgtggtgggacagcggtgggccgccctcggtacgtcgggccggatcgtcacggtcgtctccgtgatcgtgctgatcgctctgttcctaccgtggtacggcgtgagcatcggatcgctgagtgtgtccgtcgatgggttgcactcctacggcctgctgaccgccctcggtgtggtcgtcgtcgccgtcggtgtcggcgcgaacgcgccatgggtgcgtggtgcgcgtcttgccggggtcgtgctcgaggcggtcggcgcagtcgcgttcctcgccgcctaccatgcggcagggtcgacgagcgcgctgtcggtgtcgttcggacccgagatcggggtgtatctcgcgctgctcgcgagcctggttggcgtggtcgcggcgttgaacgaacgccggcgtgccgtctgatgcgtcgcctcgcgtggatgatggttgctggcgccacgctcgcggcgtgtggtactgcgaccgcccaggtgaccggtccggtcgctcgtgcggctcgcgcgctcgcatcggtgccgttgcacttctgtttcgtcatcgacgcgaccgcgcaggacgcgcaggagcgcatctcgggttgtggtgacgagtccgccggtgcccgtcggttggcgctgacgcagaacctcctcgagcaggtcggaagccaacgccagcagagctcggagggtgtgatcgagattggctcgaaggagtgggtgagctcgagcaaggtctggcaactcgtgacgccgaccacgaacgtgatcgagccgctcgccgtcgcggacctcgtcgacgcagcgcccggcttcgtcgtcggccgtggcagcgtcgtcgacggtgtgcaggcgctcgcctactcgacggtgctcgagggatcgtcgctcagtcggacgcttgcgcgccttccggcggcgctcgcggagcagtatcgcggtgagaacctccgcagtgacgacctcaccgtggagctcagcccgcaggggcggttgctcgaggtcgaccagcaccagtcgctcgtcgtgtcgggtcaggcggtgaccgcggtctcggttctggtgctgtcgcgtttcggccagtccgtgacggtcacgcccccgtctccggtcgccggctgagtcggtggccggccagcacggcagcaacggtggagagcagcaccacggcgaggagcgcttcgccgcccgcagcgccgatcacactccgcagcgccgtcgcgatcgcgatcgtgacctcgccgcgcgggagcatcccgacggcgatccagcggtcggggcgtgcgatgagcaggtagaggccaaggcgtgagatggcgagtgcgaccaggaggccgacgacgacggcgacgttcatccgccagagcggaccgagcgagccgagcacgaaccctgccgtcgcaaagaacatgaggccgagcgtccggcgcgaccacgtgaccacggcggctcgaggaacgaggtcgtggaggagcgcaccggcgagcgcaccggcgagcgcgggtgacgtcccgaacgcacaggtcgccgtcacgacgagcgctccgaggagtcgtggtgctcgcgcacccgtttgtcggaggaccagtgcgatgacgacggcgacgacggtcgcgaccacgctggtgggacgggcgccggtcgggagcacgaaaggcgcagcggcgagcagtgccaagctgacgaggtcgtcgccgatggctgcctgcaggatcgacgtccgggagcctcgtggaacgtgggcgagcgggaggacggtggccgccaacgccccgctcgtcgggatggctgcaagcgcgatggcaagggctcgaacggcacccacgccacttacgaggacggcaccgaaggcgccgaggccaaggaggctcgcgccgatcccggcgatggcgaggccgcggcccgcgatcgggtggctgccagagccttggagctcctcaccgatcccgaagagcacgacgtagacgccgagcgactctgcggtcgtcgcgatgtgggtagcgacggccggatgggggagcagagcgacgagtgtcccgacgacgagcatcacgagtgcggttgggatgcggctcgaggagtgccgcagggatccgacgatgctcgcagcgagcaggaccccgagactgagcgccgtcatcgccgacctccaccgtcgaggtgctggcacgcgagattcagagcctagcctggaggggtatgcgacgcagacctcgacgcctgagcgcgcttgtcgtggtggcagcgccgttggtgctggcgagctgtcacttttccaacggcgactacggaccggcgggtgccggtgggggcacgacgtcgtcggcgagctccggtccgatcggcgcgaacacgaccgcgccggacgcaaagctgctaggtggctcagccgccccgaagacagcgtcgacctacgacggtgctggctttccgattccgacgtatccgccggttccgtgcccgagggcaacctgcctcaacgggtcgcctctcgagccggtggagatctcgtggcgcaactcgccgtatgggccgatcctcacgacggcgagcggggagaccctctacctgcgccttggcgacggctttcgggagtcgggctgccatggcatctgcctccgagcgttcccgccgttgctgacgaacggcgccccgcaggcggcccctggtttgctcgcggcggatgtgggcgacttgaccgcgtcgaacgggaaggagcaggcgtcctacggcggtcacccgctctacacctaccgtggcgatacgaaaccgggtcagtacggtgcagagggcaagggcggcatttggtacgtggtctcgatcacgggcctaccggtcaaggcgccggtgcattctggcacctcatcgagctcggccactacctcgacctcgaacggctgatcccgccctggggcgccctcagtcgactggggtcgacggcgtgcggagagcgccgaggagcacctggctgatgtcggcgacccgcacatgctcgggtgcgtcaccggtcgcctgacgagccttcagcccatcgtcgagcatgatcatgcagaacgggcacgccaccccgacgacgtcgaccccggtggcgagcgcctgtgtgacgcgggcgtcgttgacccgctgtcccttcgcctcctccatccacatgcgcgccccgccggcaccgcagcagaagctgcgcgaccgattccgctccatttcgagtggatccgcaccgagtgcggcgccgacgacggctcgcggtgcgtcgtagacgccgttgtgacggccgagatagcacgaatcgtggaaggtcgctgaggcgatgctccctgcctcgaccgggagacgaccgtcgcggacgagctccgcgagcagctccgagtggtggcggacctcccagttgccaccgagggctgggtactcgttccgaatggtgttgaagcaatgcgggcacgaggtcacgatgctccgcgccccggcctcggtgagggtgtcgatgacctggcgagcttgcatctggtagaggtactcgttgcccatgcgtcgtgctggatccccggtgcaggtttcccgcggaccgagcacgccgaagcggactccggctttggcgagcagcgtcgccgtggctcgggtcaccgcctgggcgcgttcgtcgagcgccccggcgcacccgacccagaggagtacctcgacatcagctgggatctggccgtcgaagacgggtacctcgacgtcgagccccttcaaccagtcgagccgatgcgaagcgccgagaccccacgggtcgccgcggttttcgaggttgcgcagcatgccaccggcctcagtggggaaggacgactccatcaggacctggtagcgccgcagatcgacgatggtgtcgacatgttcgatgtcgacaggacaggcggcgacacacgcgccgcaggtcgtgcaggcccagagcacctccggatcgacgacatcgggcacaagggacgtctcttgggcttcagggttcgctccgtgggcgagcaccgcctctcgcaggctcatgatgaggagcttcggtgagaggggcttgcccgttccccatgcgggacagagctcctggcagcggccgcactcggtgcaggcgagtgtgtcgagccggtgcttccagtcgagctgaccgatggtgccgacgccgagcacggtcgcttcatcgaacgcttcggggtcgaggtcgggtgtcgttgcgagcgctcccagggctcgcgggcgccgcgcgaaggcgacgttgatcggtgccgtcgcgatgtggaggtgcttggagtgcacgatgaagacgaggaacgcgaagatcaccgcgacgttcgcaacgaggaagatcgattcgagttcgtagttcgtatgggcacccatgtgccggaatggcagcgccacgatctctgacagccaggcaccggaacggtacgggaagtcgccgtcgttcacctgggttgctcgataggcgacgagggtcacgatgacggcggcgatccacccgagcgtgagccacgccacaccggtgtgcgaaccgtagaagcgcgatgctcgttcgcggcgctggggtgcctcccgaagccgaatgacggcgaagacgacgagcgaaacgagcacgaggaacgccatggtgtcctcgagggcgccaagccagggctcgtggccgatgatcgggaaggcaaagtggcggtcgaacagcgccccaaccgcctccaccaccgtgacgagcaggatcgtaaagccccagaacgtgaagaagtgggcgaggcccgggacccgtttggtgaggagccgacgctgaccgagcacctcgacgacctcggcgcgggcccgtcgcgcgaggctcgctcgacgcccgggggaggcgggcccacggcggacggcgcgtatgagcaccacggcccgtcggatcgtcagggcgagcgcgacgacgatgatcgcaaggccgatcgcaaggcgcatctgagcctccttgggcgtcaggaacgaatggatgttaccactcagtagcttcgtggtggcggcggtcgcccttgatgtcgtcgtgatcgaggtggtaacgagacggcgtcgggccgcgttgaccctggtacttcgaggccagtgcggcactaccgtaggggtgctcggcagggctcgtcatctgcaagaacgagatctgcccgacccgcatgccgggatagagcgtgatcggaagctgagcaacgttcgagagttccagggtgacgtggccttcgaagccgggatcgatgaagccagcggtcgagtggatcagaagaccgaggcgtccgagggacgacttgccctcgagtcgtgcgacgagatcctcgccgacgcgcacgtgctcgatcgtcgagccgagcacgaactcgccgggatggagcatgaacgctcgcccgaaggggacctcgacgagctcggtcaagtcgtcgggaatggcagcaaggtcgaggtggccggctgagtagttgcggaacacccgaaagagtgcatcgagccgcaggtcgatcgatgacggctggatggcaccgggcgagagcggatcgaccgagatccgaccagccgcgagggcgtcgcggagcgagcggtcagagaggatcattggcgctacactatcgcgacgcagctcctgtcgcggaggcagggtgcccgcgggcgtagttcagcggcagaacatcagcttcccaagctgagaacgcgggttcgattcccgtcgcccgctccacgcgtagcaccagctcaggggcatcctcgatagagtgtcgactccgccgagaagccgagcagccctgctcagaccacaaatagaccacatctgcggctgggagcacaccgcgaggtgtgcttgcgcgacggggtgcgcctcgtggcggcgtcgtcggcgctacgaaggagagcgcttccacactgcctggcccgaggttcccccaagacgtcggtcgcttcggtctcgtccgatgggcttgcgtgggcagatgcgaggtccgacagagccgcagcgattgccttatcgcgttccgcggtggcgtgctgatagatcagcgcggctcgtggtgacgagtgtccgatgcgtgccatgaggtcgcgcgtgctcgcacctgtcgccgccgcccacgtattactagagtgacgcaggtcatggaggtgcaggtcagctctcccgatactgcgccgtgcgcgatcccaggtgctctggaggacgtgcacgcgaagcgggccgcccatagcgccagtgaacagcagggcatcgggttctgccccgacatagcggtcgaggtgttcggcgaggccccggatcgcgtgaggaggtatcgcgaccgtcctcagcccggcttgcgacttcgggggccggtgatcacggtgccatcgcgaagctgatggctggtgcgttgaatgcggagcggtccgtgcggcaggtccacgtcggagcggcggagggcgagaagttccgatcgtcgcaggccgctccaagcagccagcacgacgagcatcgcgagcctctcgggcatggctgcggtgagtgcgtccacctcccggatgctggcgatcggacgctccgtgggctgctcgacgcctgcgccctcgacgcggcagggatttcgcgtgatccgctcgtcggccaccgccgtgttgagaattgcgcgcagcaaccggtaggccttcgccgctgtggatggatgctgcccagccagctcggcatgccacgtacggactcccaacggggtgatcttgctcaagtcggttcgcccgaaggctggcaggatgtatcggtccaagagatagcggtacagttcgacggttctcggccgtagatctggacggtgtgcgagccacagctcggcgtaggcacggaatgcgagctgacctagccgcgggtcgacccactctgcccgttgcatgtccgctcccacccgctccaggaagcgacgtgcttcgatcttcgtgggaactgtgcgtccacgttgacgcccgtccggatctcggtagcgggtttcccagcgtccggatggcttgcgctggatgcttgacaccgatcgctcctactcgtgcgtcctcagttgggagatgctgctggcagactgatcgcaaccagtgtcttgtcgtcatggcgcttggcccgagggaggagcgagccgttggggtctcgctcgctctcccagcgatagcaacggtctcgcgcaaggcagccaaccatgtcttcgcccatggcagcggtcgtctcgtgtacggagacgtgcgggggatcgagcaagcgaccaaggggcgccgctcagccggtcgtcatcaacgccgggagccttcgcagtggtcgagaggacgccacgaacggtacctcgacgacaagaccggcctgaaaggagagcacgtagacgaagctgcttcaacgaagacatgcccagcgtgtggagcacgcaaccgaccgagcggtcgggactaccggtgtgcgaacgctgactgtgggtttgcctaccaccgagacgccgtaggagcgatcaacatcctgcagaaagcgatccacgggacctatgtcccaattggaccggatgtcacgatccatgtcacgtatctccgggctgtcgagcgttggtcaccacgccagagcgaggcacaccgcaaggtgcagtaccgaagggcgagagccctgagtagcgcccggaaccgggcttcgtcaggagcagtcccgacgtgcgagcaaaggcaagcccaatcatccaccagcttctcggggccagaccagttagtcgcggtggcatgaggacggcgatgtcgagcaaccccaaccgtatggacgggctagaagccccgtccgtaagggcgggaagggtccccgacggcgcgcctgtgtggctcaagagggacgtggctgctcgagagaatgaggtaaaaggtgtccgaaaagctcttcgaggaggaagcgggttcttgcaggcacgggccgattgggatagacggcttcgagcagcgcaagtccgtccgctgccgtcctcatgccgcaaagaccatagagcagtttgatgtcgtcgacgtcctggtccgctcgcgatgcgaggagtttcatcgccaagagctgacgtggggaggcaacagaaacggtcagacccggtcggcggatgacgacagtcgatgcaggatcaggaccaggaaagaacgccctcgctccgtcgttgagccagtcctccggtagacccatctcgatggctaccgttgatgcggcctcacgaacggttgccttcggctcaaagacggcatccacatcccgcgtgattcgccgagcctcgtacgcgagcgcaagggcgttcccaccgacgacgtagatctcggctacgaccccacggcgctcgagctcgtcagcgagacggttgaacgcttcgagaatgagtgtcgcgttgaagcgtggcctcggttcagacacgatcgaacgcgccttcgttgacgaacacgccgtggcgtttgagctcgaccgggctgtctcgcagggccatcgcctcatagcccggcaagccagccacgaaccaccacggctcgacgtagcgtgtcgcttcggtcgtccacgacggcgcagcaatgccagcctcgttgcagaggaactcaacgatacctgcaagcgccgcgtcgaatcgtgtgtcgccgcacagcggtggcggatctgcgaccagccacgccttcccgagacgggacgatcctcggacgtcgtcgacgaagtcgagcacctctcgccacgccgaacgcacgccctcggtgtggagaagttcggtgatggtagtcgcgacatccgcgactggctttgcacctcggcgcacctgcggacgcaggaccaaatccacatcgaagccagcgacggcaacgatgcgttgcagcgtgctcaacctcggctcgatcctgccgcgttcctagttggcgacagtcggttgcgaggtgcccgcgagcagtgctagctcctcctgtgtgagctgtgcttgggcgcgcaggtcgcgcagcaacacgctgatgcgctgatagctgcgcgacgcgggcatatcagaaagcgtatcgtgcccgatgcccggcactgttgagtctgagtggggaggagcgcctcgacaaggagatccgccgacgtacgaacgtggtgggcatctttcctgaccgagctgccatcatccgcctcgttggctcggtgctcatcggcgagaccgaggagtggatggaacagcgtcgctccatgagcgctgaagcccttgccaaggtgacccgggtcactgtggccgagaccgaggaccccgccacagaacaagcacaacgcagcctgccagagccgatgggggcgtcggctcgagggaggatccgcggtggccaatacaccactcgtttggacgcgacctggcgagtacaggaacaggttggtgggaaggaccggcgtcgtcaggtgcgcacgcacttcgtgcccgaggaaggcgaaggatcggtgccggttgatcgcgttccagaccgatggcttcgtcacaccgatggcttcgtcacaccgatgacttcgacgtccgatcactcgggacgccctcgttgagcgtggcgacgaagttttcaggaccagacgtcggcatggtcttcaggtcagcggtgagctcggcggcggtcagctgcgggtagagcggctcgagccgactgaggtcgatggtgcccgggtgatcgacgcagaccagtccgtctgggcactgcatcgacatcgccggcacggagaatccgagcggcaccgtgatgtagagcgggtcgaaggaccgtgccagcggcgcctcatagggtgcaccgacctcgcagcccaatgatgcctctgagctcacgtgcaggtcgcagtagaggcctcgggtgtgcatgaacggtgcgaggtgaccgtcgcagagggcgtcggtcacgccttactcgttgacgccttggccggcccgcacggcgttgctcgggggcggcgtggacgccgccgccgttgcgatgcctgcaccggtcgcaagggcagcagcgaaggcgactgctccgttccgcattcgtcgtcgtgcgactcgtcccatctgtcctcctcttccctccgtcggggtctcgtgggatccggattcgaggcggtccttggatggagccagaggcgccgttgaggcggaagggaccgaccttggagcgtgcggtgaaccgctgggcgtaggtgcggcgcgggtgagtgctgaatactgctacagtacgtcacgtaatgatatgcggagagcatggaatcgagagggtcgacccctctgcaaccacggctcggcctcgaccgggacggcctcgggatcggcgtgtcgacgcctccgtcatgggcgcaaccctggcccttctcgacgaggtgggctacagcgcactcagtctcgagatggtcgctcgtcgtgctcgtgttggcaagccgagcatctaccgtcgctggccgggcaaggcttcgctcgtcgtggacacgatcgtcacgatcgcgggcaccgatccggcaccggacaccggttcgctccgcgacgacctcagggcggtcgccctggctatggctgcgctgtatcggacgccgctcgctcgcacggtcgtgctaccccttctcggggatctcgccgacgatcctgatcttggcgagcgcttcaggcggcgctacgtcgcgccgaggcggggctcggtccaccgggcgctcgagcgtgcgcaggagcgcggcgagatcccgcgggtggacgaccccgagctcatctgcgatctgatcgcagggccgttgttccaccgtgcatttcttgttgccggagagatcgacgaccgcttcgccctggcaacggtcgacgcggtgctgatcgtgctggagtcggggcaagccggcgaccgcaactcgggaacaggaaaaggagcctcccagtgagcgcagatgcccagagggcgttagaggcaaccagagcgcccggtacacgtccgccgctgtggcttcgaacgtcggtaccggtcggggttgtgtcccagtgcgccgccgcagcgctcggcacggggctcatcgcggttgcggccgactcgtaccggctgggggttgacctccgaggggcagcgctgatcgttgggttcatactcatctatctcaacacccatgcggtggctcactggttcgtcggccggatcgtcgggatcaggtttcgaggcttcggactgcgaggaacggatcacccggagaactatccgccgggccttcgccacctcatgggggtactgccgatgtgggtggcgatgaccgagcccgagagtcggcgccgcgcgggtccccgagcccgcgcggcaatgtacgcagccggggagacgtccaccacggtgtgctcggtggcagcggctgcggctgcgttcctcgcgcacgcaccatgggcgcgcggcctgctcgtcttcgcggtcctgtggaaccttggtgcctcgattgtggtcagcatgatcgacaagggggactacgcgaaggcgcgtcgtgccctgcgggcgcggtagcacgtgcgccccactcgggccgtacttcttgcgatcgcgttctcgttcaagcggaggtttcgcggcggttcgtgtcccgcctggcgccttgtgagtgtgcggctggacgagctggacacggggctttgccgcctggcagcgtgctcgatgagggctcaggtcgccgctggcgagtaggagatgagacggccgtcggcggagctgcgtaggtgcagctcgaaggtgtgtgcccgcaggatgagtgagaaggcgtcgaagggctggcgcgaggccgcgtaggcaacgccctcgatgtcgatcacccactcgctgcgcgcgagcccgagcacgccacgctcctgcccctgtggtgggcgcgccaccagccactgctcctcgtgggtctccgcgagcccgaagtggtgctcgagggcggcagagagcggatccctcgatgggtcgaacaccgcgtccagggatggggcgaggaccgtgggcacgagcgcgcgctcaagcgcgatggggtgcgccccccgcagacagcgcagagacctatcgcaaggcgcaagtcctcgctggatgcaggggagtcccgggcgagcgtcatcgtcgtaacctgctcttcgtgcaggtcttccggtccgggatcgcctggatctggagtcgtagcggcgtaccgacgtcctcgggatggcctctgatcgcagtgctgtcatgcaactgcctgacctagtgacggcgaggccacgactcgcaatggcccaggcgctcgaagacccgcaatggtggtcgctcagaccgacgagctgcttggggtcgtggtctgcgttgggaagctcgccgctcgggcttccggaggtgtgcatggttgggttcgggtcgggtcgtgcggaggcaacagaccacgtcggttggcgtaactcgacattcgggtacgcgttacctgccgtctgtgcgcttcgccgaggtcgcgagggcgtggctcacgctgcccgacgcccgaagccaggtagcaggcgctcgacggacgaggtgacgagatgcaggcccgcaaggccaggaaggcgttcgatacgacgatcgatgcgtgcgaccacctcgggtcctcctggaccggtgaagagtgtgctgatgagcgcacgtacttcctcgttcgacttgacccccgaccctacgggtgcccaaaaccgcgcgagagccgatcgtacgatgcgctggtcgcggggacgctcgagcagggcgcgggcctgcatggtgtagaagtcgatgtggcgaccctcttgcttcatgatctcggtgagcacccccgtgagggcggggtgctccgctcgtgccacgagccgcgcgtaaccagcctgcgtcgtgagctcgttgaccatcccccatgccatgaggagcccgggcaacgccggagcgatgggcgagaagacggagaagccaacgagccggagccaatctcgagcgcgacgagcgcgtcggagcgttgcggccgcatcgggggcacctgccagcccatgcgcggtgaggatcttcccgatggcgtcaccgtgaaactgctcttcgtagacccagcacgcaagaaaccgcgtgatcgccgggtcggcgtggacgggtgtggcgaggagttcgcagaggtagcagaccgtatggctctcgatgtcacacatgtaacgaaggcatgcgaggctcgcgtcatccagcgggtgcgatcggaacgcatcgatgtcgatctgctcgacctcaatgcgtcgagagcgtgcgacgagggcatccaaggttgtcggcatacgtacctacttcggagcaacggtcggccgtggatggtacgaggactgtaggcaccggccttcttttgacccgagatcaccggtcagaactgacccatccgcgacacacgtttaggtgatgaccttggggtcggggtgctcggcctcacctccctgtaccatgccagcggcttcctgccgcagcacggatgggcttgtggagcgagaaagcgtagcggtgccgcgcaggacagcatgggctgacttgctcgccgcagacgggagagcacgtcaaggaagcgggggccgtaggctgcctcgagcgagggcacggctcgtcgcttccacgaccaggcctccctcgaatggccgcccggcctcggtggcaatcagggagggaaagccgcaccctccatcccaccaggcccacgccgtccagccgatgccgtgtccggcgaggaagtccacgatgtggcgttccaggttgagcgggtaggggttgctgcagccgaggacgccgaactcggtggcgatgactggccagtgtcgccacgtcgaaccgagctcgtgctgccagagcgcgggccctgtcggttgtgctgcttgtacgtagaggtgcagcccataggcgacgttggtaccggccaggtgccagcgcgtcaggcccgcaagcgtccccgcccaatcgatgccgtccgcgatcacgaggtttcgcgcacccgtggcccgtacggtgtcgaggagcgtctgttcgccgatcgcgtcatagcgtcgtccggtcgctgggcaggtgatcaaccctccgtcgcgccacgtcgaccacgtgatgtcgtggggttcgttgtagagctcgaagaccaccccgggccaggtgcggaagcgctccgcgagggtcctccagaatgcgatgctcggagggtctggcgcacacgaaggccctgctgcggccggggcagtcgaggtgtcagccccgatgacggtgtgcaggtccaagatcacgacgagaccgactcgtcgtgcggcacgaaccgcgcgctcgacgagttccccgtactccggatcgtagcgtggggatccgcgtaggaggaaggcctcgttgagcgcgatgcgaactgcgttggcgcgaaagcgcgtcaccatcgagcggagctcagagaggtccaggcctggggctccgtcggcgtgctgccctgcgggtgcccagtcgagactcggccagtcgacgccatggaggtagatcggcgttccgcgctcgtccacgaccaagggaccccgactcacgagctggccggtgacggcacccggcggcgaggggctgaaggtgggccgcctgtgggaatgcagcacgacaacgaggagggttgcgatgccgagggcgaccaacaccacgagcgccgccacaccgcggcgtctgcggacgcccgtcatggtcggtagatgtcgatgcgggagagtccggagccgaactgcgcgacgaggtggtcttcatgctgaacagcgctaatgaacggtaactgtgtctgcaccgcgcgcatctgaggagtcacgacaatgaggtgcatcgccttccagccctgagggttgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcaggtagcgacgttcgacctccgggtccgtcgtgatcttccaataccacaccacggcctggtaggggtgccaacccatgtcgacgacgtcgacccacatcgtatcggcgacgaggatgggggcggaacggtcgccatgggcgcgtagccaggcctctgcggcaagctgggcctggtctcgaggggcgagcaacgtctccgcgtcccgggcggaccaggcgaaacctaacagcagcgtgagtgtggtgacgagcacaccaagggcggttcgagccaggcgtcgccaggagacactctggctgaggagggagtcgaagagcccgccaccgaccagtgcaaccgctgggaacgcctcgactgggtaggtcgaggggagatacccaggacggaaggccatggcagtgtagacgagcgcagcgatcccgaaggggcgcgttcgtcgagcgatgacgccgatgcacgcggccggcaccaggaggacgagaaccgggtcgaggtgaagccacccctggagcaggccccaggcggccgtgccgtggcggaggatgaagccgctgcccgcacgctcgaagacttgccacgctgcgctcccgagcaaactcacgtgaccgggtccggggaggagtgctcccttgagcgtggcgtagagcaggtacaggctcccgatactcccggtgacgaggagaaaggtccacattgcgaccgagcgccgttcatcgcggtagcgccgagcgaggagccagagcacggtgggagtccagaggagggccgtctccacggacaggatcgctgcgccgaacgcgatgccagcgatcacgacggcgtgcaagcggcgccttggatccgagagcgaccagatcgcgacgagaaccagagccatcgcgacgttgtcgagttcgacgaggcgctcgagcgtgatggcaagcggggacaggccccagaggatgacggctatggcggcagcaccagggtgccagcggagcctcttcgccgctccgaccagcgcgccgagcgcgacgagcgaccagatccacatcgcgaagcggagctgggcgacggcgtcgaggccctggggcaggacatgggcaaggagccaccacatgccggcaaggaggatccacgcgagcggtggatgatcgtaccagtacgtgtaaggggcaagccgcccgaggtgcagcagagcccacgcctccgcggcataggtaccctcgtcgagcatcggggtcgggttgtgtgcggcgcccgcgacgtgaacgagagcgacgatggcagcggttccccaggcgagcgtgttgcccgccaccgaccaggtgccccgagccgcggtctgtgtcgaatccggggcttccggaacctcatgcgttcggacgagagtctcaaccacggctacgccacctgctgttcgctcaggacctcgtcaggagttgacaagcgacggtgtgcgccgacatgctccgtctttgcccaaccgcgctcaccgcggagctcgcgcaccagcgctacgagcagggcggtcacgagcacgagctggtaggggatgagaccgaggacgagggagagcgcatctcggatgcgtggccgctcaccgcgtaggcgacgcaagcgagctgcggcgatgacctcgaagctgagggcgccgagctccgcgaagagagataggaaggcgaagaggacgaggtcgacggggagtcgacgtgtcaagccccaggcgagcattgcgaccgggatcagcacgcccgtgagggcttgctggaacggtgccgccaatgtgaagagcgcaagtgcccttctccgccaggggagtttgcgccaagagcccttgcggagcacctggatgaagccctggtcccatcgggtgcgctggcgaacgaaagcgcgcaggctaaggggtgtctcctcctgcgtggcgagtgcctcctcaaagcggactgcgatctgagcgccgcaggtggcgagtcgaattcccatgtcggcatcctcggtgagcgcgttggggtcccagaggccgacctcgtgcagggtatgggagcgaaagacgcacgtgttcccaccgagcggtacgacgccgtggcgggcttgccacggaaggcggctcgagtaccacaggtagtactcgaccgcggatcgggttgcgaaccacgagctggacaggttgacgaggaggacgcctccctgaagcacgtcgagaccgggacgcatggcgaactcggcggctgcaagcgcaaagaagccttctgcgacgtcatcctccgcgtcgacaatggcgatgagctcggcgctccccgccgcctccatcccagtgatgagggctgcaggtttcgatttaggccagtggtggtcgacgacgacctcgatgcgatcggggtgcgccgaggcagcacgttccgcgaccgcatgggtggcctgatcatcgtggccgacgatggcgatgatccgcagcgcgtcgtacggttgtcgcgcgaggcgctcgagggtcgccccgaggaccgtctcctcatggcgggctggtatgagcacagccatcgtcggcagggtcgtcaaactgtcggcgctgatttggaaggatagctgacgtcgaagctgtgggtcttcccacccgaatgctgcaagtgcaacagcggagagcgaggctgttagcacgattacagcgccagtcaggtagagccaatccccgatcgtcattgagaactcctcgatccccaggtcgtccgctgacgtagtgtagagccagctcagaggggatggaactccaggcagatctcgcaacgatgtggcaatgaaagtcgggcactggtgcatgggatgcgcttgtggcctctgcacgtgatccatgaacaactcgaaacagattggtgaacagtcgcaatgattgtcatcaaatcagtcggatcggcgcggcatatggccgtgaaatggtcgctcagagtggtgagttggctgcggaaggtcatgcttccagatgcgcaccgccgcagcgacggcggtgtcgaggttgaacgcatggtgatcccgtgggcagatgcgacgagtgaatccgcatcgatcgacggtccttgcgacctacgagccgtgatgccgttggtatcggcgatccttcgtcgctcgttccgatccgtctgcaccgccgaagtggtcgaaacgccccaactacggatgagaggcgtagcggagttggtgatgaggcatgtggggtcagtccaagtgacgtggggtgaggtctcacctgccacgtggcgtcatcggttcacggagagcattccctgggtcgcggcatcgacagcgctctccgatcggcgacgacccagcgaaggccctgtccgtctgcgcgtcgaggtggtgaggagtgtcacgggttggtcaagggcgaggcatcagctgcacgaacgtggcggcggcgaggatactcctgctaacgcctggctaacgctcgtccaggtgagccgctggcgagcgaggtaggacttgagtcccgaggaccgatcgagggaaggggggctcatgcgcaggtgggcgggtgtgccggtcgtgaagaagctggcaagtatcggagcaggactcgggctggttggcgcaggtctgtcggtgccgttgacccatgcggcgctcgcgggttcgaactcgtcgagtgagacgttctactacaccgggagtcaacagacctttactgtgccgatgggggtcacacagcttgactacaccgtggctggtggggcaggaggagcaggttacgcagcgctcgcaggcgagttaggtggctcgggtggcgacggttcggtcgtcaccggcacgctgacggtgacgcccggagagcagctgatcatcgaagtggggtcttctggtgcgaacgcgagttccaatcagcagagttgtggtggtcccttcagcctctatgtcggaggtgccggcggatcgaacccggattcgagcttcagcggtggctcgggcggcgacggcaattgcgacctcttcaattctggcggtggtggcggcggtggtggagcggcgagcgccatcctcgacagtagtaacgctgcgctcgtcgtcgcagcgggcggcggtggtggtggcggcgctggtgcggccgcgggttacgacggcggcgcgggtggcgccaatgcctctggtggccccggagggggcgacggagcaggtagtgggggccaaatcggtgctgccggcagcagtgctggtgggaccggtggatacgacgacgtagcgggacatgagtccggtggtggcggcggcggtggtggtggcctcgacggcggtgacggcggcagcgcaggacagattggtggtggcggcggtggtggcggcggctccgggagttcgaccacgggtagcggcgtcaccgtgtctgcgaccaacaacggcaacggctacgtgacgctgagttggtccacctctccaccgccccccgcgctgagcgccacgctgagcgccaccagttcgccgagccctgcctatgcaggggacaccgtcagttttgcggttcacgtgtcggggagcgggtcgtcaagcccggtgactggggaagccttcattgaagccccgggcaagaccgatcagacggaattcatccccgttgccgaggtcccgatctccgacggggctggaaccgttcaagagtcggtggatcaggtggcggcggtactcgaggcggagggcgagagcgttccgtacgggacattgaccctgccggtctacttcatcggttcgggggcctggcagggggtcggcgcgacaggttccgtcggtgtcgacctgtccatcgaccccacgaccacgagcctctcgctacagccgtcctcgccggtcgtcggccagccagtgacgctcacggcgacggtgacgaaccagtcccaggccgcacccggccttccgccgaccgggagcgtgaccttctcggcgacggacagcgccggcacgacgacgaaactcggtacggcgtcggtcgacggttcgggccaggccacgctctcgggcctggagctgccagcgggtgcggacaccatcaccgcgagttactcgggggatcccacccacgatgcctcctcgaccacgagctcgatcgatgtctcgaacgcgctggcgctgttcgcctcgagcaccccgtaccctgcgtacttcggcaatgacgtggccgtcaccgccaccgtggccgggggcgggtcgctcggtgcagcgaccggcacggcgtgcatcgagggtccgtccggaggagtgacgcttggctgcttcgtcgtcgaccagggttccgggagcttcacgatcccggtcgaggaagcggcgacgctgctgggtgcgagccgggcctacggtccccgggcgttgcccgttacgttcacgggttcgggcgcctggcaaggtgtcgacctcaccggctctgtgaacgtcgacctctcgctcgaccccacgaccacgaacctctcggtgcagccgtcctcgccggtcgcccgccagccagagacgctcgtggcgacggtgacgaaccagtcccaggccgcacccggccttccgccgaccgggagcgtgaccttctcggcgacggacagcgccggcacgacgacgagacttggcacgtccacgctctcgagctcgggccaggcgatcctcaccggcatcagccttccggctggcgtgcacgtcgtcaccgcgagctactcgggggatcccacccacgatgcctcctcggcgtcgagcacgatcgtggtgacgacaccggtacggctcgacctcgcggcctcaccgacatcgtcgtccttcggttctgcggagacgctcaccgccaccgtgcatggccaggcgcgtgggtccgtcaccttcagtctgatccagggcaggaagaccaagcggctcggcacagcgccggtgacctcgggccatacggcgcagctcgtcacctcgaacctgcccgtcggcaccgacgagatcgtcgctacgtacacgccgtcgagcggctccgacgtcgcgcccgcctatgccgacaccacgttggtggtggtgcaggacgtgcccgcgatcacgatcctcggaccgacgagcgtggcagcggggtcgtccgcgtcgtacaccatcctcgtgacggcgaacgggagcccggtcgacggtgggacgctgctggtccagctgggcgacacatcatccaccgcgaccgtggacgccaacggactggcgaccgtgacactcaccttccccaggaccggcggcacgcaggtcctctctgccatgtacctggggtcaccgacggtggcaatggcgtcgaacaccctctcggtgacggtgacgtccccctccccatcgacgtcggcgcagagttccagcacgccgcccgctggctcgtcgtcgagctcgagtacgaccaccgcgtcgtccaccagcacgagcacgtctccgacgagcccgggaacgaccagctcgacctcgacgcaagcagtgcggccggtgacggcgagttcggcagtgacggtcccgaccgcctcgaccggagaacccttcgcgtccccgtggtggtgggctctctccgggttcggcgtcggaacagggtcgacgctggcagcggtccagatccgtcgccgccgcaacacgcgcgaggccgtgtaagcggcagcagggactcagccggtcgtctcgcggttcggccgtggtggctccagcatccgaccgagagctcagtctggttcgtacagccgaagcctctctatcaaggggttgagggaactcgagggcttcgtcgttgtggctgagcgcgtaacgtcgtgccggagccggcggtctcgcccatgtctcgagcaccggctcccgggtgacgagctcgtgagcggacctgtccggtgtcggagacgcgcactcaccgcggagtcatcgaacgagtcgatgcgcccgaacgtgagcacgtcccgtacgctcgcaccacgctcgccgctggggcggggacggagatcgtcagcccggcctgcgccttcgatgtcgcggcatcctcgagcgctcgcgggccgtgatcgccgagggtccccagtggatctccgagtccgtcgagcatcgggaagctcgtcgaccgagcagtgaccgatcgggccttctagcaggtcaccgacttgctacagtccgtcctgggggtgatgcagggcggcggagggtgcacaggtggcgacttgggtgttcgcagatcggaagcacgggacgcggaccgctgcgcacgacgcacggtgaatgggacagtgttccaccgatgcggcacgacgatgccagcgatccggaggtgaccgtgcgtcagcccatgggggcgtacgggcgcagcgcaacagggcgacggacgggtggtccgcgggtgaaggtgcgtgtcctcggacagccgcgcgtagagaccagtctcggatccatcgcggtcggaggtcagcgggccaagttcctcgtcgggctcgcagccgcaggaggcgtcctcagcgtcgaggaggccgcgacgcttctctggccttccgtacgtccaccgagctggcgcggcgcgctgcgcgtcctcgtccatgagcttcgcgacgcgttctcgcgagttggcgcaccacgggggctcgtgcagcgttccggccccatcttcgtgctcgatactggcgatggtgaggtcgacgtcgacctctggtttgcgagggacgccgcgcgggatggacgtgcggcctgggaggcgggcgacttcgtgacggcacgcgcgcgagctgaggatgtcgagtcgatcctcgccgagggtgtgctgcctgggctcgatgacgaggccgtccgtgacctgcgcggtggcgtcacggcggagcgcatacggaacctcgaggtgctcgcacgcagcgcggcagcactcggcgactgctcgagtgcccttgagactgtcgagggtgcgctcggcctcgaccccaccaaccagcccctgtgccaagtcgggctcatggccgcggagacattgggtgcagtggctcgcgggctcgcgctctacgcccgtctacgcgccgccctcgcatcgggcctcggcgtttctccgagccccgcactcgccgcaagctacgcgcgtctcattgctgcgcaaggtgggcaagcgcgaggcgccgacgagccccactccctgcccgaggccatgaggtcccgtcaccgtgtcgttggtcggacgaccgaactcgctcacctcggcgtgttgtggggcagggtcgagcgcggcgaggggctcgcgtccgtcgtggtcggtcccgcaggcatcggcaagacagccttgctcggcgagctcggtgcggtcgtcgtgagtcgaggaggcagggtgctctacgggcgcgagtcggatccgccttcgcatgagctcgcggcgatcgtcgaggcactgcgcgcctatcagactcgctgtgcgcgggtcggcgtgccttgcaacctcggaccgctcggagcggacctcgaaaccctgctcggaagcggctcggacaacgttcgtctcgcaccgcggagccgacgccttcgactctcgcaggcagttcgcggatggtgggcggcagtcggctctgagcgcccgacgctggtcgtcttggacgatctccactgggcctcggcgacgacgacagccatcctggccgatctcgccgtcgatggcccccctgagggtgttctcgtcgttggcgccgcacgctcgacgggatcggcgctgccaccgagcatcgggtcattggtctcgtggggcgctcggaccatcgaactcggaccactggcgctcgacgccgtcgccgacctcctcggctcgaccggacatgacgccgcacgagtcgctgcggaagtctggctcgcgagcgggggcaatcccgagagagtgtgggaactcgctgagctcgtcgtgaatcccggagcccgaggtcgcagcggtctcgcgcgcctcgacgtcgatcgcctctccccacccgcacgacggatcgtccgagctgcggccgtgctcggtcgcgcaacgcccgcgtccgtcgtgttcgacgttgccgacactgacgatgtcgccgcgctgcaggaggcgcaggctgcgggcgtcctcggcctctcgcaggggggttccgtcgtgctacgacacgacctcctccgtgaggacgtcctcgcgcaggcagggaccgatgagaaggtccgcttgcacgcccgagcggccgaggcgcttgccaagggaggtacgtcgtcgcacaccctcgtccaccacctcgctcgagcggcccccgtagtgtcgcccgagcgactcgccaaggcccgtctctcggcggcgcgcgaagccgccagcctcggcgcgtacgaggatgcactcagtgcactcgacgcttggcgggtggagcggtcggacggtggagccgatgacctggatgccctcgtgctgcgagtggagtgcttgagtgccctcggcgatccacggctccgagacgccgtggtcgagctcttggagcgtgccgtggttctgcgtcggatcgctgcggcagcgacggctgccgagatcgtcaccgcggcgctcatcccgaccctcgtgggtcgagaggatcccgccatcaccacgcggttgcaggccgctctcgagcgagcccgtcgaccggagcacatcgcctccttggcgtctgcgcttgccctgtcgcgggtctggacggcgtcggccagggatcggcgagcgctggcgaggcgtgcggtcgcggccctcgaccgtcgcggcggccagggtgccgacgccctcgcactggcgaccttgacgcgagcgcacctcggcagcctcgaggcagcccacccagcccatcgcctcgccagcgctcgccgcatcctcgcgcttgcgaggtcgactcatgacatcgagggcgttgctcgcggccatctactggcgcacgacgcgctggtggagctcggtcatctcgacgaggccgacctcgaactccaggctgcccggctgtgcgccgcagctctcgacgaccaggtgcgctgggaggtggagatccgtgaggcaggacgtcggctcatggcggggaggcttcgcgatgccgaggcagccgctgagcaggcgctggtcacggtccgggccgagattctccgcgaaggcgctgcggcggtctacggggcccagctgatgatggtgcgcgaggccgagggacggcttggcgagctcgcggacgccgtcgcagagtttcgtcgggtccagcacgagtggacggtgtgggacgctgccgaggcgagaatcgcggtcgcgctcggtgatcaaggccgtgcgcgcgagctcctcgcgcgcggtgtcgccgagctcgaggatcctgtgcgcaccgacatcacgtggctcgcgcgtgccgtgcagtacgcgtgggtcgctggcgacgtccgcgacgtcgagatggcgcagcgcttggtggcactccttgcgccctaccgagggacggtgcactggtcggtgtgcgtcagcctcggtccggtcgacctactcctcgcacggctgttgatgctggccgacccgcgacgtgcctcgacaccgctcgagcgtgcgcgtcggctcctcgccaacgatgggctcgcatactggcgcgcacggcttgccgacctggtgagctgagtcttggcgaggtgctgagcgctgtcggtcgtcctcggcgctggcggggcgttgtctcgtctctgggccttcgctctcctcgcgcggacgctgccccgtgactaccccttggcaggggcgtgtcgcgatgtcgccgagcgcggcgtgatcgtgtcgtccccggggccgaccggtgaccccttgtccttggcgcgaggcctgacgcgcacggtgccgttagtgcgccgttagcgccgacccgcggaactggatcggagacgttgggtgtgagtctcctgcgagcacggtccgggcggtcgcgtgcttgattggcgaagatggtcgcggtgctggaacgtgcgggactggggcagcatcgagggcgtcgattcgtcacgcgtcacccgaggtcgcgacggcggttcgctgtggcgagcctcggctttgtgctcgcggggcttggcaccgcaggcatcgtgtggccggtgacgtggctgcagcacgccgaggcgcgcgggacggtgtcgattcgacgcgtcgtgcggtctgagtgtgacgccgtaccagcgggagcgatcggcgtgttggccatcccttccgtaggcgtcgttgcgccggttgcccaaggactggcccaagcgaccctcgcgtgggcggtcggccatgatccctccacaccgttgccaggtgaactgggcgtctcggtgctggcagctcacgacgtgagctacttcgcgtcgaacgcaacgttgcggaggggggccgccgtgctctacgcacagggttgccggacctacgtctttaccgttgcagatcgcttggttctgcaccctggccaactcattccgccgccaggtccgcgtgggctcgccctcgacagttgttggccgagcgacgcactgttcctgacccctgatcggctcatcgtcacggcgcggttggtggcgatcacccggggcgatcgactcacgctggcgagcacaggcgtgacgccaagcctcccagccggtgtcccccagcccccgaacctcttcgcctcggggtggcttggcgggacgctcaccatcctgggcgcagcgtcagtaaggtggcgagacagtcgtgctcccatggcgtgggaggccgaggcattggccagcttgtcagccgcccgggtgggcctcgcgcaggacgcgcgctggacttccctcgtcgtcgcggccgggaccgtgcgcacggggctccttctggctccgtatacgtccgggacaccagtgagcgtacgtgaggtcgtcctaggggatcgcgttctctccgtcgccgtcacggttaccttgggcggcaacccgctgaccgtgaccgaggttccgagcgcgggcacgctccgcatcgtctcggtcgatcccgtctaaggatccggcccctcgctcggcctcggagacgacgccatcgagtgtcgatggaccaggtccggccacgtggcgggtgtcccgcgacgctacggatgggtcgtgatgtcggtggcgtctgcactgggacggatgggccgtagcgacaggtggccacccgtgcttcggcccagccacgtggtcggacccgcacgaagacgccccttgcgatgcttacgcaacggacgcggcctctcgcggaccgtcgccgctcgtggtccccggtcgtcgagatggcgcggttcgactctgtggaactgccgtggacgccggttccgtcgccgttggcggcgtcgagcggttctggcactcggaatgcgggcggtgcagagtgcaacagcggcctcgagaccggtcgcttcacgatcgtggtcttgaccagcagctggggggtccggcttccgaggacgaaggttgtgctatcggctccggggaggtaccgccgaggcggcgtgcgtccagacggcagaggcgcccgaccacggcttcgcgaaggcgcgcatcgagggacgccgggacggccctcgacgtgggtacccgagaggtggcaacggctggccggtcgtgcagcagccgctgcctccgtctcgttcagcgtgcggcttctcgtgcgggcgtgccttccagtgaggcggcgagggtccgcaccgccgtccgatagcccgactcgatgagcgtcgatgtctgagagaagtcgagggcatcgagggcgttggcggccgggcactccagcacgatcacctcggcacgttctcgtgcccacgcgagctcagtggcgagctgtgctcgcttggtgagcgtgatcgagcgcaccagggcctcgagagggcgctcgtggacagggagcggatcggcgagcgtgcccgtcaggagcacgacgatgcgcgtcgcaccgagatcggcggcccttgcgaccggggtgtcgtggaggacaccaccgtcgacccattcgcgtccatcgtgaacgagtggcggcaggacgccagggatcgcggcactgccgtagagcagggcgacggcgggaccttgacgctcccatcgtgcttcgccggtgcgcgggtcagccaagacgagttccatcggcaccgtggtatcggcgaggtcgacgaccggcacgtgggctgcgataaaggtcatgagcggttcggcggggaagacgctcgcccggcgcgtcgcgtaccggaggagtgtcacgagcttggtcgccgggaacaggcgcgcggctctcagcgactgccagatgctctcgaggcgctcgacactgcgcgacgtcgggtcggctgcaacgatcacgccgttcagggcgccgaccgatgcgccaacgacgagatcgggtctcacccctgcttcgaacaaggctcgtagcatgccgacgtggcatgcgccccttccaccgcctccggcaaagacgaacgccgtgagctcgtgctgctcgtctcgcatgcctgcaacgctagctcaggacgtcggcgtgtctttcgcagtctgtgggcccttggtccgctcgtcgtcgctgccgcagttcgcacacgaggacgcgacgtcgagctcgcggacgaggtccgcgaggagggcaagcagcatctcgcgacgatccggtccccagttctgcagcgcgcgctccagaactgcatggcgccgagcgcggagctcttcgaggacctgcttaccgctcggcgtgaggcgtaccttggcgacacgtgcgtcctcggcgtcagcgaccttctcgatgaggccacgatgcgcgagggccttgagctggcgtgagacggtggagatgtcgaggttgagttgggtggcgaggtcgctgactcggatctcgccgtggtgggcgatggcgacgagctgccagaaaccggctccgatggcgtaggtaaacgtggcatgctcgcccgagctcacgcgaagtcgacgcagtgactgccccagtcggaagagcagttcgtcgagcgtgcgcgaggcatcggagtcgggggatgacgccatcgggtccgagcatacccgtcgcctcgatcgacgctcgggctcggcgcctcatgcagtgttcgcatactttgagggtcgctaggatcgccacgtcttccctcaccagagaaggaggggtcgtgcaccgactcgatgatgaactccggtcgctccaagcgtcgatcgttcgctacgccatggaacgcattgctctccagccaccaccgctcgacgggccgaagagcgccgacgaactgcgcgcgctctacggcgcgaacgtcaccgaggacggtatcggcggcgaagaggccttgcgccgcttcgtcgagggctacgcgccggccaccctcagctcggatcaccctcggttcttggcgttcgtcccggtcgctccgaccaaggcagcggtgctcttcgacatgatcgtctcggcctcgagcatctccgggacctcgtggctcgagggcgctggcgcggtgtacctcgagaacgaggcgctgcgctggctcgccgacctcatcgggttccccgagacggctggtgggacgttcctgtcgggaggttcgctcgcgaacctttccggtcttcacgcagcgcgtcaggcggccaaggagcgcctcggcggtgtgcggcccgatcgctaccgcattcttgcctcgaccgaggcgcactcgtcgattcgcacggcagctgacgtcatggatctcgaggtcgtcgaggtcgaggtcaacgatccgggacggttgcgcggtgaggacctcgtacggacgtgggcaaagctgaccgatgccgagcgcaactcggtggtcgctgtcgtggcaacggccggcacgacgaacgcgggcctcgtcgatgcacttgacgaggtcgccgactttgccgaggtcaacgggctctggatgcacgtcgacgctgcctacggtggtgctgcgctcgcgtcccatcttcgcgagcgctttcgtggcatcgaacgtgcaggctccgtcgtgatcgacccgcacaagtggctgttcgctccgttcgatgctgcggccatcgtctaccgtgacccgaacgttgctcggcgggccctgacgcaagaggccgcctacctcgacgagatcaatcgtgcgcccgactggaacccgtcgagctacggctatcacctctcgcggcgagttcgaggtctgccattctggttctcgctcgcgacgcacggcacgcgccgttatcgcgaggccatcgaagcgtcgatcacgcttgcccacgagagcgcccacgagatcgagcgacgtccctacctcgagctcgcgatcgagcccgaactgagcgtcgtggtgtttcgacgcctgggatgggatgccgaagcgtacgagcgatggtcgcggcaggcgctggtcgacggggtgggcttcgtcctccccacggcctatcgaggggagaagctgttgcgcttctgcttcgtcaatccactgaccaccctcgacgacgtacgggccatcctcgacacgctcgcgatcgaccctcggccctggtgagagccgtgagctgtccgttgtgcggcgcggcggcgagtgcgctccgccgttcgaccctcgccgcggtcgtcgcggatcgctatccggtcgcagcgggccacctcttggtgctgccgctgcgtcactgtggccggctcgtcgatctcgacgacgaggagcgagcggatctctgggcgttggtgcacgacacgctcgatgctccaccgccggtcgttggtgaggcagatggctggaccgtcggtgtgaatgatggagcggcggcaggccaggtcatcgatcacgtccatgtccacctcattccgaggcgagctggcgacgtcagcgacccgcgcggtggcgtgcgctgggtccttggggcgaaggcgccgtggtgggacgacgtcggagtcgacgacgcctcgcgtcaccgttgacgtcggcgagctgccagggcgagctgtcagcgatatcagggaggggccgcggctcatgcggacccgagtcgccggctcgacgatcggccccgacaccagcagcggagcccccatccccgctgctggtgcgtgcgccgcgacccatcggcagcggcgcgtggccccccaaaggctgcctaggcgatgcccttgagcatcccgtgccagtagagcgcgggcagtccgtagcgcttgagcaaccacattgagtagtgctccttcgtcgtgtcgatcagcggcacggtcgggtgcggattgccggtgtagtcgaactcggcgagcagcatgcggttgcgagcggtcacgagcgggcacgacccgtaaccgtcgtagtgcgcttcgggtgtgcgccctgccatcactgcctttaggttcgcgaccacgacgggtgcctgcttgcgtacggcggcaccggtcttggcgttgggcgtgttgccggcgtcgccgagggcgaacacgttgggatagcgcacgtgctgcagcgtctccttgttgacctcgacgcagccgcctggcgtcccgtcggacagaggcgtcgccttcaaccagtcaggagcgctctgcggcggtacggcatggaggaagtcgtaggagatggtctccttggtgccctccttgttgtcggagatgacgacctcgcgcttggtgccgtcgatctccaccatctccgattggaaccgaacatcgatgccgtagcgcgcaacgaccttctcgagctccttcgcccacaccggcacgccgaacatcgtcggtccagggagcacgaggatgacgtggatcttgtcgagcacgccctcgatccgccagtagtccgccgcgaggtaggcaatcttctgaggcgcgccggcacacttgatcggtcccgagggcatggtgaagaccgccgtgcccgagcgggtccgctggatgaagtcccaggtgcgtggcgcgagatcgaacgtgtagttgctcgagaccccgtcgtggcctaccgcctcggtgagtccgggcactcgatcccaattgagctgaatacccgggcacacgaccaggtagtcgtagtggacgggaatgtcgctctcggtgctcacgacctggttctccggatcgatggtgaccacccggtcacggatccacttcacgccacgcggcatgaccgaggcctcggagcgcacggtctcactcgccttggcgagccctccccccacgacggtccacagtggctggtagtagtgattctccgatggctcgatgatcgcgacgtcggtctcgcctgctcgtcggaggcgtgccgccaccgtgatgcccgcggaacctccgccgatgatgaccaccttgtggtggagccccttcgcttcggccatgtcccctcctcgacctcatgaaggttgtgctgataccgacaagggtacaccactgagggaccttagttgaatttggttcgggactttcgtcccttgttcacgtcgattcaggtctgcggtcggctcggagcctggtgacgtagcgcgacgggcagtcgtccatgacgacgatgagaccgccctcgcgcgcgatggcggcagcctcgtccgagacgatcccgagctggagccacagtgctcgagcgccgacaccgacggcggcgcgagccaccgcggggcacgcctccgggcggcggaagacgtcgacgaggtcgatcgagtgctccgcggcagcagcctcgagcgtggggtaggcgggcaggtcgtgcaccatggtttcgcgagggttcaccggcagcacctcgtagccgaggtcgaggagctccgccatgacgtggtgggaagcccgccacgggttcgaggacgctccgaccatggcgatggtgtggaccgagcggaggacgtcgatgggctgctcggcgccgatcacgatcatcagtactctcccctcacgacgttgagcaggggaagtccggccatgtagcggcggacgttgcgctcgacgagcgccgacgcgcgcgtctcgaggccggcgacgtctcctccgacgtgcggggtgagcacgacgttcggtaggtgccacagcggatggaaaggcggcagcggttcggggtcggtgacgtcgagaccggcccggagccgaccgctcgcgagctcggcgaccaacgcttctgtgtcgacgactgggcctcgggcgacgttaacgacgaccgcgccgtcggggagcctggcaaggagtgctgcgtcgatgaggtgcctggttgcatcggtgaggggaaccacgacgacgatgccggcgagcgtgggaagaatcggggcaaattcgtcgaaggcgaggacgtcagggttgaaccggggtgtacgagccactcggacgatctcgacgccgaacggcgcgaggcgagcctcgatggcgcggccaatcgcgccgtagccgatgatggcgacgcgcgcacccgcgaggcttggcatgacacgacgctcccaccgcccctcgtgttgggccagggcgaactcggacaagccacgcgtcgcggcgaggaggagcgccaccgccaactctgcagtcgcgtcatcgtgcacgccgcgggcattgcagagcgtgacgccttcgccgatctgcccgacgacacgatccacgccagctgtcaggagttggaggacttcgaggtgacgcatacgcgggagcggctcgagggcggcgccgccggcagcgtaggccggcacgaagaaggtcgtcatggccaatcgatcatcgatcgggtcccctggatcccacgtcacgatcggtgcgtctgggatgcgtgtgatcagttcggtgagggctgtcgggaccacgatctgcatgaatcggagcctaggccctcacctccacagaaggtcagctgatgggcgtggctgaacggggacgtggcaactcgccacgtcgtgctgctggggacgtcgtcggtgcgtgcagcgtgagccggctgcccactcccgcttcgcctccgcgacgacgatccgcgtgtcgcccacacctggttcggcttgaccgctccgtcgcgtcgttctcagctctcggcgcccacgcacgctgctggccttctccctccaggttgacacctgcgatcgggggaatggatgggccagcattggaaggccagcattggaaggccagcattggaagaggacgacgcccttcgccactctgggcagactcgtggtcgatcgggaacggcccttgttcgtacccacggacgacgggccgcagttcgcgaagcggtacctctgacctgggagctggcggggatggcgtgtggtggttcgctgatgctggtctgtacggctctcaggatgtgactctcaggatgtgaactgagtccgcctcgcgctggcgatcatcgcccagatgaacctctcggtccctggtcatcacgcagcagcgatgagccgcggttcgcagcgccgagccgtcgagcagcgcggcctcgggcgtcttggtgcccgaggccgtccctgcgacgcggccgctcagtcgccgagctctctcgggatcgcggtctggaagctgcggaacagctgcgtgaggtccgcgtagccgaggcccgatcccggattgaacacggcgccttgtgagccggtgtagaagtcgttcgtgttggtgaactcaccggagatcgcaagctgggcgttgccgatctggccgctgtagtaggccgagccgtcgatggtgttcgaatcgagcggcgtgaacggcgacgacgtcgaggtcgcgaagcggtagatgttcggattccagaagccgagccgtacgcccccgagggcgctctcgtagacggcgtcggtcccgttgagctgaggcgcgatgaagctcgtgccaccgaagtccaccagctttgacccgtagacgctctggaactgtgggtcgtagaccgcatagccggtctgggggtcggcgttgaacgccaggtccggcgtgacgcggccaccgctcatgcccgtctgaagcgtcggggcagggttgaacgagaactgcgtcggctcgacgaggcctggtgcgacctgctgtggatcgatcggcgtcaagaactcataggccgagtagctccctgcccccaccatctgaccctgttggtagagcggacggccgaagagggtggagtagccaccgcctgatcccaccggcaagctcgtggctgcttgggcctcgttctggaagccgagtgcgatgtacatcggccacaggtagtcccagccccaggtcatctgctgcgggatggtcaccgactcggtgccgacttgggtcccgttcgccatgatcgggtaggtctgagtacccgggagcgtcgtgccgccagcggcggtgtcgtagggggagtcggaggggttgtcgataccgaggttggtggtaccgatatcgccttgagggtcataggcgccgttgtcgccgctcgcgatgaagttcgactgtccctgcgccgccatctcgaggaaggcctggttgaacgaggccgcataccccggtgactcctgcgctgcgtccaccgcagcttggatcgcggtctcggactcaccccagctcgacgagacggagccggcgacgttctggctggccgcctcgtagaaggcgtcgacgaagccgtagtcggtgttgggcgcctggtacacgacgatcttggccatcggcgcgatcgtgcccgactgctcgacgtcgagggtggtctcgtcggagccagcgttcagcgacaccggccctgcaccgccgtcgacgttgacgagcgcaagacgattcggcaacgtcacgacgtgcgcgatgttcctccagaagtacatcggcaccgaagggttcacgctcgccaaggtcacgatgccgatggtctgcccctgaccgaggtagcccgcttgctggagcggtgtgaggttgtagtcgctcgtgaaggcctgcggcagctgatcggtgggtgctgcggtttgcgacgacccagccgtgggtgcgacctggttgatgccgggcaccgcgagcgactcgtagggcgcgtagttcgacaacccgagcacggccagaatgttcgacgccaggttcaacggcatctgcggcgcgctgcgcgtcccgtagaccgtctgggtcgtcgcgggcgcactggctgcgggcctggtggtgacggtgaagttctcgagcaagatcccaagggccttgtcgtactgtgcggccgtgccctgcgaggtgacatcgaggccatcgctcatggcctgggagctgatgccgaactcacggaggaacccacgcagcgcgaggatgtactcttcggtctggccgtactcgagcgcgaactcatggggcgtcaggtacggaccacgccaaccagcagccacccgagaggcaagctgtccctggttgcgcatcttcaggatgaacgacacccgcatcatcgtcgacccagccgtggtgcccgtcggggtggcgtgcgagagcacatcggcaccgatgccctgcgacaccggcaccagcggatcagacgccgacgcgagcgactgcgcgcctggcatcgccagtgcagcgccgacgaggccgatggatcccaaggtaccgagcatctgcagacgacgactgatacgcctcatagcccaacccccctcatacctgagcgcagcccacacccatgcaggacctgcatcagcgcgacactagcacgcgaagtatgccgcatcgttgtcgagacggtccgtctttcggttggctcgactaccgagcgtgctggtccgtcgcggcggatgcgtcgtgggttcggtcgtgacgtgctcagtgcatcaggagacgcggctcggcgtcgacaccgagtgtgaggtgccagaaggagtcctgcgatccttccgccttgagttcttctgccgcgagtgcaaggcgcttcatcggggagcgcgccgtgtgatcgtgtgggagcagggttacgaggtagccgtcgcgacggaagtgtcgagccatccgcaacgcctcggcaatctgagtcgtcgggtcgaagatgagggtgaggcggcgtcgcggcgtggcgaggtggatgccgagctcttcgagcagggagagaatgcgctcgaacccaagcgagataccgcaggccggctcgtcgactccgaagcgtgcgaggagtccgtcgtagcgcccgccgccgccgatcgacgacgaccagtgagggtgaacgatctcgaacaccgacgaggagtagtagtccagccctcgaacgatgagcgggtcgatgacgacctccgtgtcccggaccgaggtccgcacgtgcgtcgcgatcgcgtggaggctctcgagcacgcttgcatcgacatcgagggtctcgaggacatcgaggggatgctcgttctcgacgatgtcaccgagcgttgcgaggacgtggtcggcgagctcctcgccgagcccagccccgaccatctcgttacgcacagcgatcggcggctccttgtcgagcttgtcgagcgcgacgagcacactgcgccaatgatctgccggcacctcgagacgctccaggacatgctcgacggcccgtcgatcgttcacgtgcagctcgaagccctcgaggccgagctggtgcaaggccgccgtggcggcgatcagcagctcgacctcggcgagccagctcgcctcgccgaggatgtctgcgtccgcctgcacgaactggcggagtcggccgcgctgcggacgctcggcccgaaaggcggggccgatctgcatcgcaagaaagggcttgggcagcttcgactggttcacggcgtagaagcgagcgagcggcaccgtgaggtcgaatcgcaggcccgcatcgacgaggtcgtcggggctcgaggcggacccgaggtcgagacgctcgccgcgcttgagcaccttgaacatcagcttcgcattctcgcccgccccggaggcagccagtgcttcgagggtttcgacgatcggggtctcgatctcgaggaagccgtgcgaccggtacgtcgagcggatcacagacgctgcggcagagcggacctcgtgctccccggggaggatgtcgcgcattcctcgaaacggacgcacctggagcattggactcctctctgactcgggcgccgatgtgctgtcatcaggcagtgtcatcctacgcctcgatcgggcccgaaccgtggcccttgggaagggatgcgctctcaccggtgttgtccggacaaaggaggggagccatgcgcaagtccttgcacgtccgttccgtggttaccgtcggggtcttggcgagccttggtgtcgtactggccgcctgtgggtcgacgtcgtcgacgtctacctcggcgaagacgtcgtccagctctgcgaccgtcgccacgtcgtcctcgagctacggcaccatcgtgacctcgggttcgggagtcacgtactacgtgttctcggcagactcacacgatcattcggcgtgcacgggttcgtgtgccgctgcgtggcatccggtgctcgcgacgcaccccacggtcggtggctcggcccaggcatcgctcgtgagcacgttcgtgcgcccaggcggagagcatcaggtcgcctatgacggccaccctctctacaccttcgtcgacgactcgggcccccacgtcatcagcggccaaggcatcaactcgttcgggggttcctggcacgtgatcgccccgagcgggaccccgatcaccgctgcgtcgagctcgtcgagttcgtcctcgagcggctatagcagtggctactagacggcgtccgcaccacgaccacgacgcccggtggctctaggctgcgagcgcacggcaccatgagcgtgccctgtgcctgatcgacgaacgaggaggccctggtgcgcagcgcttcgccacggcacgacagtcatatgatcgccctggcgcgaggtgacgggaacgtcgacctcgtcatcaacggtgcggaggtcttcagtcctctgacgcgaacctgggtctcgacgtcgctcgcgatcgccgacggggtggtggtcggatggggcgagcggccgaccaaggagcggctggacctcgcgggcatgatcatcgtgcccggattcatcgatgcccacgtccacatcgaatcgacgaagctgtggatcgaccgcttcgtcgaagcgaccgtacctatggggacggtcgcggtcgcgagcgatccacacgagatggccaacgtaaaggggctcgagggtgtgcgtgcgatgatcgcagccgcccatgatctccccatcaccatcggagtctgtgggtcgtcgtgtgtgccagcgtcgcgattcgagagtccgggggcgacgttcgaggtggaagcgatcgccgaggtgctcgccgagaccgacgcgctcggtgtggccgaggtcatggacttcccaggcgtgatcgctggcgacgagaccttgctcgccaagatcgcgctcgctggttcgcgtcgcgtcgacggccacgctccaggactgcgcggttcggatctcgatgcgtacctcgtcgctggcgtggaatccgatcacgagatggtcagtctcgaggaggtcgacgagaagcgtcacaagggcatgtgggtcttcctccggcacggatcggcaagccacaacctcgctgcgttcgccccgtcggtgcgagcctacggaacgaccaacgttgcgctttgctccgatgaccgggagccggatctccttctcgagcgcggtcacgtgaacgacctcgtcaggatcgccctggaggcgggcatcagcctcgaagacgcactcgtgctggcgacgttgaaccctgccacctaccacggtctcacccatctcggccatctggggcccggccgtcaggccgacttcgtggtgtatcgatcgcgcgccgagctcgaggcgggacggcctcccgccatggtgttccaccgtggtcggctggtcgccgaagatgggcggctcgtcgtcgagctcccccgtcgcgaggtgcccgagaccctcctcgccaccgtgcgtcttgctcgagcgctcgtcgagggggactttacgaccccgatccccgagcgcgttcgagtgatcgtcgccaacgaccactcgctctggaccaaccagcgcgtcacgactcgtgacgagctcaccgggatcaatcggctcgcggtcgtcgagcgacaccacgcgaccgggcgcatcggccatggtctcgtcgagggtttcggcctcgagcgcggtgccatcgcgtccaccgttgcccacgacgctcacaacctgatggtggtcggtgcgctcggagccgaggccgacatggcgaccgcagccaatcgcgtcgctgcgctcggcggcgggcaggtggtcgtcgtcgatggccaggtgatcgcagaggtgcccctcccgatcgccgggctcatgagtgatgcgccgattgccgagacggcgcgcgcggtcgtcgaggcgacgcaggccgcccatgcgctcggatcgacgctggaggcgcccttcatgacgctcgcgttcttgggtctgtcggtcatccccgagctcaagctcactgaccagggactcgtcgacgtcggagcgtgggacgtcgtgagtctcgaggcctgacaagccaccgctcaccccggccggtacgctaggagcaaggccaaggaggtcacccgatgcgtgatgccgtcatcgtcgatgtggttcgaaccccagtcggtcgtcgtaatggtgcgctctcgggctggcacgcggtcgacctcgcctcgacggttctcgaagcgctcgtcgcacgaacgggcatcgacccggcgctcgtcgaggacgtcatcatgggctgcgtctcccaggtcggagagcagggcatcaacgtcgccagaaatgccgtcctcgccgcgggttttcccgagtccgtccccggcacgacggtcgatcggcagtgcggctcgtcacagcaggcggtcgcgttcgccgcacaaggcgtgctcgccggtgcctacgacgtcgtgatcgccgccggtgtcgagtcgatgtcgcgggtgccgatgggctcgaacggggtgggccctgggtcgccattcgggccccgtgtcgaggcgcgctacgcagcgcgtggaggtctcgtgcctcaggggatctcggctgaactgatcgtcgaacgctgggggttgacgcgccaggagctcgatgcgttcgcgcttcgatcccacgagcgtgcttggacggcgacgacggaagggcgtttcaagtcggagatcctgcccatcgaggggcgtcgtgccgacggtgcagccgccccgaccgtgctcgaggcagacgagggcatccggcccgacacctccctcgaggcgctcgggagtctgaagcccgcgttcgtgcccacagggacggtaacagcgggcaacgcctcgcagatctccgatggcgccgccgctgctctcatcatggacgccgaacgggcgcgtcgccttggcctcgtcccccgcgcgcgggtcgttgccttctcactggcggccgacgatccgatcatgatgctcaccgcacccattccagcgacccgtcgtgtgctcgaacgcgcccatctcagcctcgatgacatcgacctcgtcgagatcaacgaggccttcgcatcggtcgtgttggcgtggggtgctgagctgcatcccgactgggatcgcgtcaacgtcaacggtggggcgatcgcgcttggccatccgctcggggcgtctggggcacgcctgttggcgaccttggtgaacgagctcgagcgccgtggcgggcgttacggcctccagaccatgtgtgagggcggcggcatggcgaacgcgctcgtgatcgagcgcctcgggtagatgagcgccccacgcgtcctcatcgtcgacaacgtcgactcgttcgtccataatctctatcagtacgtcggcgagctcggcgcagatccagtcgtggttcgtgacctcgagattcgagatcgtgtcgatccgcgcagtttcgacgcgatcatcatctcccccgggccggggcatcccagggcgtgcgtcggaggacggtggatcctcgaggatgcagctcgcgaggtgccgacactgggtgtgtgtctcggccatcagctcatcggtctcgtcttcggtgcaaccgtgacccacgcaccacgcatcgtgcatggtgagacctccagcgttcgccacgacggtcgaggcgtctttgcggggctgccgaatcccctcgtggcaacccgctaccattcgcttgcgatcgacccgacctcggttccggacgagctcgtcgtgacgagctggagcgaggacgacgtgatcatgggggtgcggcaccgatcgttcccgatcgagggcatccagttccatcccgagtcctacgccaccgacctcggccaccagctgatcgggcgattcctgggtctcgaggtgcctgcccgcactcgctgatccttgtgcgggcgtcgttcgctcggatggccaagccggcgcgccaccggagctgctcagggtggcgaccttcgccgtggtggcacttggcacgaggaaggcgggcatgcacgtccgctgcggtggcgttgacaccgacccgggcgccgcgctcgtctggtggcgctggccgtgcgacggcacgggctcagcgccgagtcggatcagccggctgacggggttggccccccgctggcaggaccgcccgaagcggtcgtcgtccacgtgatggtcacgctggacccaaccggtgcctgggtccctgcggccggcgacgtcgactcgaccaccgcggcagccggagggttcggctgcgagagtgtgtaggtgaagccagcgttggtcaggtcttgctctgcggtggcgaccggatcgccgacgacgttcggtaccgtcgcctcgttgccctgcgacaccaccaacgcaacactcgatcccggcgccaccttcgtccccggagcggggctcgtcgagatgacgtcaccattcggcacgctcgagcttgcctggtacgtcaccgtaccaacagccaattggtcggccccgagcttgttggacgccgatgcgagcgagagaccgacgacgttcggcaccgcgatcgagctcggaccgttggagacggtgaggacgacggtcgaaccgtgcggggcggacgtcccgccagtcggcgactcggcgaccacggtgccctgcggcgcgctcgctgcctgatagttggtggagacgttgaagcccaacgcgagcagcttcgcctcggctgtcgatgcggtctcaccgacgaccttcggtaccgtcaccgccgccggtccgctcgagaccacgagatcgacggtggagcccttctgaaccttggtgccagcccgtggcgattcggcgatgacggtacccgaggaggccgaggccgcccggaacgacagtgcactttggaggccaaggttggagaggacctgcgctgcgccctgctcctgggagccgacgacgttcgggacggcgacgcgagggagcggcgctgcgacgtgatggttcgagccggcgagcttcgcgtacagaaggcctcctgcgagtgcgagcagcaccacgatgacgagtaggatccatggccagcgccgccgccgacgagctgtctcgaccggcggcgtcaccgccgggatcgatgccgtgtcctcgacacgactgagcaactgggtccgatcgccaacgccctcgaccgctccgatcgccatcgtgcgctcgccgagcgcggtctgggtggtcgtcgtgcgcaggggacggtgctcgagcacccgctgcagatcgacacgcagtgccgtcgcgtcggggtagcgctggtcgcgctgcttggcgaggcagcgcatgaccacggtctcgagttcggcactcacccgagggttcacgttccggagcggggtgggcgcctcggtgacgtgcttgtaggcgacggcgatcggtgtctcaccgaggaagggtggcgtcccggtgagcatctcgtagaggacgatcccgagggagtagatgtcgctgcgtccatcgagatcctcgccacgggcctgctccggcgagatgtaggtcgcggtcccgaggaccgagccggtctgggtcaggtcctcgtcgttggcgaccgcacgtgcgatgccgaagtcggccaccttcacgatgccgtcctcggtgatgagcacgttggagggcttgatgtcgcggtggacgaccccgtggcgatgggcgaaggcgagtgcgagcgcgacgtcggcgccgatcgaggctgcttgatcgggggggaccaccccgaccgtgcggatgagctgcgccagcgtctgaccgctcacgagctccatcgcgatgaagtaggtgccgttcgcggggccccagtcgtagaccgacacgatgttcgggtgcgacagcgccgctgccgactgcgcctcacgccggaatcgctcgacgaacgtcgggttcgtcgacagctccgcgaagagcaccttcagcgccacgaggcggtcgagcaggaggtctcgcgcttcgtagacgtcggccatgccccctcgggcgatcttcgcgatgggctggtagcgcgtcccgaagacttggagctggacctcttcggtcatgtctgcctgccttcattcatcacagaggcacgctcggagcgcgcatctcccgtcatgacgacctcttccgcttagcgtgcgccgtggcggttggtgctggcgctcgcgcgatcaccaatgtcacagctgatccaggggcgacctcggtgcccgcggccgggcgcgatgcgagcacgtcaccgctcggcacggtggtgctcgtttggtaggacaccgtcccgaggacgagttggtgggttccgaggaggttcgaggcggccgcgacggagaggccttggagggtcggtacgaccacgcgaggtggtccggaagagacgatgaggttgacgcgagatcgtatcgcaacggtggtgtcggcggtggggctggtcgcgatgacctcgccgggtggcacggtggtgctggcctcggtcgtcacggtcccgaggacgagttggtcggcaccgaggtcgttggaggctgctgcctctgacatcccacgaaggcgcgggaccgcgacgaccgcgacggccgtgaggcggcttgcgatcactccgatcgcgacgccgagcccgagcaccacgaccagcacgatcgcgagccacggccatcggcgcgaccgtcggggcggcgttgtggaggctggcgagctcagcaactgcgtccgatcgccaacgccctcgaccgctccgatcgccatcgtgcgctcgccgagcgcggtctgggtggtcgtcgtgcgcaggggacggtgctcgagcacccgctgcagatcgacacgcagtgccgtcgcgtcggggtagcgctggtcgcgctgcttggcgaggcagcgcatgaccacggtctcgagctcggcactcacccgagggttcacgttccggagcggggtcggcgcctcggtgacgtgcttgtaggcgacggcgatcggtgtctcaccgaggaagggtggcgtcccggtgagcatctcgtagaggacgatcccgagggagtagatgtcgctgcgtccatcgagatcctcgccacgggcctgctccggcgagatgtaggtcgcggtcccgaggaccgagccggtctgggtcaggtcctcgtcgttggcgaccgcgcgcgcgatgccgaagtcggccaccttcacgatgccgtcctcggtgatgagcacgttggagggcttgatgtcgcggtggacgaccccgtggcgatgggcgaaggccaatgcgagcgcgacgtcggcgccgatcgaggctgcctgctcgggagggacgaccccgaccgtgcggatgagctgcgccagcgtctggccgctcacgagctccatcgcgatgaagtaggtgccgttcgcggggccccagtcgtagaccgacacgatgttcgggtgcgacagcgccgctgccgactgcgcctcacgccggaatcgctcgacgaacgtcgggttcgtcgacagctccgcgaagagcaccttgagcgctacgaggcggtcgagcaggagatctcgcgcctcgtagacgtcggccatgccccctcgggcgatcttcgcgatgggctggtagcgcgtcccgaagacgtggagctggccgtcgcgtcgagttcggcgtcctcggtccctgcgaccgagcgagaggggggcggtcgactcgtcggtcatccctgccctcccgtgataccgagcgcagcttccagcatcgccttgacgaccgggcccgcatactgagcccccgtcgggttcgcggacagcccaggctgcttgggtacgacgacagcgacgacgacgcgcgggttctcggccggagcgaaggcaaccatccagttgtccgatgcaccaaggaccgaggagtgactcgtcaacgtggtctgggccgtaccggtcttcgcagcgatctggacacctgggatctggatgccgaccgccgtcccgtagcggacgacgtcgatcatcagctgtgtgacctgtgcggccgtggacggactggtggcgaccctccaaacgtgcgggtggtaggccgtgacgaccgcgtcttgaggattgaggacacggttgaggacgtgcggggtcatgatggcgccgtggttggcgataccggctccgaccagcgccatctgcaagagggtcgcggtgacgttgccttggccgatcgcgctgaaggcgagctgggggagattctgcttgaagaacgatgcaggtgggaaggtcgacgcagccgctccgggcaggtcgatcggaggaacctgattgaatccgaaggccgtggcctcctcgctgagcgcggtcgcgccgagcttgaggccgagctgcgcaaaggcggtgtcacacgacacagggagcgtctgggtgagcgtaccgccacaggactcgtaggcgtaattgtggagttcgtgcgtggtctcaggcaaggggatctgcgacactgcagggaagttgatcagggcgagtttcgggtcgtggtcgaagattgccgaggtcgtcaccatcttgaaggtggacccaggcggataggcgcgcgaaatcgcccgatccaggagcggatcacccggattggcgagatcggccttccaggccgcgatctcggtcgtcgtcgactgtgccgcgagcggcgcaggatcgtaggtggggttcgatgcaagggcgaggatcgcaccggttcggggatcgagcgcgatgaccgctcccttgagtgacccgagcgcctggtacgccgtgcgctggaggcgcgagttgatggtggtgacgaccgagtcggtctgctcgctcgacccgaggagctgcgagatcgagtcgggtaccaccacgtgcgggacgaggtagcggttgagctcgtactcgaggcctgacaggccgtagatgagcgagaagtagccggtgatgtcgccgtagagtgatccggccgggtaggtgcgctggtagctgttgccaccgggaagcggcacggactcggccatgacctggccatcggcggtgaggatcggccctcggttctccgagaagatgcgctgcatgcccgcggtgttaccgggcgcgtcggcgagcttggacgcctggaccacctggaggttgttgagctgcacgaagaccaaggcaaaggcgagcagcagtacgagcgtgacgatcccgatgcgcctacgcatgcagcacctccaccacgccgaacgcggcaagggatgcgtgctgctgcgcggcctcgcgtgtcaagttggcgacgagcgtccttgccgcagccagcgatccctcttggacgccgtggccgagctgcaggcggagcgctggcgtgagcgcgcgctgctggagggatgtcgtctcgacgacccgcgggtggaaccagaggatccctccgatgcgtccccgctcgatcacgacgtgacctgcgacgatggtcacgatgtaggagtggtcgttgtagagcgcgaccacacccaccaccaccgccgctaccgcgccgagtgccacaatgagggccgcgagtcggagcgccgaacgtatccaggtcggacgttcggtcatctgggagggaagaggacgggggagcttggttgcgagggatgggtccttcggtgccgacgacgatcgcctcgtccggcccgacgcagcgcgggaagcctcggacacgaccgaggtcgacgctgtgtccgcggggcgggcgtgcgagagctcggacgtcgcgccgagtgcgctcgaggctcccgccggcacaccgtcttcgtgcgcgctgacgacgatcaccgagacgttgtcggagccgccgtgctcgagcgccgcctcgaccaacgccgagacggcgtgctccgggtcatcgttactgagcaggtgcgcgatctcggtctcggtgacctcgttgacgagcccgtcggaacagagcagcagcgtgtctcccggtccgagcgtgagctcgaagtggtcgggttcgaccccttccaccacgccgagcaccttcgtgaggacgtgacgcgcctggtggtgctgagcttgctggcttgtgatcgtcccggcatcgaccagttcctggacgaacgtgtgatcgttcgtgatctgacggagttcgcccgcgcgcaacaggtacgcgcgtgagtcgccgacgttggcgagatcgcagcgcccgtcggggtcgacgatcgcgagggttgcagtggtgcccatccccgcgagctcgggttcgtcctgggagcgctcgaagatcgcgacgttggcggctcgcagcgcgtcgactgcgctcgctccagcggcgacggcgtcggcgatggcccggatcgcgatggacgaggccacctcacctccgacgtggccacccatgccgtcggcgacgacgaaggaccggccgtcggcggcgacggcgtcttggttggacgaacggacgcggccagtatggctggcggctgcccaacgcaactgcatcacccgaccacccgaaaggcgctctggccaacctggagcacgtcgcctcgcgtcacgcgcatcgagccttcgacccgctcgccgttgacgaacgtcccgttcgtggacccgagatctcggacgatgatccgccgtccctccttgaccacctcggcgtggtggcccgagacgaagcggtcgtcggcgagcgtgaggtcgcaggatgcatcacggccgatcgtcgcgggggtggcgagttccagtcgacgtccctccagcggccccgccaccgcgagcacgacgagcgccccggtcttcggaccgccgctcggggtgactcgagctgcggtctggtgggcctctgcctgggcgcccgagcccgccgaggcgaccactggccgagcattcacgctggccggggtgcgctgggctcgacgcgtctcgcgccagacggcgcgcagtgcgaacgcaaagaagatccagatcaccacgatcagggcgtacttcaggatggtcaggaggacgacgctcatggaatcagccgcgctccactcggacttcgaccgcaccgagacggaggacgtcgccggcctggagttcggtcggtcgagcgactcgctccccgttcacgaacgtcccgttggtcgagccgaggtcggtcaccgtcgcggtgccttcggcgatcgtgacctcggcgtgtcgacgagagacgcggttatcgtcgatgcggacgtcggcaccgctctggcgcccgatgatgtaggacccaggtccgagctcgacgggtgcgccgtcgggcaggatgaacctccaccggttgcggtaggtggcgtcttcgacgaaggccgtgtcgatgtagaaggtgccggccttgagctgggggtcggcgtcgatggtcagcgcgatcggccccaggagctcgaagccgttgtcgtcgaccgtctcgcgcgcgagctcagcgagttcctcctccacgcgagctcgcaacggcccgagctcttcgaggtcagagggtgcgagcgcgacgacgatgcggttgggagcgatctcagagcgaaccccgatccgcacgtcacgctcgatctcgcgcaccaagcgtcgcccgatctctgccggttcgatcccacgcggcgcgcccttcgagaaaatcgactcgaccgcgctcgcgatgcgacgctcaaactgttcgagtgccaccccacctgcactataccgagcccacccgcgtacccacttaggaatccccagggagctggcgcgcctgcacacgcgcgtgagctccctcgctaagctcttggcgctcccgggcgagtggcggaattggtagacgcgcaggattcaggttcctgtgagggcaacctcgtgggggttcaagtcccccctcgcccaccgcatcggctctctggcatgggcgtcggtcgacggattgggcatcgccgcggtcgcgcgtgtgcgaagctgaaagcaacccgaggagggcggcatcggaactgtcacgctcgcagccctggtggtggcgacgtccttcgtcggggagctgcccgacaagacgatgatcgcggcggtgatcctcggccggcgtcaccacccgacgaaggtcgtcggcgcggccgtgctcggtctcggcgcccaggccgcgatcgccgtgaccctcgcaaccgtggcccgacgcctgctcaaggcctcggtggtccatcaggtctccggtgcgatcttgctcgtggttgcggccgtgctcgtgtgggtggcgcttcgggccaaggaggacgctggcgacaccatcacgccgaaccgccccttctggcagctcgtcggcgtgttcttcctcgctgaactcggtgatgtgacccaagcaaccacggctggcttcgcgctgtcgtcgtcggagcccgtcgtggtcgccgttgcggcgacggccggcatgacgctcgcgattgcgatcggcgctaccgcgtcctcagcgctcagtcgcattcccgagcgcgcgatctgggcgagcgccgccgccatcctcatcctcttgggcgtcggcgagctcaccggcgttctcatcctctaggtgctgattcctcgggatcggcctcgagcggccaggtcctcgccaccatcgtgagcacgtcgtagcgagccacgatcgctccgtcgccatcgcgtgtcacctcggcatcccaccgaacctcgtcgtagggcatccccgcgcgaggcgtgatctccttcgcggtgagcgtcaccgagagcgcatcgcccgggcgtaccggtgtgaggaagcggaggttgtcgaccccgtagttcgccagtactgggcccggctctggatcgacgaagagtcctgcggccaagctgacgacgagatagccgtgcgcaacgatcccgccgaagagtgggttggccgcggcggcctcggggttcgtatgggcgtagaagtgatcgccgctgagggccgcgaaggcggcgatgtcgtcagccgtgacgatccgcgggcctgcgctgatcgcgtctcccagctggagcgcggaggtgggcttgcgaaacgggtgctcaccgaggtgccgcggggcgcctggaacccactgggcggcgatgcgaccaagcacgctcggtgtgccttggaccgcggtccgtgcgaggtgccgcgtgacggctcgcatccctccgagttcctcgccgccaccggctcgtcctgggccgccgtggaggagccgaggcaagggagagccgtgtccggtggacgcgggagcgctggtcgcatcgagcacgaggatgcgaccgtgccagggcgcaagctccatcacgagctcgtcgacgacgcgcgcgtccgcgctcaccaccgaggccaccaggctgcctgccccgcgcgcagccagcttcgccgcgtgctgtgggtcctgatagccgaggacggtcgcgaccggcccgaaggcctcgatgcggtggggctcgtcacgatcggcgtcgcgcgcgacgagcaacgtgggggcgacgaaggcgcctcgctccgggtccgcgccgaggacatcgtccaggtcgccgccgaccacgacgtctgctgcgcgggcgagctcgtcaatccgggcgcgcacctccgcacgctgggcgaggctcgccagcggtcccatcaccacgtcgggacgtcgcggatcgcccacggtcacggccgagagccgctcggttgcggcctcgaccaccggtcctaccaggcttgccggcacgagcgcgcgtcgaatcgcggtacagcgctgccccgccttgatggtgagttcgtccacgagctgggagacgtagagatcgaattcgttcgtgccggggaccgcgtcaggcccgaggatcgatgcgttgagcgagtcggtctcgacggtgagatgggtgccgcgggtacgaacgctcgggtgcgagcggagcagctcggccgtcgccgccgaaccggtgaaggcgatcgtgtcctgaggcccgaggtggtcgaggagatcctcggcgccgcccgccaccagttggagcgcgccgggcggcaggaggccgctgtcgatgatgagctgcacgagtcggtgggtgaccggggcggtctgcgacgctggcttgatgatggtcggcatccccgcgagcagggctggagccagcttctcgagcggcccccagacggggaagttgaaggcgttgatctgaacctcgacgcccctgcgcggcacgaagatgtgacgccccgcgaagcggccaccgcgatcgagccgttccacctcgccgtcacgcaggacgttgccctccggtagggatcgcttggcgaggcttgcgtagctgtagaggacgccgatgcccccttcgacgtcgaaccacgcgtcgcgagccgttgcgccagcgacggccgatgcgtcgtggagggtgtcgacgtgctccgagaggtacgccccgagtgcaccgagcagtgcgcccctgtcttggaatccgagggcgcggagcgccgggcccccgacatcgcgcgcgaagcgcaccatcgcctcggtcgggagtcctcgcgtcgcgaggcgagccacctcctcgccggtcgtggcgtcaaggacgggttgcccgggatccgtggagaaccaccacgagtcctcgacgaagctgccaagcgtctgcatcgatcacctccgaggccgcgcccgaccgaccggtcggtcggggtgatctgaggctatcgcagactgggccgcctcaccgcggccttgtcgtcgtggctcgacgcacgtgtcgccgccggcgatctgcgtgcagctcggtgctccgggagcctgcggtccgaggtgcgatcagccagcgtgaccgatgcacatggcgctagacccgatcatgaggcacggatcgttggcggagagggagggatttgaaccctcggacccactttcgcgggtcaactcattagcagtgagtcccattcggccgctctggcacctctccttgggctcctaaggctagcgcagcttcggccgccgattcgccccggtggcccagacggcacgggctacgggccggcgtgtgtcggcggcggtcggatcggtgatggcccatccacggagcggggtggtctcgaagaccatgcgacgcccagcgatcgtggggcgggagggagaccacacatgagttggatgagacgacatcgcgtgcgcctgggtctggcggcgcttggggcggtgctcgcaacgggtgcgggcgtggcaacggccgcggcggcctcgccgccgccgagcaacgctgtcgttccaggcaccggggtaggcgagtacgggatgacgagcgccttctacgacggtcacatcgtgcacttcacgtattcgcgtggcttctactgcgacctgcacgtgtcctcgggcgcatcgtccgggtgtgaggtcggcgcgaactacgtcgtgccgccgtcgaagtcgttcgacccgctctacatcgcggtcccgatcgggatctcggtgccggccatgtcgatggactgcccgagcggcctcgtctgcgtcgatcaccccggtaccatcgacctgagcaggctagagcctgcgctcaagccgttgtatccgaacctctcggccgcgcagctgaccgccgccctgaagaacgtcccgacgccagggcacgagcacttcatcaccaccgtgaacgaccgcaagcctgagtggtgggatgtcaaggtgatcggggtggagaagctgtcggtgtggaacgccatcaatcggcatcgctcctttgccttcctcgagaaggaggttcgcgcaggacagaccacgccgatcatccccaccaacctcttcttgtacttctcggttaactaggcgtaaccgccccggcggtgctgcgtgcaccgccagggccgaccggagctcaccacccatgcacctcacacgtcgccgcctgcaacttggcctcggatggctctggctcctcgacggctgcctctcgttgcagggatcgctgctcggaaagagtttcgtcacggcggtcctcgagccaacgctcgcacaccagcccgcgatcgtcgccgcaccgctgcgaaccgccatcgaactcgtcgcaccgcacgctgcgctcgctggcttggcaatcgcgctcgtacaactcggtctcggccttggcctcgtcgtcgctcgcgacactcggcgatggcttgcgctctcgattgggtgggccctcgtcgtctggtggatcggggagggactcggtggcctcctgaccggggccacgctgctcagtggcgctccaggggcggcactgctctacgcgctgatcgcggccgcggcctggccgcggcggggccgacaggagcacgttccgccctcgccgttcgccgtcgcggcgtggagcgtcctgtggatcgtgaacggcgtcgcgcaagtcctggccgatcgttcgagcacgaacccgatcgcctccacagcgcagatgggccaagttggcgccccatcgtggatcgcggccgtcgaccaacgactcgggacgatccacggcgatgccctcggcacgatgctgatcgtgctcgaggttgccgtcgccatctggggactcgtgcctggcggaccacgcacgctgtcggcgctcgtcggatcaggtcttgcggtcgtcgcctgggtgttcttccaggggatgggggcactcacctcgggcctggcgaccgatccgaatacgggtccgctgatgctcctcctcgctggcgccgtcgtcgcggctcgtcctgcgaccggcgctctcacggaagcgatcgggcgacgccgggagcggagggcgccggtcggcgcccacgtcctgctcggcgtgcaccgtggcgagcgttcctcgtccatccccgcccagacgaagtgaggtgtgtccagtcgggtcgtgagcgtctgcgtgctgctgtcgatggctccgggggcatcccggctgtgcaggcagtccgtggaacgacttgcgtgtggcgcactgcggctcgcgccatggcgcccctccgcctccggcgacgtcgggtggcgtggcctcgcccgcctcgctgccgtcgtcggctcaccgcgaccgcatgcggggccgttggcatcgctggcgcaaccttgtgccggcccggtccacgccacctggtgcactgccatcgtgacgatcctcgactcgggcgctcccttgcggtctcggtgcccatgggggtcgatctgggctcgtcgatgaaggctccgtcggatccttcgtcgtcccagccgaggccgcggcgcccccgcagttcgatgcgccatactcagataggagcacgatcggtgctcacgagggtccggggggccaccgtcgagcaacgactggagagcacacagctaaccgccgatcacgactctcgagctcatcggtccgccggctgggatctgtgaggcccgtgcgagccgctgccggcgtcgccgcccatggtctcgcgaagcccgtctcgagtccgcagctgtcacctcgcagcgcgagcctcagctcgtgcgcaccaggtactcgagcctgggccgtggctggtgcgtgtctcggtgtcggcgaagtgccaacattgagccttgtgttgcggagggagtgggattcgaacccacggggctcgtggcccaaagcatttcaagtgcttcgcattcgtccgctctgccatccctcctcgaggacgcgagcctagtccggcgagtgcaggctccgcgggaggctcgggtcgagcggaaccggcggtggcgatggtgccgcctcttcgcggtggcgggggcgtgcactggcgaacgagccgagcagcttcgctcgtacgccgctcgcggcgaggtcgtcgagtgcactcgccaccgctggatcggtgacgtgaccctcgagctcgatgacgaacaggtaggcgccgaggctggttcgggttgggcgcgattcgagtttggtgaggttgatgccgcgagcagcgaaggcgctgagcagcgcgagcagtgagcctggtcggtcggtgacctgaaagcacgccagagcggtgcgatccgatccggtgggttccgggagcctgcccttggcgagcagccagaaacgcgtctcgttgcgcgggtcgtcctcgatgtccgacgcgagaacgtcgaggtgccagaggtgtgcggccgtcatcgttccgatggcagccgtggttggatcgttggcgtctgcgacggtgcgagctgcctcggcggtcgaggccaccgcgacgcgggtggctcccgggagcctcgtgcgcaggaacccgcgcgactgcgagagcgcttgggggtgagagaggacgcgggtgatgcgatcgagggaggacccgacgacgccgagcagctggtgatggaccgggaggatcgcctccgccaccgcaaggaggtcgaaacgatggaccagggcgtcgagcgtcgcgagcaccgctccctcgagcgcattctcgatcggcgagaaggcgaggtcgacgtcgccgtggtcgaccgcttcgaggacgtcctcgatggtggggtaggcgaccggctcgacgcgatctccgaaggaccgccggagtgcttcctcggtgaaggtcccggtcggccccaggtagctgacgcggtgggtgggcatggccggagcctaccgagtgggggtgaggtgcctcgccctaggctcggcgtgtgtgcagcccatgagtgaggacggtctcgtccgtagcgatgccggttggttcgacactgcacgccggaggcggatcggcctgccggaggccatctacgcaccgggcaaagccgagaccgacctcgtcgccctcatcgagcagagtctcgcctccggcgagccgaccatcgtcacacgcgtcgagcgcgagctggccgagcggctcgtcgaccggttcgaccttcgcccgtatcccgcgctcgaacgtcgtgcacccatggtggcgctcgccggcaatccggtgccgtcgtcgtcgctcgaacgcgtcgggctggtcgggattcttgcggcggggacctcggatcgcccggtcgctgccgaggccgcgtgtgtcatcgagacgctcggccacaggacccgcttcgtgctcgactgcggcgtggctgcgctcgcgcgatcggtgcgcgccatggaggaggtggccgacgcggacgtcgtcgtggtcgtcgctggtttcgagggtgcgctggccagcgtggtcggcggttcgatggcccaaccgctcattgcggtgccgacctcgaccgggtacggggcagcccgtggcggtgagaccgcgttgtgggccatgctcgcgacgtgtgcccaaggggtctgcgtggtgggggtcgacaacggattcggcgccgggtgcgctgcggtgcgcatcgtcggtgcggctgggcgcaacgcatgagtcgacgtaccctcgtcgtcaatgctgcggcaggagtcgcgggcgacatgctcctcgccgcgctgctcgcgctcggagcatcgagagagcacgtggaacgagcacttcgaccggtcggtctcgacaccgccctcgagacctcgctcgtggaccgagcaggcattcgcgccacgcagctggtcgttggcgacgacatcgagcacacccccctcgacgaggctgggctgcgcgcagcctgtgaggcggccagcctcgggcctcgtggacgcgagctcctctcgcgcgcgctcgatctggtgctcctcggtgagcgcacggtccacggggggcatgggcacgctctgcacgaactggggtcgctcgataccgtcctcgacctcgtcgggacggcggccgcgttcgaggcgctcgacgtggatggggtgctcctcggccccgtcgccaccgggctcggggcggctccgatggcccatggggtctacccgatcccggcgccagcggtcgcggcgatcgccgccgcgacgggcctcgtggtcgaggtccgttccggtgcagaggccaccaccccgaccggcgctgcgctgctgggtgcgctcacgatggtgcgggtcgccgaagcgagcggggccgttgctgccgtcgcctacggcgccggtacccgcgatgacccggaccgggccaacgtgctccaagccctcctgctcgatgggagcgacgcggttgccgagcagatcggcgtcgtcgagacctggctcgacgacctgagcggtgaggacctcgggcgcatcgccgacgaggcgatcggccagggcgcgctcgatgcgtggttgcttcccggactcggcaagaagggtcgtccgggtttcgagctgcgtctcgtgtgcgcaccgtctgccctcgagagcctcgtggcctgggtgcaccgacggacccagagtccgggcgtgcgtcatcgtctccaagagcgcagcgtgctctccgcgtggttcgacgaggtcgaggtgcacggcgtgtcgtgtcgcatcaaggtgacgccggtgggggccaagtgcgaggacgacgacgcacgcgaacttgctgcggtgctcggggcatcggtggcgacggcccgtgcgttggcattggcgaggtggcgagagagcggtgtgtctcgatgaccgcgactggagggagcgacgtggcacttgacccgacgatcgcgagcttgctcgaacagctcgccgcaaccggagcgacgactccggtgtacgagctgtcgctggccgatgcgagggctggcctcgatctcgtcggcaccatcgggatcgcaaatcctcctgcggttgcccgagtcgagcagcggaccatcgacgctggcgaccacgccatcgcggcggagctggtttggggctctgaggcgccacgggctgccctgctcttcgtgcacggcggtgggttcgtcctcgggagtctgcgtggctacgggccgatggtccgccatctcgcggcctcgaccggcgcgttggtcgtgtccctcgactaccggctcgccccggagcaccgtttcccggcagcggtcgacgacacgctccatggtttgcggtggctcgcggccgagcgagatgcgctcggcgtctcggtgctcggtgtcgtgggggactcggcaggcggcaacctcgcggccgtggcgagcatcgccgcgccgtccgaggggatcgacctcgcgctcgccctcgagctctatcccgcgaccgatctcagcgaggacctcgcctcgctcgagcgcttcggcgagggttactacctcaccgccgaggaggctcggtggttcgcgtcccagtatctcggcgatgacgaacggctgctcgcagattggcgtgccaatcccatggccgccaccgacctcgacgacctgccactcacgatcgtcgcgaccgctggctacgaccccatcggtgacgcgggccgccgatgggcagctcgtctcgcagcgctcgagccgcgcggtagcgtgcccgacgacctggacgagcgtctgcgacaggcgggggtcgaggtctcgggctgggcccgcggtcgggtcatctcgctggactttcccacgctcgtccacggtttcgcatcgatagcccagctcgcaccggcggcgggggccgcgtgcgagctgagctatggcctggccgcctgggtgctcgaacgggcgtgagcggcgtcgggacgcctacccggagttcttctggacggtggcgatcgcattgatcgatcgcaggacgagggtgagatcatcggggttccgggaggaccgccacgcaccgagcgccgtcacctgcaacgggttcagctctgcgaggacgcggttgcgcacggtgagcgagtcggcgagcgtcggactccaggcgaggagtcggcgctgacccgtggcgcggagcgtctcggccacggtgcgctcgtactcctcctcgatcaccgcgaagatcgccgctgcggtcgtcggatcgtctgcgaggtcgaggtagcggcgggccaagcgcatgtcggccttggcgagcgcgatctggacgttgtcgagcatgccggcgacgaacggccacgaggcccgagcctcccggatggcgtggtcgccgtgcgcctcgcgtgctgtggcgagaccggtcccgatgccgaaccacgcgggcagcgtgtgccgtgactgggcccacgcgaagacccaggggattgcgcggatcgtggcaagtccggtatcggcctgatggcgccgggcgggtcgtgagccgatgcggagctgggtgagctccggaaagggcgtgaccgatcggaaataggcgtcgaaaccggcgctcgtggtcaaggcccgataggcgtgctcgctcgagcgtgccaccagttcggtgaccatgaccgcgcggtcggtgggtgcggtgtcgtcgtccgcgccgccgaaggctccgagcgcggtgagcaaggtcgcgctggcgcgatcggtcgtggcgtagcggtgcgagatggtctcgccctgctccgtgatgcggatggtgccgcgcagcgcagctcgcgggtgcgctcgggccacctgggcgatcggtccgccaccacgcccgacggtgccgccacggccgtggaagagttcgacggtgatggcgtggcgttctccgaggccgatgagcgcctcttgcgcccggtagagcgcgtacgcggacgccgccatgccaccgtccttggtcgagtcggagtagccgagcatgacctcttggcgcagcgcccgacgctcgaggtgggccaggtaggcggggagggtgaagagttgctccatgaccgactcgagacactcgaggtctgcgatggtctcgaagagcggggtgatgtccagatggtcggcgccgagcgcacgggcgatgacgaggaccgcaatgacgtcggcagcgtggtgggtcatcgagatcacgtaggagccgatggcggcgggcccgagctcggcctcgacggtggtcagggtgtcgaacagggcgacgaggtcggcaacgagcgtggtcctcggcgtgcgagcgtgtggcggatgatccaggcaggccagcagcatcgacaggcgatcgtccgcgtccgcctcccaatagccagccaggcgaggatcgtcgccaaagagttcgaggatcgcttggtggtggaccgtcgactcctgccggatgtcgagtgatgcgaggtgggtgccgaacgtcgcggcttgccacacgaggtcctggaggggcccctcagcaagcgcggtgtcgccgtgagcagccagcgagtcgcgtatgagtcggagcgcagtctcgaggtcggggccgaccaggggggcgatgtcgagcgcctctgggtcgttgtggagccgatggagctggttgtcgatacgcgcaagcaggtagtagatcttctgacggtagggctcgtcgacgtagtgggtgcgcacgtacggtgcgaggtggacgaagtcgtgctcgtcgttgcggatcgactccacgatcgcgtcggagacggcggcgaagtgcatggagtgcgtgagccgtcgcttgacggcgtcgagtcgcgagcggaacgcctcgaggcacgcggtcgcgttcgcgacgaaggcagccttggtgacctcggccgtgaccaacgggttcccatcgcgatcgccgccgatccacgaaccgaagcgcacggggacgccgatggcatctgcatcgaccccccgtgctgccgcgagctgtcggtacacgactgggatggcgtcgaacaggctggtggtgaggtagaagaggccggtgtgcacctcgtcggcgacctcgagtcgtcgggagcgcagctcctcggtgaaccacaacagacggaggtcggacgggtcgacggcgttcggcgcgtgcgcgatgcgctgcagggtgtgcaagatggtgcgccgcttggtctcggtcgggtgcgcggtgagcaccggagtgaggcggatccgtccgagactcctcggtgcgagcttggcgaggtccgtcacgtcgtcggcgccctcggcgacgttgaggacgttgaacacgacgttggcgaggcgcagaagctgctccgtgtcgttgcgatcgagcggctcgtgctcggggccatcaccgagcgcgaagcggagcgcggcgaccgcccgcggcgtggcgagcgcccacagcgcgtccagcgggagtgaccacaggtactcgttcgtgcgcgacagcgactgcctcctcgcgggccgtggcgaccagtgcgcccgggcggcgagtgcgccgcccgggcccgagcggaggaggtgggattcgaacccacggtgggttgccccacacgcgacttccaatcgcgccgattcggccgctctcgcacccctccgtgcccgtctcggtgcacccaaggttcgggctgctacgctagcctacggtctacatcgcgcccgggccgccggcgtgggcgcggaagccgggccccacgcggcgggtccccgtgaaccgggtcagggccgggaggcagcagccctcagcggagcgattcgggtgccgtggccagcctggcttccgcgcaacgccggcggcctcgtaggcctgtccggggctgaagctaggatgccaccgtggccgagccttaccagtcgctgtatcggcgctttcgaccgcggcgcttcggcgaggtccgaggtcaggagcgcgtcaccgagaccttgaggcgcgcggtggccgaggggcatgtctcgcacgcctacctcttctcgggcccgcggggaaccgggaagacctcgactgctcgtatcctcgcgatggcgctcaactgcgaggcgcccgtcgatggtgagccgtgtctcgcctgcgcgtcgtgcgaggccgtcgtgcgcggcagctccgcggacgtcgaggagctcgatgcagcgtcgaactccggtgtggactccattcgatggatcacccagaccgttgcggctgcgccggtcgggcggtggcgcgtctacatcgtcgacgaggtccacatgctctcgcaggcagcgtcgaacgccttgttgaagacgctcgaggaaccgccggcgcacgtcgtgttcatcctcgcgacgaccaacccggccaaggtgctcgcaaccgtgcgctcgaggacgcagcacttcgcctttcgcctgctcgacgacgcatcggtcgatgcgttggtcgccgaggtcctggaggcgctcggcgccagcttgtccgacgaggcgctggcctacgtgcgtcggcggggcggaggatctgcgcgtgacacgctctcggttcttgagcaggtcctcgcgctcggaggcgtggtgaacgacgcggccgacggcgccgtcgcgctcgcacaggcgatcgcagacggtgacctcgcgtccgcggtgcgcatcgcgagcgatgccttcgagggcggcatcgacccgacagaactcgtcgccgacaccgtgggcgatctcggtcgacggttcgtggccgaggcgctggccggtgcgcgaggggcggagctcgctcggctctcgcggccgctcgagaccctcggacgcttgggggcgggcctgcgcgatgcgttggacccacaggtggtcgtgctcgcagggctcgccgaggcgctggcgccggacgcgaggctcagcgcgctcgaggctcgcgtggccgcgctcgaggccgacctcgcaggagccggtcacatgccgagacccaagccaccgaccggcgagccactgccggcccggaccacgagccccgagcccgccgggcactcggcgtcgccaaacgttgcggagcctgagaccagccagccagagacccgggagcgagcgtcccgcgcaccagcgcgcggactccaagatgctcggcgtggtggcgacgagcatcctggtgcgtccaccgagcagcggccctcgtcgctcgatcgcgtgcgtgctgccttcgcgaggaatcagcagcgggccgatgtcgaccgtggcgagccatccgagcccgtcgcgaccaccccggcccctcatggagacgatgaccagcccgcggcggcccccgacgcgcacggctccccggtgccgagcgggctcgctgacgaagcaacgcgagccgctgggcccgcgtcgctcgaggcccgtcggcagcgactgcaggcacgctggttcgacgacgtgatggccaaggcgccccgggtcctgcgtccgctcctcgcgcacgctcgtctcgcgatccgagacgagcgcatcgtggtggcggtcgacaaccgaacggttgccgagcggctcgtcccccatctcgccgagatcgtcgcgctcgtcggcccggacgagtttgccgagccgcccgagatcgtcgtcgaccctggatcgagtcagacgtcgtcccgggcgcccgctgcgagcgtcgacgatcgcgatccaggcgacgaggacggcgtcgatctcaccgacgccccctcgtccgatgcgacccccgtgcgcgacctcagcgagtcggtgatcgaggccaacgtccgcagcatcttcgaggatgctcgacggctcccatgaactcactgcctccaacgctggacgcgctcatcgaggagctcggtcgattgcctggcatcggtccgaagtcggcgcaacgcatcgcgctggcgctcatcgtgcgcggcccggccgctgcgcaccggctcgcagacgtcctcgtcaccgcgaccgagcggctcggtcgttgtgaccgctgcggggcgctcgcagagggggcgcgctgcccgatctgcgacgatccggcccgagatccgcgcatcgtcctcgtcgtcgagggcgatcgcgacgtgtgggccttcgagcgggcgcgacgtttccgagggacctaccacgtcctcggcggcgtgatcagccccatggacggcgtcggacctgatgatctcgccatcggccggctcatcgctcgcgtcgaggccgagccgatcgaggaggtcgtggtcgcgacctcgccgaccgtggagggcgagacgacggcgacctacctcgccagagtgctggccgggcgcgtcggtgtctcgcgtcttgcgaccggcgtgcccgtcggcggcgagctggagtacgtcgacgagctgaccttggcgcgcgcgctcgagggccgacggcccttcgacgacgcggggccgcgccgctagtcagtcggttgcaggcggttcttcgacgaactcgatcaggacgccaccggtggagcggggatggacgaaggcaaccgtcgtgccgcgcgatcctcggcggggtacctcgtcgatcgggtcgaagccctgacgtcgagcctcctcgagggcgtcgcgacacgattgcactcggagggcgaggtggtggatgccgggccctcgacgggcgagaaagcgagcgaccggcgagtcctcgcgggtcggagcaaccagctgaatgaagctcggcccgaccgcgagcatgacctcctcgatgccgtcggagtcgacgtgctcgcggtgggcgagtcgtgccccgagcgcctcccaccgggcgatcgccgcgtcgaggtcgtcgaccgcgatgccgacgtggtcgatctcaggctcgtccatcgtcgcctccgcgctgttcgggtgccgtcgtttgctcggccgcaaagcgcgcgaagagtgcgatgcggtcttcgccgatcgcggtgcgtgcctcggggtcgtcgatgccgagccccggcgtgggcgagaggcagaggatcccgaccttgccttcgtgacggttctggcggaccgtgcgaaccgcttcggcgacctcctcgagcgggtacgtggccgacaggaccggttggatgcgtccacgctcgatgagtcgattggcttcccacgcctcgcgatagttcgcgaagtggctgcccttgatggtcttcagcttcatccacaggtggcggttgtcgtaggagatccaatgtccgctcgtggcagcgcacgtcacgatcgtgccgccgcgcttggcgacgtagacggacgcccccatggtcgcgcggcccgggtgctcgaagacgatgtcagggtcttcgcccacgaggtcacgtatgtcttggccgaagcgtcgccactccgtttcgtcctgcgtgtcgtcgtcgcgccagaactggtagttccgctcggaacgatcgatgacgtactcgcagcccatgcgtcggagcagcgctgccttgcgcggcgaggagaccaccccgacggggatgcctccgccgttcaggacgtactggacgccgtaggagccgatcccaccggtcgcgccccagatcagcaccacctgtccttgacgcatctgggcaccgttgggcgagacgagcatgcggtaggcggtcgagttggtgaggggattgacggccgcctcttcccagctgagatggcggggcttcggcatgagctgattggctcgcacgatggtgaactccgccaagccgccgaagttggtctcgtaaccccagatgcgctgctcgctggcgagcatcgagtcgtcgtgggcgctcgggtcttggtcgtcgaccgcgttgcagtgcacgaccacacggtcaccgatctgccagcggcgtaccgcgggtccggtgcgaacgatgacaccggcagcgtccgatccgatcacgtggtagggcaggttgtggcgctggtcgagcggccgcggtgagcgtccgagtcgggcgaggaactgaaacgtcggcaccggttcgaagagcgccgaccagatcgtgttgtagttgatcgagctcgccatcaccgcgacgagcacttcgtccggcccgagctcgggcatggggacatctccgatgtgcaaggtggtgccggggtcgcgtacggcaggatcgaggtgggcaacacgctcgatgtcggactgctggacgtagcaggcccggtagtggtccgggaccggtgtcgccgccaactcggcgggatccgcgccagcgagcacagcctcggtgaggaacgacggcatgctctgacgttagccgctggcgacctcggcgtgtgggcagcccatctcgacgctgcgacgccggtgttctagactcgcgaggtcacaaccgtgtgctcgtgctggcgccaccaggtcaggcactcggaaggttggaggaggtcgtatgtcgaggtcggtcattgtctcgtacgctcgcacaccgatcggcaagctccagggtgcgttggcgtcgctgtcggcgatggagctcggtggtcgcgccatcgcgggcgcgctcgagcgagcgggagtcgccccggactcggtggactatgtcttcatgggccacgtgctccaggcgggccaaggccagatcaccgcgcgtcaggcggcggtggccgccaacattcccatgaccgttcccgccaccacggtgaacaaggtctgcttgtcgggcttgaacgcagtgttcctcgccgatctcctcctcgcccaaggacgcaccagtgtcgtggtggcgggcggcatggagtccatgtcgcgggcgccctacgtgctccccggcgcgcgaggcgggctgcgcatgggcgacgcggccctcatcgactcgatgctctacgacgggctcttctgtgcgttcgatcgcatggcgatgggtgcctcgaccgaacactactgccgggtggatcatccggtgtctcgcgatcgccaggatgcctttgcggcacgttcgcacgaactcgctgctcgagcggcgaaggagggccgtctcgccgacgagatcgtgccggtcacggttgcggggcgccgaggcgaggtgcacgtggtcgaggacgacgagggcatccgtcccgagaccacggtcgagacgttggcccgtctgcgtccggcctttgccgaggacggcaccatcaccgctggtaatgcgtcgcagatctccgacggcgctgccgcgctcgtcgtcatgcgggccgaggaggcagagcgacggggcctgacccctctcggagagatcctcggttatgggcaggttgccggtcctgacgcgtcgttgctgcaccaaccctcgaacgccatccgtgctgccgcgagcgacgccggcctcgacccggcctcactggacctcgtcgagatcaacgaggcgttcgccgcggtcgcgctcgcgtccatggacgatctcggtatcgatcccgcgcgtgtcaacgtcaatgggggcgcgatcgcgctcggccaccccatcggggcctctggtgcgcggatcctcggctcgctcctgctcgagctccgtcgtcgtggtggcggtgtcggcgcggccgccctgtgcggcggaggaggccagggggatgcgatgatcgtgcgcgtgccccgcaccgagtcctgactcaagccgccagaggggcggtcgatgacctcctcgggaggtcccgcatgcgtatcttcgtcgagggggcaacggcccacgacaactcctacggcatcgtgaacctgcgccttgccgaggcgctgcgcgctcgtggtcatgcggtgtacgtgcgcccgtgggaccaatcgttgcggggagctggcacgagcgcacgtgagctcgacatcgagcccttcgatctcggcgtcggccacgccgacgtctgggtgcgacaggtgtggccgccgtcgttcgagcgtcccgacgccgagcgcgccttcgtcatccaacccttcgagcttggcgcggtgccggcgaggtgggtcgtcgaggcaggtcagctcgatggcatcctcgtcccctcactctttgccaagcaaacctggctccaaggcggggcggatcatcgccacctctgggtcgttccgaacggcgtcgtcgtacctgccctcgtcgagtcctcagaaccgaacggtgatcgcctgacggtgggctacgtgggcggcgccatctggcgcaagggtatcgacatcctcatcgctggtctcgacctcctcgatgacgccacgctgcaacggatcgagctcatcgtcaaggtcgcaggtcatgacacctactacgccggccagtcgttgctcgagcgcgagctgctcgcccatcctcgtgtcgccgctcggacggagatcattcgcgcgagcctgtcgcaggcgcggctcgatgccctctaccaacgcttcgacgtgctcgcggctccctaccgtgccgaggggttcgcgctgccgatcctcgaggcgatggctcacggggtcgtcccgatcgtgccggacgccgggcctgcgccagagttcgtcgaccggagctgtggcgtgttgctcgcgagtcgccccctcatggtcggtggccctgccgatgagttcctcggtccggcgctcggaccacggtgggccatcgaggtggacccctgtgacgtcggctccgctgtggccgcgctgctggaggaccccggcgcccgggctgggcgtgcgcgagctgggcaggagcgagcccgggcctggagctgggatcgcgccgcaagcatcctcgaagacgtcgtgagggcgctggacgccgacgaggcacccaccgatgcgtcgtctcgactcctcctccgtgcgacacggggtggtccgcaggcgatcggtgcgctcgtcgagctgggtgacctccacggcgcccgcgagctcgctgcggtgaccccaggcgccgaggcggtgcgagcgagactggaggggctcgcggccactcgcccggacgtgtggtggggtgcgcgccatcgcgcgccgatccccgctcgggccgaagcacggtcgtcgtggcacgccggcgaaggcgacctcgccatcgtgacgcgtgtcgcgcgctacctcgctccactgcttgcgatcggaggcggtcgcgtcctcgacgtcgggagcggccatggcgcgatgctcggtcagctccggtcgctcggggttcgtgcacttgggatcgaactcgatccagcgagagtggagcacctgcgtgcgagtgggttcgacgtcctcgagggcgatgcgctcgaggtgctcggcaccttggagacggggagcttcggcggagccttcgtgggccacctcgtcgagcacttcgcgccccaggaggtcgtcacgttgctcgccgagctcgctcgtgtcgttcgcacgggtggcgtcgtggtgatccagaccccggatccgcaggcagagggagtcatgcagcagacgttctggctggatccgacgcacgtgcgcccgtatccggcgatgacgatcgccgcgatggcggccgaggccggttttgccactgttggggcactcgagcgatcgctcgcaccgctcgtcaccgacacgctcgtcgtgctgcgtcgtcgtgccgatgcgcccgtcatcgcgcctcggagggtggcagcggtggcgccggcggtggtcgtggtggccgaccctcacagtggattccggcgagccagcgacgcgctcctcggcgagctcaatgcgatgggcgtgggcgtgcgggcagagcccctcgtggggccgcggtcggaccgcgtgttcatgcacgatctcccgattggttcgttggccagcggcctcgtgggtacggcgctcgttgcgcgtaccgcgtgggaggcgaggggcctgccacgagagctgcgccgtacgctcgcgcgctatcgccgcatcctcacctactcacactggagccgcgacgtgttcgtcgaggccgggctcgcgcccgaccaggtcggcgtctgggcgccgaaggtggccctggacctcgatccagcgtcagtgcgagccctgcgaggttcgagggagccctcggggcgcgtcctggcggtcgccgagtggggcgctcgcaagaacatcgaggccctggtgcgcgggttcgtcagggctcgtggtcgtgtcggccagggttcgctcgtcgtgaagctacgacggatcgaggccgagagcgcggcgcgctggctcgagcggatcgtgagcgaggagcggggtgaattggcggcgatctcgctcgtcaccgacgacctggcgcctgcggcgctgcgccagctctatctcgatgccgacctctactgcatgccgacgcgtggcgaaggcttcggcctccccttcctcgaggcgatgagctacgggtgcgccgtcatcgcgccggccgacggcggtcaccgtgacgtggtcgatgcgtcgcaatggctcgttcccggtcgctacgagcctgcgcacgtcgatcccgcgtctggctacgccgatagcggggtcttccgaggagccgagtggttcgagatcgatcccgacgccttcgtcgaggttctcgccgaggcgctcagcgacccggacgcggtgcgctcgcgcgccttggctgcgctcgggctcgccgaggctgccgctcaggcctcgatcgacgagcacgagctgaacgtcgtgcgcgcgctctgggaggacgcggtcagctacgtggatgttcgatgatcgtgacgtgctcgatgaccgggacgcgctgtggccgaccctcgggagtgccgagcgcgtcgaggcgtgcgagcgtctgcgaaccgtcggtcatctgaccgaagaggctgtaggcgggcggcagtgcgacacccgagggtccggagacgatgaagaactgcgagccattcgtgttcggaccggcgttcgccatggcgagcgagccgatctggtaggcgcccgctggcgggagctcgtcgcggaagcggtaaccaggcccacccgcgccggacccggtgggatcgccaccttggacgacgaagccggggatgatgcggtggaacccgatcccgtcgaagtagtggtagcgggcgaggaagacgaagctgttgaccgtcgtcggcgcgcggtcggcgaagagctcgaagcggagctcgccttcgctcgtcaccatgagcgcctcgtaggatgcaccgtcggcgaggcagaagctcggcggcgcatcgaaccgctgtgtcttcgggctcgagccgtcgggctcgggacaagggtacgaacggtcacgacgtccgaacgccacgggggctcctttcttcgtgctcaccgcacgacgtgcggcacgtgccacacgctcgggtggactacgagctcgcgatgtgccagtggatcgacacgatccggtaggtgtgcttcggggggatgccgttgttctgggccgagccggcgtcgttgatggtggtgatgacgttgaggccgctcgtcacctggccgaagaccgagtagtcaggggggagctgctcgcctgcgggacccgacacgatgaagaactgcgagccgttcgtccctggcgccccggagttcgccatggcgagcgtgccgaagcggtacgagccggcaggagggttcttgtcggcgtaggcgaagcccggtgatccggtgtcggtgttcgtcgggctgccaccttggatgacgaagcccggaatcactcggaagaaggtcgtcccgtcgtagaagtgatacaggctgaggacgtagaaggcgttggcgctcttggggcccaggttcggctcgagtcggaaggtgaacgtgccggcggtcgtgtcgacggtggcggtgtaggtatcccctgcgacgaggcactccttggggtaggcgccaaagtgcgttcgcttgggtgcggacccgttcgggttgggacagccgttggcgaggaggcccttggcgggctttgcggtcgggcgcgtgagctcgtagatcagcgcgaggagggcgacgaggatgacgaggacgatgactcctcgtcggatgaggcgggtgcgacgctgacgggctgcgcgctcggcgcgcagtcgctcttggttggcccgaatacgggctcgcttggcgcttggcacctcggcaaggctagtcgccaaggcctcgggactggcgcgaccacaacgcgccgcgcgtgctcccgcctcgaggcgggaggtaagcggcgctctcatgctggtcggcgctgttactcgacgtagtggcactacctcgaacagcccctccttgcaggtatgacgctgacgagcgttggtgacgtgggcgagtacgtcggtcggagctaccggctctccccgagcccgcaccaggcagccagaatgaccacctgggcacatactcgccgtgccattcacaacctcgccatcgagcatcggcaactggcgtggtcaagagcgagggcgcaggtgacgtaccgcgaacaatgtcacgagctggctgaactgcgctcgtgcgtcgagtgggtggccgagccaccggcacaccttctccaacaagcacttcgtgacgtggatcgggcacaccagaactggtggcaaggacgcgcccgtaagccagccttcgagaggcgcggccaactccgcttccggccctcggcctccgatctccagatccgccacctcaaccgaaaatggtccgaagtgcgcctccccaagctggggtgggtccggttccgacgctcgcgctcactcgatggtgagcttgcctcggccacgttccgctgctcggtggcgtgtggcaggtgaacttcaccgtcctcgccacgacccaccgcgcgcccgtgaacgacggacccacggtgggcgtggacttcggtattgcctgcgccgcctacgtcgctggcgagtctgccccgaggatcatgcccccgacgctcaccccaggcgaagagcgtcggctccgtggcctggaacggcgtaaggctcgccagctcacctacgcgaagcgtcacaacggaggccggtactcgaaccgactccgtcggacgatccgtgagatcgcacgtctccgggctcgccaagcccggagacgccaggacttcacccacaagctcacgagcgacttggccaagaaccacagcctcgtcgccatcgaggacttgcgggtgacccacatgacgagctcggccaagggcacggtcgaggctcccggcaccagagtccgtcagaaagccggactcaaccggtccatcttggacatagctcctggcgagcggcgtcggcaactggactacaagtgcccgaagtacggctccctgctcgtggcggtgccaccggcaggcacgagccagacctgtcctgcatgcggggtccgagacccagcgagcaggccagggtgcgggagatcgttcgcatgcgtgcagtgtggtcataccgcacatgcggacgcggtggccgcacggaacatccttgatcgggccatcgccctcgttggtggtggtattgccgtggggcgcacggtggacagcgcgggcagggcttctggcccgagtcgccgccgcacggcggcaggcgtttccgcgaaggttcctcctgcggtaggagccacaggtgcgtgaacagcgcacccgaagcccccgccttcaggcggaggtggagtcacgagccgctagccttgggtgcccgtggccctgctcgtccagaagtttggcggaacctccgttggcgatgtcgatcgcatacgcggggtcgcagaccatgtcgcgcggacggtacaccgagggaacaaggtcgtcgtggtcgtctcggcgatgggcaagacgaccgacgacctcattcggctcgcgcacgaggcgacggacggccctgcgcccgcgcgcgagatggacatgctcctgaccgccggtgagcggatctccgcggccctcgtcgccatggccctgagcgacctcggcgtggaggccgagtcgttcaccggctcccaagccggcatcatcactgacaccgaccacacgcgcgcgaagatcctcgagatccgcccccatcgtctcctcgaggccatcgagtcccacatcgtgccggtcgtcgcgggattccagggcgtctcgacggagcgcgacgtcacgaccttgggcaggggtggttcggacacgaccgcggtggcgctcgcggctcggctcgacgccgacgtctgcgagatctacaccgacgtctcgggcgtgttcaccgccgatccgcgggtggttccgcgcgcgcgcaagattccccggatctcgttcgaggagatgctcgagctcgcggcctcgggagggcgggtcctggcgttgcgctcggtggaggccgcgcggaacttccgggtcccgctccacgttcggtcgagcttcacgtgggagccggggacgtgggttgtggaggaggagccatcgatggaacaggccgtggtgtccgccatcgcgcacgacgcgagcgaggtcaaggtgaccgtggtcggtgtcccggatcaccccggggttgccgcccgtctgttccgccacgttgcggagcaaggcgtcaacgtcgacatgatcgtccagaacgtctcgctccaggggcacaccgatatctcgttcaccgccccgaaggccgatcgcgctcgcgcactcgaggcgacccgtgctgctgccgcagaggtgggcgccgtcgacgtcatcctcgatgaagggatcgggcgcgtctcgctggtcggagccggcatgaagacacaccctggggtgacggcccgcatgttcgagaccctcgccgagaaggggatcaacatcgagatgatctcgacgtcggccatcaggatctcctgcgtggtgcgggccgaggtactcgaggacgcggtccaggcgttgcacgaggccttcgaactcgatcgtgaggtgcaccaatgaacgggctcgccctcggggtggtcggcgcgacgggccaggtcgggtcggtgatgcgtcggatcgtgctcgagcgcggtctgccgattgcgtccgtgcggttcttcgcctcgtctcggtcggcagggacgcagctcgacttcgatggcacctcggtcgaggtcgaggacgttgcgacggcggacccgagcggcctggacgtggcgttgttctcgatcggggcttccgcggccgagcgctacgcgccgcgcttcgctgcgagcgggtgcgtggtcgtcgacaactcctcggcatttcgtatggacccagcggtaccgctcgtggtggccgaggtgaatcccgaggcgatcgaggcgatgccgaagcggatcgtggcgaacccgaactgcacgacgatggtcgcggtcggggcgctcgcggcgatccgtcgcgtcgcgggccttcggcgcgtcatcgcgtccacctaccaggcggcttcgggtgccgggcgcacgggggtggccgaactcgccgcacagctgtcgcgccccggcctcgaggcgctcaccttcgacgggaaggccgtcgacttcgggacgccagcggtcttccccgcacccctcggggccaacgtcgtacccctcgcggggtcgttggtgggcgacgacacgaccgaggagcgcaagttcgtcaacgagagccgcaagatcctcggcatggaggacctgcgcgtgggcgcgacctgcgtgcgcgtgccggtctttaccgggcacgcagtgagcgtggtcgccgagtgcgagcggcccgtcgaccttgccgcggtgcgtgctgccctcgaggcggctccagggctccagctcgcggacctcccgacgccgctcgacgcggcaggtcgcgacgaggtgctcgtgggtcgggtgcgcgccagcgacgtcgtcgacaacggcgtcgcgttcttcgtcgcgggagacaacctgcgcaagggtgccgcgctgaacgcggtccagctcgctgagctcgtcatcgagcgcggcctggtcggctgagcaatcctcgcgagcgctcagagaagctactcaagttcgagatcctcgtcgtcgatgccttgaatgcgcatcacggaaccaccgtggagcgtctatggacagcgggcattcaaggaggatccatgtccctctcggtcaacacgaacctctcggcgattcaggcctacaacaacctgaatgcgacgtcgaaccagatgcagaccacgatcaatcagctgtcgtcaggtctgcagatccagacggctgcggacaacgctgcgggctacgtgatctcgcaggggctgcagacccaagcgaacggcctcggtgtcgcgatcaacaatggccaggacgccatcagcgtgctgcagatcgcctctggtgcgatgaaccagcagatctcgatcctgcagaccatgaaccagctggccacgcaggctgcgaacggcggcgcgaacaactccaactcgctgagcgcggatcagcaggagttcgcggcactccagagccagctcgaccagattgcgaactccacgagcttcggtggcacgaacctcctgaacgggagctactcgaacgaggtgttccagatcggggcctacgcgagctcggtcgaccaggtctcggtcaccatcgcgaccttgaacaccacctcgctcgggatcgcgtcctcgacggtgtcgatcggcacggtgtcggcggcgatcagcgccatggctgcggtgcagtcggccatcctcgcggtggcgagtgccgaggcggtggtcggtgctgcgcagaaccaggtccaagcgatcatcgcgaacgacacggtcgctcagcagaacgtgcagtcggcgaactccacgctggtcgacaccaacatggcgcaagcgatgaccgcgttctcgtcgcagcaggtcctcatgcaggccggcgtcgcgatgctgtcgcaggcacaggcgctgccgcagctcatcctcaagctcctcccgtagcacatccgatcatccccggtcgttcgtcacgggcccaggccgtcggggcctgggcccgtgatcgtgcgatcaggactccgaaggaggccccatgtcgtcgatcctgccaacctcatcgacgagctcgacgtcgtcgacgtcgagtggctccaacgtctcgacctactccgacccgggcggtcccccgatcacgttctccagcctgttctccggtatcaacacccaggcgatcatccaggcgctcatggccgcctacgagcaaccccaggtcgatctcgccaagcagatccagtcgctccagacgaacctgtcggactaccagaccatcgtctcggacctcagttcgctccagacccaagcgaacgctctgctccagccgtcacagctctcctcgatgagcgcgagtacctccgacgctgccgtggccacagcaaccgcaggtcaaggcgccatcccgtcgtccttgacgttcaacgttaaccaactcgcccaggccaacatcctcgcctccagcggcaccgtgtcgtcgctgtcgtctcaggtcgcctccgggaacttcctcctctcctcgagcgcagcgggcgccggcgtcacctcgcttgctggctcctcgctccaggtcgggacgcactccttctccgtgacgagcgcgctctcgggcgccaccgcgacggggacgtcccctcttgcctcgtcgatcaccatcggctcgtccaacgacaccatcgccgctaccgtcaacggcaccgccgagacgttcaccatcgcctcggggacctacacgccagctcagctcgccgccgcgatctcgcaggcgagttcggtctcgggaacccccttgctgcaggcgcaggtgaacgcccagggccagctcgaactcggcacgacgctgctcggttcgagtgcatcgctccagatcaccggtggtaccgcactgtcgacgttgggactcgcggcccaagcgagtgcgtccgtcgggaccgcggggtcggtcacactcgatggcaccgtcaccgccgtgaacaacgtccaagcgggtcagacggtcagccttgccgacggcaccggggggtcgatcacgatcggtatcggatcgttcggcctcagccagggcagcttcaccgctaccgaggtggcggccggcaacgggtcgctctcgcaggtggtgagcaacatcaatgccgctggcgccggtgtgacggcatcagcggtccaagtctcgagtggtacctacgtgctccagctggtctcgaaccaaacgggcaccgcatcggccatcaccgtcgaacaggcgcccttccagagtgccctcggtagcttcacgaccattgcagcggcacagaatgcccaggtccagatcggtggccagagtggttacctggtgagttctcagacgaaccaggtccagggcgtgttgcccggagtcacgctcaacttggtgtcggcgcagcctcccggctcggcgccggtcaccgtgagcgtcacccccgacggcaagacgctcgcctcgtccatccagtcgctcgtcaacgccgcaaaccaggtgctcagcgacatcaacacgtacgcgggctacaacgagcagaccaacaccggcggaccgctgatgggcgactcgacgctgaacgggatcacgagccaggtgctcggtgtcatcgctcagaccctcggcgaggggggcatcaccgccgcccaagccggcatcacgctgaacaagaacggtaccatcagcttcgacgcgcaaaccttcgcccagctctacgaccagaacccgaccgccgtcacgtcactattcgcccagtcgggcaccttcaacccatcgagttcgacctacgcaggcgacgtcagtctggtctacgcgggtgatggcacgcaagcgggctcctaccaggtcgtggtgagccagtcggccacccaggcgacggacagcgggtccgtgctcgcgagcggaacgatcaccaacgccgagacgctcaccgtcgcccagggttcgcagtcggtgcagtacgcagcgagcgcgggcgagtcgctcagcgccatcgcccagggcctcaatgccgcgttcgcccaggcaggcatggggatgcaggcctccgtggtgagctcgtcgtcgggttcgcagatcgtgctcaccgcgagtgcgtacgggacccagggcgacttcacggtgacgacgacggcgacgggatctgggcagaccgggctcgcaacgagcgcgaacacgccggagtcgttcaccggcttgaacgtcgccgggacgatcaatggtgtggcggcgaccgggaacggtcaggtcctcgccgcgccgacgacggaccccacgctcgccggcttgtcgctgcaggtgagtgcgagcgggatcacgagtgcgacgaccattggctcgttcgtgtattcgccagggatctcgggccagctcgccctcatcgccaacggcgccacagcacccgtgaccgggagcctcgaggcgcgcatgagcggtatccagcaacagatctcgatgctgcagcaacagtacaacggctatacgccgatgatccagaacgagcagaagatgctcgagcaggagtactccgcgatggagtcacagctcggctcgctccagagcgtgggctcggagctcgccgggcagattgcacagctgccgtagcgcccgccggacgggtgctgtcgacgacgaccaaggagggagaccgggtgccttcactggctcaacgcgcctacgtcgagaacgcggtggaaaccgcgacgccggcccagcgcctgctcatcctgttggaccgcctggaagcgaatctggtggccctcggtgacgcctttcgggtgcgtgacctcgaggcgatccacgtcaacgccaaggctgcccaggcagcgttggcgttgttgcgaggggcgcttcgcgaggacgtgtgggagcacgccgcgacgatcgcgaccttgtacacgtgggcgctggagcgactcgtccgagccaatgtggacaaagatccggctccctacgaggaggcccgctcggtgctcgagccgctcatcgcggcgtggcgacacgctgcgatggaggtctcgcatgagtgagcgcgatccgtgggaggagtacctggacgcgtacgcggagcacctcgcgcgcgtctcggcgagcctcgaggcgggccgggtgctcgagacgccgttcgatcgtgcgcgtccttccagcgcgatgccggcgcgtcacgctgagcgagcacgcgccctcgtggaggcgaccgaacagctcgcggcccgcctcgagcatcgtcgcgacgtggtcgggaccgtacttcggtactcgagagtccgcgaccccgagcgggtggtgctcctcgacgtgatcttgtgaggatgccatcgcttcggtttgcgtgactcggccgatctcggggacctgctcagacgctccacggggctgcttcctcgcgtgagctgacgcgagaactcacgggaagggactcgacggtgatcacggtgacgggacccaccaagcgcttcggagaggtgaccgcggtcgacggattgtcgttcgaggtgccgcccgggcgcgtgaccggattcctcggcccgaacggcgcgggcaagtcgaccacgatgcacatgatcatgggcctcgaaaggcccagtgcggggtccgctctcatcaagggcgtcccctacgccgagcttgccgcgccactgcggcaggtcggtgcgttgctcgaggcgaggtcgttccatccggggcgcagcgccagagcgcatcttgggtggctcgcggcctccaatggcttgcccgcccacggggtcaacgaggtgctcgagatcaccggactcaccgacgtcgcttcccgacgggccggcaccttctcgctcggcatgggcagcgtctcggcgtcgcggctgcgctcctcggtgatcccgaagtgctcatcctcgacgagcccgtgaacggactcgatcccgaggggattgtgtggatccggaccttactgcggggacttgctgctgaaggtcgaacggtgttcgtctcgagtcacctcatgtccgagatggctcagacggccgaccatgtcatcgtcatcggccgtggcaagctccttgccgacaccgcgatggcagcgttcatcgcatcgagttcgtccgcgagaacgctcgtacgcacaccgagcccagatgcgctcgcgtcgaccctgcgcgagcgcggcggggtcgtggtcgtcggcgacgacgggagtctcaccgtccggcctcgtggcagccgagatcggcgagatcgccttcgagcacgggatctgtctccatgaactgtcgccccagagtgcctcgctggaggaggcgttcttcgctcttacgggcgaggacacgagctttcgcggccagccggccacggttcacgaaggagcctcacgatgacgacgacggtcgaccgtagtccgagcacgctcggcccgacgttcgggcgctgctcgccgccgagtggatcaagatcaagagcgtgcgctcgacggtgctcacgctggtgttcatggtggtgctcggggtcgggatctcggcgctcggcgcgctcgccgtgcacgcagccgtgtcgcaccaccgcatcggccccggcttcgatccggtcgcgcgctcgctcggcgggatgctcatcgcgcagatcgccatcggtgtcctcggcgtcttggtcttcagcgctgaggtcgcgagcgggacgatcagccagacgttcgccgcggtccccaagcgctggcacgtgctgctggccaaggtactcgtctacttcgtgatcgcgctcgttgcctccgaagtagtgtccgtggcgagcttcctcgtgggccaggccgtcatgcacggagtcgtcccgacgaccagcctcacgaacgcgacggcgatgcgggccgtcctgggcaccgggcttctcgtcgcgatcgtgggtgtccttgcgctcgccatcggtgtcatgatccgtcgtactgctggggcgatcaccaccttcgtgggcgagtacctggtgctgcccttgctcgtgaccgcgctcccgtcgccgtactccaccgacatcgaaaagttcctgccgttccaagcagcccaggtcatgatgtcctcgcagctcgtcgcgaacagcttgtccgcgtgggtcggcctcgccgtcgtggcgggctacgccgtgatcgccgtcgtcgtcgcagggtcgctcctctcgtcgcgcgacgcctagacgcccggccatcgcgccccgcgcgaggcctgcagcttgccgcccgtgccgccttccatggaggggacacgggcggtcgtgcgtcgcgggtgcggctcaagaacacgtaagtactgatttaaccaaatcacgaaaagctcgatgattcggtttagggaaaccgtcacccgtaccgctaccgtggtgcccatcgcgttggggatgtgaggaacacgccgctcattcgagcatgaccgcgtcgaccaccagagggtgcgaggccgcggaaaacagcggggcgttggtcgacggccgctccgagccatgacgagcgagcgcacgagaggcgtaccgacacgagagaggaaagaggatggctggcaatcgctacgaggctggcgtcaaggagtaccgtaagacgtactgggcgccggactacgtgcccttggactccgacctgctcgcggtgttcaagatcgtaccgcagcctggtgtcgaccgggaggaggcagctgcggcggtcgccgccgagtcatccaccggtacctggaccacggtctggaccgacctgctcacggacctcgattactacaagggccgcgcctaccggatcgaggacgtgcccggggacgacacggcgttctacgcgttcgtcgcctacccgatcgacctcttcgaagagggctcggtcgtcaacgtcttcacatcgctggtcgggaacgtgttcggcttcaaggcggtgcgatcgctgcgcctcgaggacgtgcgcttccccttggccttcgtcaacacctgcaacgggccaccccacgggatccaggtcgagcgcgacaagatgaacaagtacggccggccgctgctcggctgcaccatcaagccgaagctcggcctgtcggccaagaactacgggcgtgccgtctacgaagtgctgcgcggtggtctcgactttaccaaggacgacgagaacgtcaactcccagccgttcatgcgctggcgcgaccggttcctcttcgtcgccgaggccatccatcaggccgaggcggagacgggcgagcgcaagggccactacctgaacgtcacggcaccctcgccagaggagatgtacgaacgcgcagagttcgccaaggaactcggcatgcccatcatcatgcacgacttcttgacgggtggtttcacggccaacacggggctcgcgcgctggtgccggcgcaacggcatgctgctccacatccaccgggccatgcatgccgtgatcgaccgcaatccgtaccacggcatccacttccgtgtgctggccaaggccttgcgtctctcgggcggtgaccacctgcacaccggaacggtggtcggcaagctcgagggcgaccgagcggcgacgcagggatgggtggacctcctccgcgagtcctacatccccgaggaccgtagccgcggcatcttcttcgatcaggactggggctcgatgccgggcgtcttcgccgtcgcctcgggcggtatccacgtgtggcacatgccgtcgttgctcaccatcttcggcgatgacgcggtcttccagttcggtggcggcaccctgggtcacccatgggggaacgcacccggcgcgaccgcgaaccgggtcgcactcgaggcgtgcgtccaggcgcgcaacgagggccgtgacgtcgaacgggaggggaaggacattctccagaacgcggccaagcacagtccggagctccgtgtggcgatggagacctggaaagagatcaagttcgagttcgacacggtggacaagctcgacagcgtgcatcgctgagcgagcgtggttcgacgaggtggcgcagcgtgcgccacctggacctaaggagcacacatggctgacgttcaggagtatcgcacgtcacggcgctacgagctgttctcgtacctgccccagatgaccccggagcagattcgcaagcaggtgctgtacctgatctcgaagggctggaacccgagcgtggagcacgtcgagccccatcgctcgatggagcgcttctggtacatgtggaagctgccgatgttcggcgagcagtcggcggaggtggtgctcgccgagctcgaggagtgccgccgtgcctaccccgatcacctcgtgcggctcgtgggctacgacaactacacccagagccagggcatcgcgttcgtggtgtaccgaggccaggggtcctgagcggctggcgctcctcgacgccgggaccagcgcgacctcgcggttcgcgcgaggtcgcgcggtggggccgtgaggctgaggcatgcgaagcaaggagatggcgacggtgcgcgcgagcgacgcgagcgagtcgccaagtaggtcgaggtcgtggtggtgacgaagggagggccccgagtgagcgagtcgtccacagccggcggggcggtgcgttctggccgcgcgttggcgcagcagcgtcggcgtgagcaagcgcttcgtcgcgcgaacgcacgaacgtcgccgaggcacgacgcagacgatcgttcgcttcgggtcgcaccgatggcgactgacccggtcgaggcgcggccgacgaccaccgagggtggctcgtgcgggtgcgaccacctcgagccgcccgtctccgcggtcgcgacgtcaagtgaactctcggtctcggtgcgcgggtatgtctcggtggatgatgcgctgcgtggcctgcgcggccgtgaggccgccaaggtgcgtcgccagctcctgtgcgtgcaggggcgaggcgatctggcggcgtgccgtccgacgggccggatgcgccgtcgcgacacggtggcgcccaaggtggaagagggcacgacccttgccggcaccagggtgaccggtacgcaggtcgagctcacggcgaccatgacgggtgcggatgcgggcagctgccgggtgatcagcggcacacagtacgtgggcatcgagcagttcgaggagcgctgcgacgaggtcccggaggcgcccccggccaaggtcagcgtcggacgcacggcggcagggcgccgcgtgagcggcacctccctcgcgccgagccccagcgtgacgggctccgaggcaggtgcgtgccggcgtgtcaccggcgtggactacctggaggcgaacgcggtcgaggaggcgtgtggcgtcgtccccgagccggcgccagccaaggtgacggtgggcgagacggtccagggccagcgtgtcacgggcgtcgtggtcgatcgtccagctgcggtcaccggtgacgacgtcggccggcgccagcgcgtgacgggcagccagtaccagcaccctgagtggattcgaggcgagtcccgcaatggttcgtcggtgccgcacaaggtgagcgtcatgagcacggtgcggggtcggccggtcaccggaaccatcgtgacgcccgatcccaccatcaccggggccgatcgcggggcgtgcgtcgaggtgacggggacggagtacgaggacagcttggccaagtaccaggcgtgcaatcggcaaccggcacctggtccgcacaaggtgagtgtgatgcggacctggcgcggggaagtcgtgaccggaaccagcgtcgagcacgacccgcgggtcaccggtgacgaggccgggcagtgcgaggacgtgaccggcacgccctacgtgggaccaggccagtacgaggccgtctgcgcgaccgatccggttcgccagggcgctcctggtggatcgtcgatcgcgatctcgggaacgcgtgtcagtgggagcgatcgtgtgacgggggacgagcgtggccgttccgtcaccgtgagcgggactccgtaccagcgtgggccctctggcgatgccgagcgcggcgtgagcgcgtggggggcgacgttcagcatcaccacgccagcacgtgctgcgcgtgaacgggcgcgggcgcgcgtcaccggcaccggctaccagcgcggtacggctcggatcacggggccactcgacctcgccctcggtcttgtctcgggtacgccagagtttcgctatcacgccggctcggacgccgaacagcaggtgcccgctcgcgaggcggccgtcacgggagaggggcgcgaggagggctttgccatcaccggcgatgcctgggatcgttcggccaccatcaccgggacagaaggggcctccgcatggcgcaatccgacgttgcggggaacccctcgtcggcgcgagcaggtggccagaagcgccgaccagcgggcagcggcagctcgcgagctccccgccagcgcccgcatcaccggcagcaccggtggcgtgagcgaggggccggtcgtgacgttctcgggcgggtcgcgcggatgatcttcctccagatgaagcggacggtcccatgaacacgcgcaatcgccgggggcgctacggcgggccgactccgtcgcatggcccctacgggctgggtacggcgcaaggacgtctgtcgggccaggacgcgcatcgcgaccacggcgaagcggccggggtcagccgtcgctcgaggaacgcgcatccactcaccgatcacgccgccaacgagcgacttgctcgattcgaacgcctcgtgcgagggcggttcgacgcggtggtaccgacactgaaggcgatcggaacgcttgctccgaccgacgacctcgccgaacgtgctgcgtcgatggctcgggccgagctcggtgtggcgttgccggcagagctgttcgagtctgcctggatcacgggtctcgacatgcgccgcctgtacgcggtcacgatggcagagaccatccatgcggtcgcggccgagacgcatgcgttcgccggcaccgagtcggacaccatgaccggtttcctgctcgagtgcggcttccacgccgtcgacatctcgccctgctccgatgggcggctgaagggtgtcattcgctcgatcctgcgcctgccggacgacgccgtgcgcagtcgcaaggcctacgcgggcgccatgttcgacgtcgaagcgaacgttcgccggtggatcgagacggagctgctgcgctttcgcgaggggagtcccgtgccgccgtcggccgggacgcggtatctgaagatcgcggtctatcactggagcaggtcggatcccgattacgaggggtgcgcggcgcacggctccgaccagcgggccgccgccgcggcagcactgtcgcgcctccgcgagcttcgcgaagccgtcgagaacagcttcttctgcggcgcctccatcgatctgttgttgatcggcgtcgacacggacaccgatgccatccgcgttcacgtccccgatgcgctcggcgacatggacctcgatcgctacgtggacaacctcgatctctatcgccagaccatcgacgatgacgtgacgacggcgcgcatgcgcgtgcatcgcgccatcgaagctgcgagcgccgatcaccctggcgggccgccgcacgagggcatgcgacggctcattgcgacgctgctcatcaacaacctgtcgcagatcgactacgtccgatcgacctggggcgagcgctacccggacgtcggccacgccgaggccttcatcagcgtcggtgacggcttcgaggagttccaggttcgcaacctcgcctacttcgtcttcctccagacggtcgaggaggcggcgaccgacctcgacgtgggcatcgggctgttccagcgtcggcccgagcgccgtgggttgccgatcccgatcgcgatccactttcgctacgaccgtcgggtcccgggcagtcgggagcgagccatcgagcggtgcgtgcgcgtgcgctcggcgatccgagcgcgctatcgagatctgtgcgcggccgggctgctcgcgtgcgacatgagcatccaggagcgaaccttctcgagcccgatcgaggtgatcgaagcgccgagtgacggtccggcgaacgaggatccgctgcgcctcgagcagcgtacggggcgagaggggggcaggcgatgaaggtctaccaagtcgagaagacgctcgtgtccaccaatcgcatccccggtctcaagaatctcccgctgctcgtggtgcgcgagcgcaacggctcccagagcgtggcggtcgacgcggtcggctgcgtccctggcgactgggtcatctgcgtcagcggatcgggcagtcgggcggcgacgggagacaaggactatccgaccgacctcaccatcgtcggcatcatcgactactgggacgaggacggctagcgacgagctgccggtgcgatgcgtcggcagcaatggggcttcctgggcgtgcgagcgcacgaccagggcgcaagggcaggggccacaggcgtatgggcaaggggcccgagcaaggaggaacgatggcaacaggggtgagcggcatcgcgctcggcatgatcgagactcgcggtctcgtgccggcgatcgaggcagcggacgcgatgacgaaggcggcggaggtgcgcctcgtcggtcgtcagttcgtcggtggcggctacgtcacggtgttggttcggggtgagaccggcgcggtgaacgcagccgtgcgtgcgggtgcggacgcgtgcgagcgggtcggcgacggcctcgtggcggcacacatcatcgctcgggtgcactccgaggtggagaagatccttcctgacggcgaggacatggccgccggggcgtagggaagaggcgagaagggagcgttgacgatggcaacaggggtgagcggcatcgcgctcggcatgatcgagactcgcggtctcgtgccggcgatcgaggcagcggacgcgatgacgaaggcggcggaggtgcgcctcgtcggtcgtcagttcgtcggtggcggctacgtcacggtgttggttcggggtgagaccggcgcggtgaacgcagccgtgcgtgcgggtgcggacgcgtgcgagcgggtcggcgacggcctcgtggcggcacacatcatcgctcgggtgcactccgaggtggagaagatccttcctgacggcgaggacatgggcgctggggcgtagggaagaggcgagaagggagcgttgacgatggcaacaggggtgagcggcatcgcgctcggcatgatcgagactcgcggtctcgtgccggcgatcgaggcagcggacgcgatgacgaaggcggcggaggtgcgcctcgtcggtcgtcagttcgtcggtggcggctacgtcacggtgttggttcggggtgagaccggcgcggtgaacgcagccgtgcgtgcgggtgcggacgcgtgcgagcgggtcggcgacggcctcgtggcggcacacatcatcgctcgggtgcactccgaggtggagaagatccttcctgacggcgaggacatgggcgctggcagcgtggcggcgcgctaggcggtcgaggtgacccaggaccacaggctggccggctttgtcgtgcgcgcgttgcgtgcagagatcatcgcggtcgagcactacctcgcacaggcgagcctggtggaactgtggggctaccccgcgttggccgatcgcttctcgaacgatgcgcgtgacgaactcgatcaccagcaccggattctccggcacgcggtgtcggtgggcatcgcgccacgcgccatcgacctgccgccactacggtttggacggagcgtggaggagctcgtaatgatggaccgggcattcgagctcgacgtcgttcgactctacggcgaggcggtcgactactgcgggcggatgggcccggcctcgagtctcgagctcttcgccgggctctacggggaggaggtcgagcacctggcgtcgatcgacgccctgatcgttgagatccgatccgagaggagggggcgggatcgtggctgaggccgccgcgccacgatcctggcgcttcgtgttcgacgactacgcaaccctgcggcgcttcctcgatgagctcgcgtcgatcttcgaggagcatgggtactaccccaaccagagcttccatcgcgccgacgtcaccatcaccatcgatcccgcgagtgccaacggcaacgaccagggcgttcgggcggtcgaagccgctctcgatgcgttcgtggcccgtggggtggggcaggcagatgaccagcggtcctgacgcgagtgattcgagcctcgtggtcgcggtggtgaacgccaagggcggatcgggcaagacgacgctcgcgctgcacgtgggcgtcggtcttgcgaggcgcggccccacgctcctcgtcgatgcggatccgcagcggtcgctgaccttctggacggcgatggcacctcctcgagctgcgttgccaccggtagcggaggcctcgcgggacgtggtgaccgtgctgcgcgctgcgcgggcggactaccgctacgtcgtggtcgactgtccaccgacgccgatccgaggcaccgtgcgtgccatcgtcgaggtcgccgatcgtgtggtggtcccgatcctcgcatctccggtcgatctgtggacgagtgcggagacgttctggtcgttgcgcaggctcgcgactggggaccgtgcgcgtcggttcgtcggtgtgctcaatcaggtcgagccgcggagcgcgctgtcggcgtccgttcggcgcgcggcgctcgcactcgatgtgccgctcaccgccgtcgcgctgggccggcgtgtcgtctaccgacaggcggcggccgaggggcggagcgtgtacgcgatgggcaagcgagcgatggcagcgatcgaggagatcgaggccctcatccaggaggtggtgtgatggcagaggacttgagtgatcgcttggtgcgggaggtgagccaggtccgtgcgatccgagccaagcagacaagcgcgtcgaagggggcaagcgtcgccggctcagaaccgacggcgcgagccaccgaacctgccaagccccgacccagacggcgtgcctcctcgactgtcgagcgcgaggtcacgcctccggccgacggcgaggccgtcgaacaaccggtggcgcgccctcggacgagacgtcctccacttgccgtgtggcctgactgatgcggatcgcggggcggtgctcgtgacggtcgggccgacactgtctcaccgaggagcaccgtttcaccgagcaataccgtctcgccgaggaaaggagtgagtcgtggtcgcaccccaagttgcgccctacgtcatcgacacggagccctactaccgaccggtcgcgaacgagatcgcgctcttcgaagccgcgtactcggtgcggatgcccgtcatgttgaagggcccgaccgggtcgggcaagacgcgcttcgtcgagtacatggcctggcgccttggcaagccgctcatcaccgtcgcgtgcaacgaggacatgacggcctcggacctcgtcggacgcttcttgctcgacgccggtggcacccggtggcaggacggaccgctcacgatcgcggcccgctacggggcgctgtgctacctcgacgagatcgtcgaggcgcgccaggacacgaccgtggtcatccacccgctcaccgacgctcgccgagtcctgccgctcgacaagaagggcgagctggtccaggctcaccctgacttccaggtggtgatctcctacaaccctggctaccagagtgtcatgaaggacctgaagcagtcgacgaagcagcggttcggcgccttggacttcacctatccacccgcggccatcgagacggagatcgtcgcccacgagagcggggtcggccacgacgatgcgagtcgcctcgtctccatcgccgagcgcgcgcgcaacctcaagggacacgggctcgacgagggcatctcgacccgcatgctgatctacgcggccagtctgatcgcccagggcgtcgatcgcatcgccgcatgcgagatggcgctcgtgtcgccgatcaccgacgaccccgacatgcgtgacgcgctcgaggcggcggtcacgacctacttctaggagggccctcccgtggccatcgagctcgagcgctaccaggggctcctcgactctctcggctcgcaagccgaggaggtgctgcgtgctgcctgggacgaagcgacgcgctccttcagcccacgcggcctcgaggaggtctacctccgctcggccgcgagcctcgcggcgctcgggcgtgggagcgacctcgtggtctcgttcctgcagcatgcccccgcgctggcgcgtgagctcggcgaggacgccgtgcgggatctggtcgcggcctcggtggcgttcttctcgaagaccagcgccagcgtgatcgcggagctgatcgcgacgagccctcgggcggccgagcgcctcggggacctggaactgttccgctcgtacctcgggctcatcgaccagctcctcgggctggccccccgtggcgttcgcggcctcctcgaccacctcgacgtcctgcttgcgcagctgaccctgagcgggttgacgcgctgggccctctggggtgcccaagtccacaaggtcgacttcgaggcccagcagcgctacttcgcactcgagagccccgatgcgctcgccatgctccagcagcagcgtcggggactgctgttcgtcgacgtccagcgtcgcttgcaggcctacctgcgcgccctgtggggccgcgacttcttccttcgacccgagtcggccgatccgcagacggccgcggtggtacgaccgttcatcgatggattcgtcgtccacctccccgacgcctacgacgacacggacggggtcggtgggccgatcagcgcgctcgagcagtaccgtgccgcggcggcgcacgccgctgcgcaccaggtggcgaccacacacgccgtggctcgagccgagcgatcgcgtctcgaggaactcgtcgtcgggatcctcgaggatgcacgcgtcgagcgcgcagcgatcgcggccttcccagggctcgccgcgctctgggcgcgcttccacgtcgtcgatctcgccgccgacgacccctcctcgctcgtcgcgcggctcgttcgctctctcctcgtcggctgcgataccgaggctcatccgtgggtccgtgaggcgtgcgagcacgctcgggtgctcgacgagttgggcggtgccgaggcagcggcagctctcccggagcttgctcgaaccctcatcgacgccgcacgccgcttcggtgtcgagctcgaccaggtcgactcgcgagccgtcctgccgagctaccgcgacgacaatcgctacgtcttcgagcgcgacgaagccattcgcgcccaggccgccaacctcgatctcgcgccctcgcaggtgcgcaagtacgtgagcgtgatggagatgatcaacgaggtggacgtgccgagcgccggcgacgacgccgaggagatctgggtgctcgcgaccgagttcttccgtgacggcgaggccgagagcgtcaacgcccaagagggtcgggagccgccgcccgtcgaggtgcactatcccgagtgggactaccaggtccaactggagcgaccgagctggacgaccgtgctcgagcgacgaggacccttgggcagcctggaggaggccgaggcgatcctcgccaagcatcgccccttgctcgggcggatgcggcgcatcatggaggcgctcgcccccgagggtgtccagcgcctgcgcaagcaggaagagggcgaggaactcgacatcaacgcggcggtcgatttcgcagtcgacctgcgacgggccgaggagcccgacctcagggtgatggtgaggacacggcgcatcgtccgtgaccttgccttcttgctgctcatcgacacgtccgagtcgacgaacgatcaggtgctcggcgcggacgtgacggtgatcgagctcgctcgagaggcgaccttgttgctcgcagaatcgatcaatcgggtcggggatccgttcgcggtccacgggttcgactccaacggtcgccatgccgtcgagtacgttcgctacaaggacttcgatgagcgcttcggcgacgaggcgcgcgctcgtgtggccggcatgaccggccaactgtcgacgaggatgggcgcggcgattcggcatgcgggtgcccatctcgcacgccagccccagcgtcggcgactgctgctcgtgctcaccgacggcgagcccgccgacaacgacgtgcgcgatccgcagtacctgcgtgcggatgcacgccgagccgtcgaggagctggctcgcgctggtatctcgacgttctgcctgagcctcgatcctcgcgcggaccagtacgtcgcgcgcatcttcggcccgaccggcttcatcgtgctcgacaacgtggcgcgactcccggaacgtctgccgctgctgtacgcggccctcacgcgctcgtgagcaacacgtaagtctttacttgacgaacatcgctttcaaatgagctttcgcatagcggaagtgtatttccggtctagtagattctcttttcatgaggagcacgccgaccgagcgccttcacggtgatggtcggctgcaggcttctgctcggcaccgggtcggtgcggcgagcggtggtgaggtgcgccccgcggtcgcgttcttacggtgtccgtggccgtggcggcccctcgcggggctcgaggggagaagggatcaagcatggggaacctggtgagttcgtggttgctcgcggtcgcggtggtcgcctacctggtggtgggtctcggtctcctggtcgcgcggggcgcggccggacgcagtgcgcgacggtggacgacggtggcgtcgtgggtcgggctcgtcgccacgctcggcgcctcgacggcgttcgtcgtcggccacgaacgatcgaccacgctggtcgcggtgccgttgcccgcacacctcgggcacgtcgccgtcgattcgctcgtgaacgccctcaccatgatcgtcgtcaccttggtggcgttcgtgggcaccgtggtcgtacgctactcgacgtcctatctccgtgacgaccccgctgagctgcggttctatcgctggttgaacgtgacgctcggcttgttcctgtggctgatcgtcaccaacgacgtgtggacgttctggctgctgttcgtcggtgcgagtctgtcgctccacgagctgctcgtgctctatcgcgatcgaccgctggccgtcacggcggcgcgcaagaacttcgcgctcgccagactcgcggacgtgagtctggcggttgcgctggtgctcgtcgtggaggcgacggggcgctcgagcttcgccggcatcgcggcgtggttccacggggcgcaccccccgatcggcgtcgatctcgaggtcgccgccgggctgatcgctctgaccgcggtcgtcaagagcggtgtcttcccgttccacgggtggctgatccaggtcatggaggcgccgacccaggtctcggcgctcctgcacgcggggctcatctacacgggtgccttcctcctcctgcgcatgagctggctggtcgcgtcggtgccgtgggtgtgggtggtgctcagcctcgccgtgatcggggtgttcgtgtcgtcgctgatgatgctcaccgagacgaacatcaaggaggcgctcgcgtactcgacctccgcccaacttgcgttcatgatgatggagtgtgggctcgggctctacagcgtcgcggtgctccacatcgtcgcacactcggtctacaaggcgcatgcattcctctcgtcgggaagcgtggtggatggccatcggggcgcgatcctcaccaaggtcccggcgcgtcgaacgttcgggcaggtcgagggcgcgctcgctatctccgcgctcgtcaccgtggggatcgccgagctcctccgggtcgacgtggtgcacgagcccacgttggccgccatcggcttcgtggtcgcggtcgccatgacgcagctgctgctgcagggggtcggggggtcagaccgtcagggacgtcgcttgctcgtgcgcgcgagcggcttcagtgtgctcgtgggtgctgcctacttcggtctgcacgacgtcatggtgcgcctgctcggctccacggtgccgtccgagagcggccaggcggaccacatcccggggtgggtgctcgtcgtggtcgtggcggcgttcgtcgccttgctccacatcggccagttcctcggtccactcagccggacccgcttcggccagtggctctacgtggcgctgtggaacggtctgtgggtggatgccgccatgcgtcgcctcgcgtggttcgaccacctgcgcctcggtcatcgtccgctgcacgcccctaccgagcctgagcctgttgcggcgacgggcgatgagcccgtgcccggatcggcggcctcggtgctggaggccgcgcgcgtggcgtgcgaccggatcgcgccggtgtggccgctccggcacttcgtcgccgtgaacccctacttcggcatgcgcgacctgtcgttctgggaggccgaccgctacctccagaccatcgcaggttctcgcctggtcatgccgctcgcctactaccgagagcagctgcaacaaggacgcatcggtccacgcgatatccgtgacgcagcgcgtcgccttgggcgcgagggggcggtcgagggcctgctcgctcgcctggaggaggctcgtagtgagccgctgctccctcggctcccgctcttcagcgatcacctcgggcgccttcgcggtcgggacatcaccacggccatcgtcgagcggctcagccatttcctggcggcctacttcgacgaggggcaagccacctggcaccttccgtggcaggggaactcgttgtggcaggcgtggcggtcatcggtccaggtcgacgcgacgccgcgcatcctcggactcccgtggcccaagtcggcgctcgcggccctgcccgagacgcccgaggacgccatcgccgctgcgctgggcgtgctcggcgttgctcacgaagcgatcgaggactacttggtcgctgcgttgttctccatcggcgggtgggcgtcgtgggcacggtaccgacggtggcaggcggagctcgtcggctcgaccgacgaaaccctgttcgaactgctggcgatccacgtctcggccgaggcgatcctcgcccagggacttgatgatcctcgggtgctcgcctcgtggcgcgacgccgtcgtggcagcccatcggtcctgggtcgcctcgcggcacgatccgctcgacgacgccgcgatcatccacaccgcgttcgagctgcactatcggcgccggctcgcgcggacgctggctgccggtgctcgcgccggggaggcgcccaccggggagcgtcctcgcgcccagctcgccttctgcatcgacgtgcgctcggagggcatccgtcgcgccgtcgaggcccgcgtcgctggcgcccagacgctcggcttcgccggcttcttcggcgttcagatggagtacgtccccttcggtaccgagcacgcacgcgcacacctgccggtcatctttgcgccgccctatcggatccgcgaggacctcgtcgatgcctccgacgacgaccgtgcgcgtgcggcggagcgacgtcgccttcggctcggcgccggcgcggtctggaagaccttcaagtcctcggcggcctccaccttcaccttcgtcgagtcgaccgggttggtctatatcccgaagctcttcggcgacgccatgggctggtcccgcacggtcgcgcaccccgacgcccgaggtctcgctggcgacctgcgcgcccggctgcgcccgaggctgacgccgatcggtcatcccgggggcaacgacgggatccccgaggatcgtctcgccgagatcggtcgcttcatcctcacctcgatgggcctcaccggcgggttcgcgccgctcgtggtcctggtggggcatgggagcgagaccgtcaacaacccgcaaggatccgggctcgactgcggtgcctgcggggggcagacgggcgaggtgagcgcgaaggtggcggcggcgttgctcaacgatccgcgaacccgagcaggcctcgaacgcgtggggatctcggtgccgagcgacacggtgttcgtcgcggcgctccactccacgttgacggagcaggtgaggctcttcgacgtcgacgcgctcgatcccgcccatcgcacgctcgcccgcgacctcgagaccgatctcgccagcgcgacccggctcgccgcgacgtggcatgcgacctccctcggtgtgaccgccgaccaggatctggcgcacgacctggcgcgtcgtggccgcgactgggcggaggttcggccggagtggggcctcgtcgccaacgccgccttcatcgcggctccacgcgcaaggaccgcccacgtctcgctcgagggccgcgcgttcctccacgactacgactggcgccacgacacggactttgcgaccctcacgctcatcatgaccgctccgatggtggtcgcgaactggatcaacctgcagtactacgcctcgatggtcgacaaccggcgcttcgggagcggaacgaaggtcctccacaacgtcgtcggtggttcgatcggagtcctcgagggcaacaacggcgatctgcgggtcggcctcgcgctgcagtcattgcacgacgggacacgctggctccacgagcccgtgcgcctcaccgtggtggtggaggcgcctcggggcgcgatcgaccaggtcgtccgggaacaccagctcgttgccgacctcgtcgagcacggctggctggtcgtgacccaactcgaacccgacggcactctctacgaacgcgagggcgatggccgttggcgcgcggtcatcgacgacgattcgttggcagcgaccagcgttcgctgacggcacggcgagcgcgagcggcctcgctcggcggccacctggaccgttcgcggtgtcggtggctgctcgtggtccgtggcctcgctcggcgatccgtgctcaaggtcgtcggcgttcgctccgagatcagtggcagccgcaggatgcgagctaccgctgatccaaggagggcgtgacccgcacggggaggactccgcgtgagcacgaccgtcgaggcgttgagctttgcgctcgacgcgctccagatccagagcgacgccatcgccaacaacgtggccaacgtcgacacgcctggctacatccagtcgaacgtgtcgttccagtcgtcgctcgccgctgcgctcgccaacggtggcacggccaccaccagcgtgaccccatcgtcgaaccccgtgggactcaacggcaacaacgtctcgctcggccaggagctgacccaggcgaccaccaacgccatggactaccaggcagtctcgaacgagctgacgacgtacttccaaatcttgtcgggttcgatgggaggccagttctaagtgtcgctgtttccagccatcgacgtcgctgccaccggcgtgacgaccgagcaaacctggctcgacaccatcgcgtccaacgtggcgaacgtcaacgaccagtcggccacgaaccaaccgatctatcaggagcaagaggtgctcgtgcagcccgtggagacgtcgccggtgacgggcgtcgcggacacgaccacgacgcccgtcggttcgggcgtccaggtcgacgccatcgtcaccccgttgcccaacggggtgctctcctacgatccgacctcgacgctcgcgaacgcgcagggctacgtgaagacgcccgggatctcgctcgcccagcagctcgggaacctcgtcaacgctcaaacctcctaccaggccaacgtcgcggtgatcaaccaggccaagacggcctacgaggcgatcctcgggatccaggcatgatccccccgatcgcacccctgtcgtcagcgctgtcggcggcggcgccgggtgctgcgggagcgtccacgcagggcgcgagcggctttgcccaggtgctcggatcggtcatcgaccagatccaatccacccaagcgacggccaacacccaagcgcaaggcgtcgccagcggccaagcgtcgatctcgaacgcgatggtcgcctccaccgagtcgctgttgaccaccgaacttgcggtccaggtgcgtaacggcgtcgtcggcgccatcgaccaggtcatgtcgacgcagttctaggaggcgtactcgtggcatcccaggacctcctcgccaaggcgcgcgactcgctccggcgcttcgcgagcggcttcaccaccggccagaaggccgtggtcatggtcggcatcgcactggtcgtcgcgatcgcggttgcgctggcatcgctcacgtcgagcccgagctacggcgtgttgttctcgggcctgtcggcccaagatgccggctcgatcaccgcgaagctccagtcggcgggggttccctacgagctcacgaacggcggtacgacggtgctcgttccccagaacctcgtcgaccaggagcgggtctcgctggccgaggccgggcttccgtcccagaccgcggggctgacgtcgctgaacggcctgtccatcacgagctcgcagatcacccagcaggccgattaccaggcggcactgcagtcgcagctcgctcagaccatcgaggcgatcaacggcgtgcagtcggcacaggtgaacctcgccctgccgccgacggacgccttcgcgatcggtcagtcgtctcagccgagtgcctccgtgatcgtgacgctggacgcgggcgtgtcgctcacgtcccagcaggtcgaagcgatcgtccacctggtggcgagcgccattccggggatgaacgccaacgacgtgacggtggccgaccagaacggtgacgtgttggcagcgccgggtctcggcgtcaacgcccagggcgccggtcagtcggcgcagggcttcgactctcagctcgaggcgtcgatccagtcgatgctcgacacgatcgtcggccccggcaacgcgaacgtccgcgtcgcggccacgctgtcgacgaaccaggtcacgacgaagacccagtcgatccagacgcagaagggcaagcccctcaccacgccgacccagacccagacccagacccagaccttcaccgggaacggcaccgtgccgggcggcacgctcggcaccactgggatcgcgaccaccggcaaccaggtgtcgacctacaagcagacctcctccacgacgcagtacgcgatcggtcaggtcacccagacggtccagcaggcaccgggcgcgatccaacgactcagcgtggcggtggcggtcaactcgcacgtcaagggtctctcgttggcgaagctgcgccaggtcgtcgcggccgcagccgggatcgtaccggcacgtggcgacacgctctcggtcgtcgcggtgccgttccccgcgctggcgacgacgccgtcgggtgcggggtcgtcgctcttcgggtcgatcctcggcatcgcgaaggtggtcctgctcgtgctgggagcgctcggtgcgatcttgctcatgtcccgtgcagcggcgcggaccgaggtcgagccgttgttcccggctgagctcgagcctgctctcgcgggaacgggtggccagctcgccggacccaccgaggaactgcccgcggtcgccttgccccagagccagccggtcgtcggcgaggacgtgctcgactacatcgatcgccagcccgaggacgtcgcgaagctcttgcgggtgtggatgacggcgcggggtcgcaaatgagcacgaaggtcgccgacctcaccggcacccagaaggcggccgcagtgttggtgcagctcgggacgactctcgctgcgcgcgtgcttcgtcagatgagcgagtcggaggcggtcgccctcacgctcgagatcgccaagctgccgagcctcgacaaggagaccatcaccgaggtgatggccgagttcgtcgactcggtcatcgcactcaagaccgtcggtcaaggtggcgtcgacacggccaaggagatcctcgcggcccgcctcggcgatcgtgaggctgaagagatcctcgcccagttcaccggtcagagcgtgtcgaacccgctggccttcctcgaccacgtcgagccgttccagctggtcagcttcctctcgagcgagcacccccagtcggtggcgatcatcctcgccaacgtccctccagacctcgctgcccaggtgctggctgcgatgcccgaggagccgcgcgcggaggtcacccgccgtatcgccctcctgtcgcgtgtcgacccggtcgtcgtcgagcaggcggcctccgtgctccagcgcaagctagccggcctgacgaagcaggggccggtcgccctgcgcagtgggctcgccacggtggtcgagatcttgaacaacgtcgaccagagcacggagcgacgcatcctgtcggacctcgactcgctcgaccccgaactcgccgatcgcatccgtgagcagatgttcgtgttcgaggacatcatggtgctcgacgaccggaccctccaacgcatcttgcgtcaggtgtcgccgaaggacctcgccgtggcgctcaagggcgtctcgcccgagttggtgaaccgcatcatggcgaacatctccgagcgcgccgcggaggatctcgccgaggagatcgagctgctcggccccgtgcgcctctcgacggtcgaggctgcccaggcacagatcttgcgtgccgtccgcgagctcgaggcggcgggcgagatcacgattgcccggtccgacgaggagctcgtccagtgagcgccgcacggatcctgcggggcacgctcgacggcgtcgggacggtggcgctcccaccggtggagcatcttcgtgccggtgacgccgagcacatcgcccttgcgcacgccatcgaggaggccgagcgccgaggcgaggagcgcggtcgtgccgccggtgaggcggccgcacgtcagctcctcgaggccgagcgggcggcgctggcctcgacgcgcgaggcccttgcctccgtcctccggcggctcgagcgcatcggtcgcgagtcgctcgaggccgacgtcgtcgaggtcgtcaccctcgcgctcgagctcgctcgcgaggtgctcgcggccgaggtggtgcctccccgggagcggatcgaggcgtgggtggggcgagtgctcgccgagcgtgacgtcgaggagctcaccgtccgcctggcaccgcccgcgagcgaggacctcgccgacaccctcgtcgagttggccgagcgcgaaggcgcgaggctccgggtcgagcgcgatgtgtcgctcgagccctacgacgtcgtcgtggagctgggcgcgggcgtcctcgacctcacggtcaagggagcgttcgagcgtgtcctccaggagttgcgggagctcggacagtgatccctgcccgtgtgcgcgaccaggtcctgcgtgccgctgcgccggttcgccagggccgcgtctcgcggatcgtcgggatccacctcgaggtcgagggcgtggaggcaggcatcggcgaagcggtgcgcatcgagctcggaggcggccagagcctggtcgccgaggtggtgggcttcgagggcgagcgactcgtctgcatgccgctgcgcgaggtccgaggggtgcgctacggcgatcgcgcggtggccttgcgccgcgcgacccagatcccggtgggtcgagcgctgctcggccgcgtgatcgacgccgatggggtgccgatcgatggccagggcccggtcgaacccgacgatgtggtgggcctcgagctggcggcaccgatgcccatggagcggacgctcatcgacgagcagctcggtctcggtgtgcgcgtgctcgacaccatggtcccctgtggtgtgggccagcgtctcggggtgttcgcgggagcgggtgtcggcaagagctcgttgctctcgatggtggtgcgcggtgcggacgtcgacgtgcgggtcgtcgcgctggtcggggagcgcgggcgcgaggtgcgagaattcctcgagcacgacctcggaccggaggggatggcacgctcggtcgtggtcgtcgcgacctccgacgagccgccactcgtgcgtgtgcgagcagccatcgcggcgactcggatcgcggagtggttccgcgccagcggggcgcgcgtcttgttggtgatggattcgctcactcgcttggcgctcgcacaacgcgagctcggactgtcggcgggggaaccgccgagcgtgcgtggctatccgccgagtgtgttccgcctgatggcccagctcctcgagcgtgcaggcaccgatcacgtcggctcgatcacggggatctactccgtgctcgtcgaaggtgacgacctcgacgatccgatcgccgacgcggctcgctcggtgttggacggtcacatcgtgttgtcgcgccagctcgccaatcgcggccgatatccggcggtcgacgtcttggcgtcgctgtcgcggttggagtcgtccatcctccccgacgatcgacgaaggctcatgcaggcggctcgccgacatctcgccgtcctcgacgaggtgcgcgatctggtggatctcggtgcctaccaagcgggaacgagcatggaggtcgacgaagcgctcgaggtggtgccgcggatcgagaccgtcttcggccaggacatctcggagcgctccgatccgaacgacgcctggtcgcgcctggccggtgcactgggggtgaacgcatgagcgaggagcgtcggatcagagcactcggtctcttgcgtaggatcgagcgactggagcgctggaaggccgtcggggcggtcgccgcagcacagcgcgcgtggggatcggcaagggccgaccgcatcgcccatgtcgccgccatcgatcaggacctgcccctcacgctccatgcctggcatctccaggccgccgtctgggcgggcgagcaggccgtagacgccgctgcccgacgtgcgacgtcggagcgttggctgcgcgccagtgagcttcgagagcggagtctcgctcgactcgaggccgaggcgcttcggcggcgccggagccacctcgaacgtgcgcgcctcgccgatctgctcgatcgtgtggtgtcgacgccgaggggagacggaccatgaccatggcgatccagagtgcggctccgcccgccgtggccgccatcgagcagctcgccagcaccctgtcagcggccgcgagcgcgcagggcgtcgcctcgttcgagtcgacgctcgccgcagcgctccaagccgagggccaggtgatctcggggaccgggaagagccagagcccaggatcggtgacgggggtggcccagcagccgagcgcgagcgtcgtgccgacgtcgaacgcaccggtcgacccgttcgctggtctcaccccggtgcccccgacgccaacggcccagaccctcgtctcgacggggggctcggcctccgagcgtgcgacggcgctcgcggccgcgaccggtgagatcggcgtaccgtacgtgtggggcggatcgtcgccggcgacggggttcgactgctcgggcctcgtccagtgggcgtacgctcaggcaggagtcgagctccctcgtacggctgccgagcagcagaccgtggggacgctcgttccctcgctcgccgcggcccagcctggagacttggtcttctatgggaacccggcctatcacgtcgcgatctatgccgggaacggcatggtggtgcaggcaccgatgaccggtgagaacgtcgagctcgccccggtcggtacgccgacggagattcgtgacccgacggccgtcgcaccgcagccgacggtgagtagtgccgtcgcgacgccgagcgacctcacggcgacgttccaggctgcgagtgcggcctatggcctgcccacagggatgctcgaggcggttgccgagaccgagtccaacttcaacccgaacgccgtgtcgtctgcaggcgcggaggggatcatgcagctcatgccccagacggcggcctcgctcggggtcaaccccttcgaccccacccaggccatctggggcgctgccaagctgctcgcgggcaagctcgcccacttcggttccgtgccgctcgcgctggctgcctacaacgcgggagacggcgcggtggaggcctacggcggtattccgccctacgcacagacgcagaactacgtccgcacggtgctctcgctgatgggaggtgaggccgatggctccggtcagagcactgccagcgcgtgagccgtcgacgggatcggcggtcgcgtcgtcgagtgcgagtccgtccgagtccgtcgcgggtgggttcgcggcgctcctcgcggccgcatcggaggtgggcatgccccaggcgaccgagaccccgacacgtgggggttcctcgggtcactcgtccgatgtcgagcacgggggggtaggaccggaggcgcgaggacgcgggcacgctgcggtgagggccgaaatcggtgcccctggcgaggcgagcaatgccagcacacgacacacgacccatcccgagggatcggaggcgaccgtgtcggcggctcgagcagccgtcgagggcgccatcctcgccgaaccggctggtgcggtgcggacgcacgcagcgtcgaacccgaagccagagcccgcgagcgcttctgcgtcactcgcgctcgttgctcaagctggcgtcgtcggggccacaggcgtcggcgccgaagccatccgggccgaagccatccgggccgaagccgtccgggtggcagcctctcccgcgcgtgcgccctcgctcgaggtcgctccggccgccgatgctcgtcgtggcgagcctgccggggcgccagcgagcgccaacacgaacgctcgacccgatggggcacctccgcacgacgctgggtcgctggtgtcgcaggacgtggtgtggccaagcgctgggccgcttgcggcggcggtcgctggtgccgagggatcgggcagcgcgcccatggccgtgtcggcgccgacgacggacgcccccgcagcgctgtccagcgccgtggccgctgccccccgagcgcacggcacgcgcgagcccgcgatcgccctcggcaccgccgacggcagagccggatcgagcatcgcctccgacttgcaagcggtcgggcgggcgccgaccgccgaagctgccggccagacgacggtcgcttcgaccggagcgagcggtgcggtctgggcggcgacgagcgtcgagctcggctccttcgtggtcgatggcgatgtgatcggaccgcccgtcgagccctcggcggtgccggcgatggtggacgggctggcacgcgctggcggtgcccaccgcgtcgtggtggtcttgtcgccgcccgagctcggtcgtctgcgcatcgtcgtgagcgaggcaccgggcgggaccgcggtgcaactgcaggtcgagaggccggccactcaggcgctcatcgagcacgcgctgggcggatatgccgatacgagtggctcggggtcccgggggggccagccgcacgcagaggacgcggcgccgccgtctcgggtcgcggtgtcggtgacgacgaaggcgacctcggttcgcgctcgtcgaggcgttcgagtcgatacgtggatctagcaggtcgacgagagaaggagtccagatgacaatggcagtgggtggtatcggagcaagcgccgccggcgctacgacgagcgcgtcgggtggactcgccagcctgaccgcgaacgagtttctcaacctcttggtcacggagctgcagaaccagaatccgctctctccgatggacccgtcgcagatggtctcacagacctcgtcgctgtcggaggtggagctcctctcgaccatccagagtgcgctcacccagatggcctcgagccaggggatcctcagcgcgagcagtctgatcggccagagcgtcacctatcaggacggctccggcgaggttgccggccaggtctccggcgtcgggcagagcgccaacggcgtcgtcctcgatgtcggtggccagagcgtgccgatcgcgaacgtcatcgccgtcggcatggtgccctcgggcgcctcggcgacgggatcgacgcagaccgggtcgacgacgtcgacgaccgggtcggtcggctgagccgccggacagcgtcgctcagtgggcgccacgaccaccatcgacacggaacacgatcaggacaccacacgatcaggacaccacacgatcaggacaccacacgatcaggacacaaggaggatcatcccatgaccaagtcgctctcgtctgcgatctccgggatcgaggcgaaccaggaatggctcgacaacatcgcgaataacatcgccaacgccaatacgaccggctatcagtcgacccagacggagttcgcagacctgctctatcagcagcagtcggcagccggcggaccggtgccgggccagaccggagggacgaatccactggtggtcggctccggtgtccgggtgtcggcgacgccaaccgacttctctcagggcacgatcgtgcaaaccggtacctccaccgacgtcgccatccagggccaaggcttcctcgtcgtcaaccagggtggccagaactactacacccgtgacggggcgctccagctcgacggcgctggtcagctcgtcacggcctcgggtgcgctcgtgatgggatgggtccccaacgcggccggtcaggtgaaccagaacgctccgctcgccgcgctcacgattccgcagggccaagttgcccagccggtcgccacgagcaccatcacgctcggtgggaacctcccggcaggttcgtccaacccggtcgtcgtgacgacgaccggctacgacgacctcggtaacccggtgccgattcagctcacctttacgccgtcgacgaccgccaaccagtggacactcacggccgagacgacgccgccgggcgcgacctcgcccgtggcgctgactgtcggcggcgcctcctcgcagacggtgaccttcgaccccgcgaccggacagatcagcgccatctccgggacctcgaccgcgaaccctgatcaactggcgctcggtgggttccccacgtcgtacgatctgccggctggctacgccatgaacctcgacttcccgacccctggcacggcacaagccgtgacccagttcgccgccagctctccaacggcccaggtgacgaaccagaacgggtacccatcgggagccctcgcaggcttcaccatcggctccgatggcgtgatcgagggcacctatgccaacggtcgcacccaggtgctcggccagatcgcactggcgcagttcgcgaacgcgcaggggctctccaagcagggcaacctcctgtacgcagcgacgaccaactccggtgcgccccagctcggatccccgggtgccgcgggtctgggccagctcgtcggaggtgcgctcgagtcgtcgaacgtctccatcggctccgaactgaccaacttggtcgtcgcacagaccgattaccaggccaatacgaaggtcgtccagacgacggccacggtgctccagagcttggtgcagatggcctagcggcgtcgggtcgcgcctgctgggtgcggcccggtcgccaaaggttcaggccggcaccaacggtgccgataccaacggtgcgcaaggaggtgctccgtgatcgaggtcacgcggtggtcaggatcgaccttggtactcaacgccgatgcgatcgagcgggtggaggcgacgccggacaccgtgatcacgctgttcggtggctcgacgtacgtcgtccgcgagacggtcgacgaggtcgtcgcggccgtggtggcctacaagtccgccgtgttcgcacccatcgcacccaccggcctcgtcgtgctcgacggcggggaggggtaggccatggacgtcgccacgccggtcgggatcgtcgtagccctcgtcgcgatcctcgtgtccatgatcatggatggaggcaatccggccgccctcatcgccccgtcggcgatgatcctcgtgctcgtgggcactgtcggcgtgtccctcgcgggccgtcgtctcaaggagatcggccagatcgtgggagcgctgcgctcggccatcctcgccaaggcgccgagcgcggaggagagcgttgggcaactcgtgcacttcgctgagatggcgcgccgagagggcgtgctcgctctcgaggccgccgcgaaggacctcacggaccccttcatgcgctcgggtatgcagctgatcatcgacggtgtcgagggcgacaagattcgagagatcctcgaggcagatctcgagggtatggggacgaggcatcgcgccggtgcgaagttcttcaaggacatggcgggattcgctccgaccctggggattctcgggacggtcatggggctcatccacgtgctcgccaacctctcgtcaccgcagacgctcggtccggcgatctcgggcgcgttcaccgcaaccctatggggcgtcatgacggcgaacgtgttctggctgccgatctcgaacaagcttgcgcatctgtcggagcaggagaacgcgctgcgtctgttggtcatcgacgggatccttgccatccaggctggtgcgtcaccgcgcctgctcgagcagcagctcctcagcttcctcgccccgacggcacgtgaggcgcaccgtacggccaaggagcgagccaagccgcagaagaaggcggcctagcgtggccagacgacatcacggcgagggcgaggccgagaactccgagcgatggctgctcacctactccgacatgatcacgctgctgctggcgctcttcgtggtgctgttcgccatgagctcgatctcggtgcgcaagttcgacgagttcaagaccgggttgttgcagaccttctcgcagatgcagctgcagagcttggagcacgggggacgcgggctgctccagcactcgtcactggtgacgcacccaggtctcacgccgggtcctccgcagatcaccatcccgcaaccaggcgcgggaactccgagcgagtcgcagatcgcccaagaggtgaaccaggcactcgcggcccaaggcctctcgcaagatgcccaggtcgtcgtggagcaacggggggtggtggtgcggatcttgtcggacaaggtgttcttcgcgacggactcagccgcactcggccccgtgggagacgccgtggtcgacgccatcgctggcgtcctgcgcacgctgccgaacgacgtgtccatcgagggctacaccgactccgagccgatcgtcggcggcccctacagttccaacttcgaactctcggcggtccgggcggtgacggtcctcgagcgactgtggaaggtcgacggcatcaaccccgaccgtctcagcgccacgggtttcggcgacacccatccgctggtgccgaacacgaccccccagaacatggccatgaaccgtcgcgtggacatcgtgatcttgagttcgaccacccaagccggcaaccgcatctagcgcgacccgacgagaaccaccggggtcacgaggaccccacgagacccaccaaggagggatatggcgacgacgaaggccaaggctgcccaggcagccgaggaggcgcaagcgcccaagaagggcaagaagcgcctcgtgctcatcgtgctcctcgtgctcatcgtgctggggggtggaggcggtgcctacgagttcctcctcgcgccccatcctgccaccaagcggcaccacggaccaccgctgccggggccgacctacacgttcccccagctcacgaccaacctcgacgacggccacatcgtgcagctccagatggtcctccagctcgcgagcggtgacacaaccgcggaggtcgcccacgacctcgacgagctcaacaatgcggccatcttgacgttcggccagatgagctacgggcaactgctgccgacggcgggccgggtggcggcggcgagcgccctcgaaggcgcgttcaaccacgtcctcgcgagtggcgcaccgccacacgacgaggtcgtcgggatcgagttcacctccttcatcgtgcagtaggcgccgcggcgccctggcaccaccgagcgcgaccgttggtcgacgctcaagttcgcgcgcctccgtccgatgccactgtcatgagtggggagaacgaggcgcgtgagcgccaggtgcgtactgtcgactttcgcctcccccacagcttcgaccgtgccgagcaacgaggactcgagctcctcgtcgagaacgcgctccgaccggctgcaaccttgatgggtgcgagcctgcgccgcggcgtgcggctcgagctcggtcggatggaccaacttccctgggagcaggtcgtcgcccaacaggacggcccagccctggtcatctcgttcgcgctggttccattgggatcgcgtggcgttctgcgcttcggagccgatgcggcccttcgcctgctcgatctgcggctcggcggtgacgggtcgccgatcgagccccgtgcgctcaccgaactcgagcagggactgctcgtccaggtcttctccgatctgctcgtccaactcgcctcgagtctgcagacgctgctcgacgtccgcttggatcgggtgggggcagagacgtccctcgagttcgtccaagtcatcagcccgggcgagatgtgcctggtcgtgccgatcgcgctgggcatcggtgacgaactcgagagcgagctcacgctctatctgccctattccatgctgcggcccgtcgtggagctcatcgcccagcgcgccatcgtggccgtcgatcgtggcggcgatacgttccgggatctgctcgccgctcgtctgcacgacgtccgcctcgaggtcagcgtccggttcgagccgacgtcgatcagttcgcgcacgctgctcgagcttgctcccggtgacgtcgtccccctcggccatcgccaaggacaaccggcctgggtcatcgtcgatcgcacgcggcttcatcgggccgtcatgggtcagtcgggctcgcgcgtcgccgccgtcatcatcgaggaggaggaagaggctcatgcctgaggtgcccgagacggccgcgaacctcgcggtccttcgcaacgtcgaactggagctcagcgtcgaactcggcagggcgcggatgcccgtgcgcgcgctgctcgcactcacgagtggcgacgtcatcgaactcgaccgtcacgccaacgccccggtcgacgtcctggtcaacggcaccctggtggccaagggcgaggtcgtggtggtcgacgacgagttcggggttcgcatcctcgaaatcatctcctccgacgaggtggaccagctgacccggggagcgtagcgaagatgggatcgatcgtcgaggccatcggcgcgctcgcgttggtggtcggcttgatcgtcgcatctggtcgcctcgcccagcgcggtcgtccggcgcgttcggtcggcatggctcgcctcgccgtcgtggctcgggcttcacttggatcgaagacctcgatcgtcatcgtcgaggccgacggacggcgattcctgctcggggtcgggccgcagggggcgagccgactggcgagcctcggtgcggcaccgccggccgatgcccccgagatcgagctcctcgacctgcgagatgtcgacgtggccttcccccctccaggttgacacctgctataggaggaagggatgagccagacaccgaacccaccaccgggcgacggccccgctggacgacgacgcggccgctacccgagccagttccgcaaggacgcggcagcgttggttctcgaccagcgccgcaccatcgctgacgtcgcccgtgagcttggcatcaacgagcagacccttggtaactgggtccgtcaggaacgcatcgaccgaggtgagcgagagggcctgacgagcgccgagcgcgaggagctgacacggctgcgccgccaggtcaagcagctcaccgtggaacgcgagctgctcaagcgagcgatggccttctgggtgaaggaggggggacagtgagccgctaccactggatctcccgccaggaggccaagggcttctctgtagcggcagcagcacgagtcatcggggtctctcgccaggcctactacgcctggcgacaccgtcgggaccgaggcgaggatcccgagcacctggtgctcgcgagcgagcttcgcgccatctggcacgagagcgacggcacctacggcagcccccgcatcacccacgagctgcgacggcgcgggttctgcgtgaaccacaagcgggtggaacgcctgatgcgcgagctcgagatggcagcgggcccacgccggcgcttcgtagtcacgacgaggcggggagaggacgcagcgctcccggacctcgtccgtcaggacttcgctcctggtgagccgaagcgcaggtatgtgagcgacatcacctacgtccgcaccgatgaggggttctgctatctcgccacggtggcagatcttggctcgaggcgcatcgtgggctggtcacttgggcgtcacatgcccgatgacctggtggtcgaggcgatccgcgaagcactcgggactcggggcagcctggctggggcgatctttcacagcgatcgcggcagccagtacctctcccggaaggtacggagcctgctcgcgacccttggcattcgccagtcggtggggagggtcgcgacctgctacgacaacgccgtggccgagtccttcttcgggagcttgaagcgcgagctggtggctcgctaccgcttcgcgaacctctcaggggctcgctctgccatcgctagctggattcaccgttacaacacggtccgcctgcactcaagcctcgggtacctaccgcccgtcgagtacgagctctcctgggcctgccgggaggtggccgtggcctaaattcagactgtcaagcaaatggggggaagcccaacgatccagaggccgccgtggtcgctgccttcgacgagccgccggtgcacgccggcggtgcgctcacggccctgctcgcggcgcttcgcacccgaggggttcgcccgtgagcggtctgctcctcgcggcgacgagcctgccgtcggccacgttgacggtgcatgcgggttcgacgccgaccgcgagcgtggtgatcatcctcgccctcaccgtgctctcgctcgccccgacactcctcgtgctcttcactggcttcgtggagatcgtcgtcgtgctctcgatcactcgtaatgccctcggtctctcgacgacgccgcccaatcaggtcctcgccggtctcgcgctcttcctctcgctcttcgtgatggcccccaccctcgggatcgtggagcaccaagccgtcctaccgtatctgcacggtcacatctctgccgttgtggcgttggatcgcgcggaagggccgatcaagctctggatgctgcgtcacacgcgaacgcaagaactcgcactgttcgatgtagtcacccaccacgccggggtcgcacctgccgcagcgccactcgatgccgtcgtgccggcgttcatcctgtccgagctccacagcgccttcgtgatgggcttcatcatctacgtgccgttcctcgtgatcgacctcgtggtctcgagcgtgctcatgagcctcggcatgatgatgctgccgccgacgctggtgtccttgcccttcaagctgctgctcttcgtgctcgtggacggttggacgctcgtcgcgcacgccctgctcgtctcgctccactgacaagggggttcaccagatgaacgatgctgctgtgctccagatcgcgcggacggccctcgaggtcgccacgctcgttgccggaccggtgctcgccgttgcgctccttgtcgggctcgtcgtcgcgctggcacagaccctgacccagatccaggaggcgaccctcagcttcgtgcccaagctcgctgccatcgccttggtcctgctcttcacggggcactggatgctccaggaactcacgacgatgacgacccagctctacagccagatcccccatctcgtgcagacgctctaaggacgagccgtgcagatcagcctccagctgggctccgtactcgcgttcttgatcgcgaccgcgcacgcgctcggcttcgtcgtcatcgccgcgccgttcgcgctcgcgacggtgccgcgcacggctcaactcgcgctcgcggtggggatgggcatggctggcgcagcgatccacaccgccttgccggcgacgacgccagcgctcatcggccagctcgcctgggcagcagcgaccggtgcattgatcggattcgtggcgctcgctgcgatcagcatcggatcgcaggcggggagcttcatcggcttgctgggtggcttcgtcacgcctccctcgctcacgccgctcgcgttcggcgaggtcccggtcaccggcgacctctacggcatgatctgggcggtgctgttcttcgtctccggcgccgacgtcgtcgtgctccgcgggttctatctcgcgagcgacgcgagcgtccatctggccaacacggccaccgtcatcgtgcagtcggtgacgctcacctttgcggccggcctggaggtggccgcaccggtcatcgcggtcatgttcttcgcccagatcgtggcggcggtcctcacgaaggtcgcgccgcagctccagccgctcggcttcttgttcccgctcgagattctgttgtcgctcatcatgatggtcgtctcgctgcccgtcatcccgcacctcttcgacgctggggtgcgtctcctgctcgctgccgagcgtgatctcggggcctgaagatggcgcgccaggagggcaccgaagagccaaccccgcgaaagctcgagcgggcgcgcaaggaggggatggtcgcgcgctcggtcgacctcgtctcgttcgtcgtgctcctcatcgcgtcgttcgccctcccgctcgccgtgcgcgatgcgagcgtgcgcatcggcgacgtcgcggccgcagcgtggtcgggcgcgatccccgccacgagcgccggggcgttgcgctttctcggcaccggtctcgatctcgtggtccaactggtcgggccggtcgccgtcgttgcggtggtcatcgtcgcggtcgggaaccttgcccaggtcgggctgcgcttcgtcccgaagcgactccgaccacgcgccgagaccttctcgcccgcggccaacctgcgtcggatcttctcggcccaacccgggatcgaggtcgccaaggcgatcgtcaagctcgtcgcgacggcggccgtcgcggctgccatcgtctccagcagcatcgacgccatggctcagggtgcatcctcaccgcttgcggcggcggatgccgccgctggtgcctctctcgagctggtccgtgtcgtcgcggtcctcggggtcgtcctcggcatcgtcgacctcgtgcgccagcgtcggtcgctgcggcgcaggctgcggatgacccgccacgaggtacgtgacgagttgcgcgagcacgaaggagatctcgccgtcaaggcacgccgccggcgcttggcgcgtgagttcgttcgacgggccatgctcgccgacgtcgcccaagccgacgtggttgtggtcaatccgacgcacgtggccgtcgcgctgcgttacgaccctcgccgtgatcgtgctccgaccgtcgtcgctaagggcctcgatcacttggcgatgaccatacgcgagcgtgcgcgtgccgctcgggtgccgatcgtcgaggaccccccgctcgcgcgcgtcgtctacgtcgcctctcgtgtcggagagccgatccctgcatcgctgttcctcgtcgtcgcgaggctcctcgcgttcgtctatcgactgccgtcgctggcgcgctcgttcgactcacgccacgtgacccgttccgacgacattccggtcgatctcgccgctcgggcctggagtctgctcgccgacgagatcgatactcaaggcgacgtgcacgcgggccgagaacgctagcgaggcgcacggaggcgccgtggaagccacggtgggcagcgacgaaggggaggcccgtggactcgacgaggctccggcgcatggcgctcgccgtgccggtcggcatcgcggtcatcgtgatcatgctggtcgtgccgatgccgtcgcagctcctcgacgtcttgatcacggccaacttgaccttcgcgttgatcgtgctgggactgacgctgcgcgtgcgagatcccctcgacttttcggcgttcccctcggtcctgctggtggccaccatgttccggctcgcgctgaacgtgtccgcgacccgtctggtcctgctgcacgcctatgcgggcagcgtgatcgaggccttcggccacttcgtcgtcggcgggtcggtcgtcgtcggactcgtggtcttcgccatcttgttcatcatccagttcgtggtcatcacgaacggtgccggtcgcgtcgcggaggtgggggcgcgcttcacgttggacgctatgccgggcaagcagatggcgatcgacgcggatctgaacgccggtcacatctcggaagccgaggcacgtgcacgtcgggcgcgcatcgctcgcgaggcggacttctacggggcgatggacggcgcctcgaagttcgtcaagggtgatgccgtcgcggccgccgtcatcaccttgatcaacctcattggcggcttcatcgtgggcatcgtggagcaccatctctcggtctcgcagtcgatcgacacgtactcgctcctgtcggtcggtgacggcctggtcagccagatcccggcactcttgctctcgatctcgacgggcctcatggtgactcggagcgcgaacgacgcggacttcggcctcgacctcctgcgccagatcgcccacgagcccgtggccatccaactcgctgggggggtgatcggcgcgctcggtctcttgccggggctccccatggtgccgttcgtcctggtcggtggctcggtcttcgcggtcgggtggcggcttcggtcgaggagcgcgtcgcacgtggggagcggcgacgagcccgtcgtcaccgagtcagaagccgtgccggacgcgctcgcggccgacgtcgtcggcgtcgagctcctcgagctccagctcggcttcgagctcctcgacgtcctcgatccggctcgaggcggggacctgctgacgcgggtgaagggcctgcggcgcaagctcgccggggagttgggcttcctcctgccaccggtgcgtacccacgactccttggacgtcggtccggacgagtatcggatcctcatccaagatcaggtcgtcggtacgggtcggattcccagagggcgtgtcctcgccatgggccagggcctcgagtccttaccgggggaggccgccgtcgatccggtgttcggtcttgcagcgtgctggatccccccggaggccaagacgcaagcccaggtgctcggcgcgacggtcgtcgaccgatcgtcggtgatcgtgacgcacctcgccgaggtggtccggcgccacgctgacgagcttctcacgcgccagcaggtcaaagagatgctcgatgcgctccgccaggcagcgccggtggtggtcgacgagctggtgtcgtcgcagctcccactcggtgagctccagcgagtccttcgcgacctgctcgccgagcgggtgccggtgcgcaacctcgccgccatcgtggaggcggtcgtcgatcgcgcgcgtcagacacacgagcccgacgcgctgctcgaggctgcacgcgaggcgctcggcggtgccatcgggacgcgctttgcgaccggcggcaagctgccggtcgcctacctcgtgcccgagctcgagcttcgcctcgtggaatcgctcgtgagcgtcgacggacgccggagtctcggcatcgcccacgaggagctccgagcactgcgtgccgaggtcgccgaggccaagcagcgcgccgaggcacaggggctcgacctcgtgctcgtcacgatgggagcgatccgtcggccgctgtgggcggtccttgcccgtacgccggcggagctccccgtgctcgcgctcggtgagatcggttcgtcggttgatgtcgttcagatgggggtgatcggtggtgtccagcaaccagcggcgctttagtggtcagacagcggcagaagcggtcgcggctgcgcgcgcggccctcggcccagacgcgaggatcgtggcggccgagcgggtttccaagcccggcctactcgggcgcaagcgccacgtggtcgtcacggccgaaccgatgccggtgacgagcgcccgggactttgccaaggagctgtcacgtcagctcgcggctcgggaagcggaggcgcccgccgaggacctcgagatcctggcgacggcgtacgagcaggccaagagcgagccgcctcaggtcgtggtcgcgcccatcgggcgacgcgaggcggtggtggtcggttcgggcggtgagacgcgtccgctcggctcggtcgagcgcccgcagtggtcgcagctcggtgacgtagcgagcgcagccgtgcgtgccgtcatcgacgaacgcacgactcacctgaccgtcgacctgagcgctgacggtggcgacgtggtggtcgacgtgagcgcaccggtggccgagcgcaccatcgcccccgagggctcgcgggtgatcgcggtgtgcgccccgagcgtgccgtatccgttggcggcgttcgatgcggtcgccgatcgcgtcggggtcggcgacgccgatcggttcgtgctcgctcagcgtcggcgcgagatcccactcggactgcgcagtccagctgatcgggtggcgcgagcggtcgcgagtggacagcgacgcgtcgcggtgctcgtggatccaggtcagctcgcgctcttgcgtagctcgtttctcgccccgctcacgtgggtggtcgtcgcggtgtcgggagacgagcctgcctgcgacctcgaggtggaactcgcggcttgtgggccgatcgacgcgctccactgcgtgcgctcggagcgtgccgccgtcgagctgggccttgcggtggtggcgtagccatgcgtcttccgtggcgggtctggctctcggtcatctcggctgcgctcgttgcgacacccagcgtcatccaagccgaccacggctacacgagctgggccaacgtcctcgagcacttcctggtcgccttggtcgtgctctggatcgcctactccgtgctggcaacggtgatcgcatggtacgaactcgaggggatggtgcgacgtcggcaggcgcgccaggccgcgatggagcaggcgcagcaggcggcaccacggactcctcagtcctgatcgacgaggaggatccgaacgacgtacgacccgtgctcgtggcacgggtcgtacgtcgtttcggcgatggcgtcgagcgcgattcaggcgacgttctcccggctgccgttcagcgttggcttgcccgcgcggatccaggcgttggtgccaccgcggacactgacggcgcgcagaccgctgccggcgaggagttgggcggcggcgtagctgcgcgatccgctcgcgcagatcacgtggacgtccttgtcgcggggcagttcatggatgcggcggggcaggtggctgagcgggatgttcttcgcccccgggacgtgacccgactcatattcccaaggatcgcgcacgtcgacgacgaaggcaccatcctggtgggccgcggcgaagtgatggatgtcgatctcgcggatcatcggtcctcccgtagtatcacgacaattatgtgatgcttcaggttgtcaaccctgatgatgacagtatataccccatggggtactgaggcgaccagtccggcccacgtcatgtgtgcgatcgatcgacgcccacgacgcaaccagccgggaccacggtcccggctggttggaggtacgcgttgtggggtgaggtctggtgctacggcagctgcgcgagggcgcgctcctccttgaagaggaagtagcgctcgaggaaccgcttcgtgatgtcgtagaaggggttcgggagcatgaactcgacctgccgcggcttgaagaacttgttggcgtacatgatcacttctttgtgccccgcgtccagtacgcacacgcccgggatgtcgcggaagggtcgctgctcgaggtccgtccgtccggtcgccaagcggccgacgttcttgccgacgagcttgccctcgatgtcggccgggaagcccgtcttcgggatgccgagcggcacctgactggtgaagggcttctccacgtcgatcgccacgcccgcagaaaagatgttcgggtagtcggggtgctggaatgcgccgttgaccgggatgaaacccgctgcgttcccgatgcccgcacccgagttcaagatcacgtcctgtccgctgaaggccggcatgatcatggtgaacttcgaggggagctgggtcccgtcggcgagggtgacgccctcgtcgctcacggatgcgatcgccgtgttctcgtagagccggatgccctggcgatggagcaggcccttcaggagccgctcgccgcctcggatgccatccatgccgaaatgacccgcgtagggttcaggtgtgacccaggtcacgtcgacgcggtcgcgaacgccgtggacgcgcaggtagtagtccaagttgaagaggaactcgtaggcggctccgatgcagctggcaccaggagcggcaccgacgacgaccgggcccggatcggcgacgagccgatcgaagtcttcacgcgtctgcatgatgagctcggggtcgtggacggcgtggttgaagccgagcttcgggtcggacccttcgagcttcgagtagtcgaacttcgggcccgtcgcgatcacgaggtagtcgtagggctcctcgccacgagtggtgctcaccacctggcgctcggggtcgatgtgggtcgcctcggcctggctgaaggcgacgtcgcgcttggcgaggatcttgggaaccggccgggtgatctgcgacacctcacgctcacggaagggaacccagatcatcgaggggacgtacaagaagtagtcggtcttcgagaccaccttgacctcgacgtcgcggccgcgggtatgtcgcttggcctcgagggccgacgtcagaccggcgaagttgccaccgagaacgagtactcgctccactgcgaacctcctttgcgcactgagtcagtatgggcgcgctggagcgcccccgaccagggaagaggtgcccgtccttgagggaccttcgtcccgaacggacgtcgaggtgccggtaggatgggggtgtggcgagcgtctatgagctggatcgtgcggcggtgcgtgcgctcgttccctggccggactggcgtatcgagcagctgtttcacgggctctaccacgaggggcagcgactcgaggcgatctcgacgctgccggctcggatgcgagccgagctcgcgagccacctcgatccgggcctcactgagcgtcggcgtgagcacgccgacgacggtgagacggtcaagttcgcgctggaggctgccgacggggcgctcgtcgagacggtcgtcatgcagtcggcgcgtcgcatcagcgtgtgcgtctcgagtcaggccggttgcgcgatgggctgtcgtttctgcgccacagggcaggccgggttcgtgcggcacctcggggtcggggagatcgtcgagcagctcgcgatcgcgcagcgttcggtacgcccgcgacgtctcacgcacgtggtcttcatggggatgggcgagccgctcgcgaacgcctcggtggcgatcgaggccattcgacgcatccgcgctgacttcggcatcagccctcggcgcgtcacggtgtccacggtcgggatcgtgccggggatccgacgccttgcgcacgcagatctcggcgtcacgctcgccgtgtcgctgcatgcggccaacgacgccgcacgaagcgacctcgtgcccatgaaccggcgctacggcatcgacgccgtgctcgatgccgcgcaggagttctccgagctcaccgggcggcgcgtcacgctcgagtgggcgctcatcgccggcgtgaacgatcgcgaccgtgacgccactgagctcgccgggcacgcacgtcggctcgccgctcacgtcaacctcatcccgctgaaccccacaccgggctacccgatggtgggcaccgatcccgacggcgtcgcgcgctttgcgcgccggcttcgctcgctcggtgtcaacgtgacggttcgcgacacgcgggggcgatccatcgatgcagcctgcggacagctcgccgccgacgtcgctcgcggcggcccggccggcgccagcgcggtgcgcttcgcacggcgcatggtctcggcctgagatcccccgaccgatcacccctggcgggggaggctccaagcgtcggagaggctaggttcctaggtgcctcgataggcctcgcttcgaaggagcgcgcatgacgaagcttgagatcgcgccctccatcctccctgctgacttcggccagctcggcccgacgctccaggacctccaggctgctggcgtcgaccgtgtgcactgggatgtgatggacggcgtcttcgtgcccaatctcaccgttggcgccccggtgatcgagagttgccgccgctggagcgacctcccgttcgaggcgcacctgatgatcgtcgaccccgaccgccacgtcgagtcgttcgtgcgggccgggtgcgagctcgtcatcattcacgccgaggcgacggcccacttgcatcggagccttgggctgatccgcagccttggtgctcgcgctggcgtggccctgaacccgtcgaccccgccgtcggcgatcgagtacgtcatggatctgctcgatgtcatcctcgtcatgacggtcaatcccggtttcgggggccagcgctacctggcgagcgtcgagccgaagatcgcatcgctcgccgcactgcgtgacctcacgaacccgaccaccaggatcgaggtggacggcggcgttgcccctgacacgctggcgggggtcgtcgagaacgggggcgagatcgtcgtgtcgggctctgcgctcttcgcacatccaggcgggctccgagctggcgtcgaggcgtttcatgcgatcgcagaggaggcaaggaagtgaccacgactgtcgagcagcgagccatcaccacggtccggatgctctcgatcgaccaggtcgaggcggcgaactcgggccatcctggccttcccctcggactctcgccggtcgccgtcacgatctttgcgcgcttgatgcggttcgatccgacagatccggcctggcccaaccgcgaccggttcgtcctgtccgctggtcacggctcggcgatgctgtactcactgctccacctgttcggtttcgacctaccgatggatgagctgcgccgtttccggcagctcaactcgcgcacgcccggacaccccgagtacggccacaccgcaggggtcgaggtcacgaccgggccgctcgggcagggcttcgcgaccgcggtcgggctcgcgctcgcagaacagctgcagcgtcacgagacggagcagcgcttcggtgaggcgctcatcgaccatcacaccttcgtgctcgcgtccgacggcgacctcatggaggggatcagccacgaggcggcgtcactcgcgggccatctcgggctgggtcggctcatcgtggggtacgactcgaacgacatcaccatcgacgggcccgcgcacatctcgtgcactgacgatgtgcgcgagcgcttccgtggctacgggtggcaggtcctctcggtcgaggacaccgaagacccggacgccatcgaggcggtctatcgggtcgcgatggccgacgagtcccgcccgagcctcatcatccttcccacgctgatcgggcgcggggccccaaccaagcagggaacgtcgaaggtgcacggtgccgccctcggacccgacgagtatcgggcgaccaaggagttctatggctggcccgtcgacgaggcgttcgtcgtccccgatgacgtgcgcgcatgggccgacgaggtggtcgccgccaagcgtgaggtggctaccaagtggcgcgaacgggctcgtgaggtgggctacgaggcgccctccatccacctcgacccgcaggtcctcgaggcgctcgagttcccggaggtcgatcctgcgaaggccgtcgcgtcccgcgtggcgagccagcacgtgctcgagcgggccatggtggcgatcccgacgctggtcggaggatcggcggatctcgccgagtccaccgggaccaagcttgcgttgcccgtcatcgatcgcgagcatccgctcggacgcatcgtccacttcggcatccgtgagcacgccatggccgcatgtgccaacggccttgcgctctcgggcttgcgcccatgggtcgcgacgttcctcgtgttctccgactatctgcggccaagttttcgtctgtcggcgatcatgggtctcccggtcatctatctgttcacgcacgactccatcggcgtgggcgaggatggaccgacgcaccagccgatcgagcaggtcgaggcgctgaggatcatcccgaacagcgcggtggtacgaccagccgacgccttcgaaaccaacgaggcgtgggcagcggcgctcgcccacacgagcggtcccattgcgttgatcttgactcgccagggtcttgcgcccatgccgaccgcggacgagcctgggtggctcgagcgccgtggtgctcggatcgtgtacggcgccgacgtcgaccgacctgatgtggttctcgtcgcctcggggtcggaggtcaacctgtgcgtcgaggccgcgcacgcgctcctcgaggaggaggggatcgtggcgcgggtcgtctccgtgccgtggcgcgagcgcttcctcgccatcgacgagcaggagcgagaggagctcgcgccgtcggggattccacgcctgatcgtcgaggcgagcgtcgcgaccggatgggaggccttcctccagccgggggaccgcctctacaacatcactcgcttcgggctgtcggctccgatcaaggacgtgcagcgagcgctcggctttaccgcctccgacgtcgccgacgccgccgcagagctcgtcgtggacggttcgttcttgcgtcgtccggtccacctcgtctccgagctcctcgctgcgacggaggccgctgcggttgcgacccaggacctcgtcggcgatggcgatcgctcggcagcagaccaagccgcggtctcggccatgcgtcgagcgctcggtgcgctccctgcgcgggccaccgtgatcgtgggtgagggggagaaggaccgagcccccatgctctacgtgggcgagcgacttggctctggttcggtcgcggtcgatctcgcggtcgacccgttggaggggacgacgtacgcggcgaccggccgggagggtgccgtctcggtgctcgctgcggcgcccaatcgcggcctgcaccccttgccaggctggtacatggagaagctcgtggtaccggccgaggccgcgggagtcgtcgacatcgaggcaccgctcgtcgagaacgttcgacgcgtggcgcaccgtctcggacttgccatctcggagaccccggtggtcgtcctcgccaagccacgccacgaggcggccatccgagagctgcgggccgcgcgggttccggtcgtcgagatcccagacggggatgtgatggcgagcctgcgcgtgctcaccggcgatccccgtatgcgcatgctgtggggtatcggtggcacgccagagggcgtcatcaccgccgcagccgccttggcgctggccggccagatgcaggcccgcctccgcccgcagagcgacgaggagcgatcgatcctcgacgcatggaagcccgattgggaggagcttcgcttcgaggcgagcgacctcgctcatcctgaatcggtcgtcgtcgcctcgtccgtaaccggggcgaccccgcttgtgccaccgatgccgcatgcggatggtttcgtgatcgaaagcctctggatcgagccgggacagttcggcacggtccggcgggtcgtgagcctccggggggaggaggacgcatgatcgatgttgtgcgaaaggaaccgtcaatgtcccatcgagtggccgccatccagaaggcgacggcgcgaggagcgcatccgacgcgcgtgacgatgctcgcgatcgccggagactccgcttctggcaagacgaccctgacgaagggcatcacccaggcgctcggcgccgagcgtatcgcgtcgttctgcaccgatgattatcaccgctacgaccgggaggagcggcgtggactcccgttcacgccgctgcatcccgagtgcaactacctcgacattctcgagcagcatctccagctcttgaccctcggacaatcggtgttgaagccggtgtaccaccattcgacgggcacgctgggtcggccggtgctcttcgagcccaaggagatcgtcatcgtcgagggtctgttcccactgtggtcgaagctgtcgcgggccacgttcgacgtcaccgtcttcttggacccaccagaggaggtccggcgtcgctggaagatccagcgcgacacgggcaagcgtggctacagcgaggaccaagtgctcgccgagctcgagcgtcgcgagcccgagtcggacgcttatatccgtccgcagcgtcgcaacgcagacatcgtgatttcgttcgctccggttgcgggccggaccggcggagacgagacgatgagcgcgaccatcttgctgcgtccgacgatcccgcaccccgacctgtcgtcggtgctcacgggcgacacgcgtgagtcggtccacctgaagctgattcgtgaccaagacggcaagccggtggatgccctccacgtccacggccatgctccgaccgaggtgacccaggtcgtcgaggaggtgctctgggaccacatcgggctcccagggccgatccccgaaccgctcggggtcatcggaccgggcaagcgctcggcgtcactggcgatcgcgcagctgctcctcatctaccacctgatccacgcatagccgggtcgggcgtgtcctactccgaggcgtcgcgcgcctcggagtcggcagaccgccagctcaccgagctcacggcgggttcgaggctgaggcgagagatggcttgttccacggcgaggtcgtcctggccttcggcgacgaggtctgcctcgacgagcacgaggccgggctcatgacgcagctcctggctgcgcacgccgcggagccgaaacgcgccggctgaggctgcttgggtgatgagcgcccggatgtgggcttcggctggctcttgacagacgaccgagagcgtccactcgaagcgcacctcttcggcctcgcgctgcggacgtcggtcgagggtgcgggcgagcggccgtagcccgacgtgggctgcgaggaccgtgagcgcagccagcagcgccaacatgaggtagccagtgcccgtgagggcgccgatggcggccgcgcaccagatcgtggctgcggtgttgatgccgcgcacgttcacgccatcgcggatgatgacgccggcaccgaggaacccgatgcccgagacgatgtaggcggtgaccctcgtgaagtccaccgattcgtgtgccgtcgcggcgatggggctggtggcaaggagcagcgagagctgttcgaagagggcggcgccgagcgccacgagggcgttcgtgcgtagccctgccatgcgcgagcgccactggcgttcggcaccgacgatcgcaccgaacagcgcagcgaggacggagcgcacgaggaaggtccaggtcacccctgggacgaggggagcggcgaggtggcgcatgagggcctcccgaggttgcggtcgggggtagtccaccggtcgagagtgaccacgagctgaacgaaaccttgcgaggcgttgacaatgcgactgcccgtgcggaacaggtcgctgtgttgtctcgtcgatcaccgacacggcagtggtgcaccgtggtccgtgctcctgcggggcggtgctcgtgaacggttcctgcgagcgatgctgaaagcgtttgcatgtcgttcacgtaagcgctatcatctggcctacgttcgctggtatgcgaaccggggaacttggtgggggtcgtcggtcgtgcggtgtgatcagggcgctgggatcgcgcgatgagcgctgctcgcgcgacgatcttcgatgtcgcagccgaagccggcgtgtcggtcgcgagcgtctcccgggcgctgcgcgacattcctggcgtacgtccggagctacgagcgcacattcgtcagatcgccgagcgactcgggtacgtgccgagtgccccggccgcgtcgctggcgtcgcggcgcctcggtgcgatcggcttggtcttcccggacctcgatgatccgtcggtcgacccagggctcgacgaggatcaagagggtcggctctatgccgacgaggtgattcgcggagccgagcgcgctgcacgttcccacggggtcgcgctcctcgtcgccgctacccatcagcgcgaggccgccgagctcgtgcgtttcgtctctgctcgtgtcgacggcatggtgatgctctcacgggtgctcgccgacgtcgaggtccgggccttggcggagcgggttccgctcgtgcagctcgccgggcggagtcggttgcggggggcggacgtggtccgagtcgacaacgagcggggcatcgaggagatcacgcggcatctgctcgtcgatcacggctacgccgacgtccggttcgtcggaggtccggttcgctcgccggatgctcgcagtcgtcttgaggccttccagcgcacggtacggatgctcgggcgcgacgatctggccgagccgatcgcgcgcggagactttcgcgagtcaagcggctggtccatcgcgtccacgctgctcgaacgcggccccgtgccacgtgcgctggtggtggggaacgaccagatggctgtcgcgatcgtgctcgccctccggaacgcgggcctgcgcgtccccgacgacgttgcggtgaccggcttcgacgatacgcagctcgcgcgcctgacctatcccggcctgacgaccgtgcgccagccgatgcgtgacctgggaaggctcagtgtcgagctcctcatcgatcggatcgaaggtcgagccgcgccaggccgcatgatcacgctcccgaccgaggtcgtgcgacggcgtagctgtgggtgcacgtcggcgtcgtggcccggagaactcgtcgcacccagcggtgcagcggagccggtgacgagcacggtcgggacggcgatgagaggagcccagtgaaagcccacggagagcagcaggacgcgacccgggcggtactcgagcgctgggaggagggaactcgtgagcgacgtgtcgacgagcacgttggtcaccttcctcccccgacgggcgtcgaggcctggcgtggctcgggctgcgtcaccatcacatggcagcgtgtcgagggtgcggtgtgctatctcgtcgagcgggcgccgagtccggacggtccgtggacggtgcttcggcgcgccgagcacgacctcgtcgaagtcgctgggcctccaacgctggacacgagccgggaggcgggcggttggtaccgggtggcggcactcgaagatgtgggtcgtcgtccgacgtcgttctccgatccggtcgaggcgcgcgatggcgaccgcagcgcagcggtgacggtacgggtcgaggcgtcgtccccggtcggctcactcgcgcccgtgtggtggatggtgggctccgagcggccagggcagctgctccttcgcgacgacggcttcggtcatgacgttcgggccgaggtgctcgaggcctatcgccgggccgcggcgatcggcgtgacgcacgttcgggcgcactgctggctcgatgacgcctttgggatggtggacgcgtctggtcgcctgaccgagacgagcgcgctcgacgaggtgctcgatctcgtgctcgccagtggtcttcgcccgatcgtggagctgtcctttacgccatcatccctggccacggatccagcggcaaccgtgttcacctatcgggccaacgtgtcgcctcccgctgacctcgttcgctacggcgaactcgtggcgcaggtggtgcgccacatgatcgagcgctacggcgccgacgaagtccgcgagtgggcgttcgaggtgtggaacgagcccaacttggccgtcttctggaccggcgacatggctgcctacttcgcactgtacgaccgggtcgcgagggcggtgaaggaggtggatccggcgctacgtgtgggaggccccgcaaccgcgggaagcgggtggatcgcgccgttcctcgacttcgtccacgagaccgatgcgccgttggacttcctgtcgacgcacacctatggcggtatgcctctcgacctgcgtgcccagcttgcgcgcgtcggtcggggggacgtccccgtgtggtggaccgagtggggcgtgtcgccgacgcaccacgcgcgggtcaacgacggggcctttggtgcgcccttcgtggtgcgcggcatgaaggcagcacagcagatcgcagctgccctctcgtattgggtggtgagcgaccacttcgaggagctcggcaggccggaacgcctcgccgcgggaggtttcgggctgttgacggtcggcaaccttccgaagtcgcgctggcacgcgctcagtctcgtcgctgagctgccttctcgaatcgtggcgaccgaggtggagggcgacggtgctggagcactcgtggacgggtgggcgggtgccgatgcggagcgggtcgacgttctcgtgtggaacggctcgcacgatgcggccgacgccgagggtcgcggtgacctcgatcggacggtgactgtgacgctcgaagggctcgaggacggcgagtggctgctcgagctcacgcgcgtcgatcgggatcacgcttcgttcctcgaggcgatcgcgggtgaggacccatggcctgggcccgaggccacggcggccctccgggagcgcgcggcgctgcgggtcgagccggctggccgaacctccgtcgtcgacggggggcgcatcgagatgaccgtgcgcgtgccgatgcccgggttggtgcggctcagggcacgccgcgcgaggagttgggaggcctgagggtcgaccaacgcgagggccagggcccgcggcgaacggcgtaagagtttcgaccgcgggacctggcgtgggatagacaaagggggatcatagtgagtggacaggtagctcgctggaggactggtcggcgatcgcggccgatccagggattgatggtggggctcgcgggcgccgcggtgctcgcggcgtgtgggtcggcatcgacgtcgtcggcgtcctcgacgacgaaggtgtcgccgacgctcaccatcggggtcgacaacggctcgccgaccctgcaggacgatttcaatccgttctcgggcaaccagcgcatcggcacgacctacatgtacgagccgctggcctgggtcaacccgctgcaagggacgacggtcccgctgctggcggcgtccgagcacttcaccaacccgaccacactcgtcgtcacgctgcgcagtggaatgaagtggtcgaacggagcgccgatcacgccagcggacgtggtgttcacgttcgacatgctcaagcagtacccggccctcgacggtgcggggatctgggatcacgtgtcgtccgtgacctcgagcggctcgacgatcaccttcacgttcaccgcaccggatgtgccgttcgcccagtcgatcctcgagacgccgatcgtgccgaagtcggtgtggtcgtcggtgtcgaatccggtgacgttcaccaacacgaacccggtggtctcggggcccttcgtgctgaagtcgttcaatccgaacgagtacgtgctcgcgaagaatcccgacttctgggacgcatcgtccgtcgaggtcaagaccatcaacttcccagcgttgacgggcaaccagacctcccagctgacgctcgcacaggggggctacgattgggcgacgctcttcatcccggatgtccagaaggtgtgggtcgccaaggatccggcaaccaacaagtactggttcccgagcggcggtgagatcaccctcttcttgaacctcgcgaaggcgcctttctcctccgtcgcgttccgccagggcatctcggcggctctcgatcgttccacgatcgcgacgaaggcagaggacggctacgtgccggttgcaagccagacgggactcttgctgcccaacctgaagcagtggctcgatcccgcgatccccaacagcggctacgtgagctacgacccaacggcggcgctcgccgacttcgcgaaggctggctaccacctcagcggcggcaagctgaccggtccgagtggtgccgtctccatgtcgatcatcgtcccgaacggcttctctgactggatcgaggcagcccaggtgatcagccaagagctggcgaaggtgggcatctccgtgacgctccagacgccggagtacgccgcctacgcgagcgacctgtccacggggtcgtttaccggagccatcggtgccttcggcggtacgggcaacccgtacaacgacctccacggcctgctcgcggcgtcgctcgccgcaccgctcggacagacggcggcctcgaactacgagcggtgggtcaatccgacgacggagacctatctgcacgcgctggctgccgcggtcacgacgagcgcgcagcgcaacgccgtctacgggctcgagcaacagatggtgaacgatgtcccggtcgtggtgctctaccaaggggcgatctggagcgagttctcgacgaagaacttcgtcggctggccgtcggcccaggacccgtacgcgccaccgcagccctacggtcaagcgccgctggtcatcatgacgcacctcaggcttcgttagtcgtgttcccctggggccgccaccgacctcggtggcggccccctcccgaggaggtagctcgtgcgctacgtcgtgcgcaggctcgtcatcttcgtactgacgctctgggtcgccctcacgctgaactttctcatccctcgcctcatgccgggcaacccagctcaggcagcgctcgccaagttggcggctcgcggaccggtgagccctaccgagctccacgccatcgagctcaccctcgggttgccccatggctcgttgctctcgcagtacggtgggtacctcgttgccctcgcgcatggacaccttggcgtctcttacacgttcttcccggagtccgttcgctccctgatcgctcaagctctgccctggacccttggcctcgtcggtacgaccactgtgttggcgttcgtcgtcggcaccttgctcggtgtgcttgcggcctggcgccgaggcggcatcatcgacaccgtcgccaccgtcggctcgacgttcaccgcggccttcccgtacttctggaccgcgctcctcgcgctctacgtgctcggtttcgtgctgggctggttcccgatccgaggtggctacgcctccacgctcagcccgacctggagcctcggtttcatcgtcgacgcggcctaccatgcgatcctgccggccgcgacgatcctcgtctcgagtcttggcggctggttgctcggcatgcgcaacaccatgatcccgaccctcggtgaggactacgtcacgttcgccgaggccaacgggattccctcgcggacggtggcactgcgctacgccgcgcgcaacgcgatcttgccgaacgtgaccggcttcggcctcgcgctcgggttcgtcgtgtcggggtcgttgctgaccgaggtggtgttcggctatccgggcgtgggatcgttgctctacaacgccgtcgtgaacgaggattacccgctgatgcagggcctgttcctcgtcatcacggtgagcgtgttggtcgccaacctgatcgtggacctgctctacggcgtgctcgatccgcgggtgcgccgatgagcacgcccgtgacgagcgcgccggcaccggctggggcagaggctgcggctccggtgcagtcggggtcgagggcgcgagcttctctcgcgcggatcgtcggggcgctctggtcgaacgtgcgagctcggatcggcatcgtcatcctcctcgccttcgtgctcatggcgctcgccgcaccgctgatcgcgccctactccccgacggcgacgtcgtttgccgactccctgcccccgagcgctgcgcatctgctcggcaccacctcgagcggccaggacgccctctcgcagctgctctacggagcgcgtacctcggtgctcgtggccttcgccgccggcggcatctccaccgtcgtcgccatcgtggtcggactgatcgctgggttctcgcgcgggatcgtggacgagaccctgagcttcgtgatgaacgtgatgctcgtcatccccgggcttccgctcatgatcgtcatcaccgcctacctgccgggtcgaggtcccggtgtgatcatcgcggtcatcgccctcaccgggtgggcgtggggagcgcgcgtgctccgaagtcaggcgaagtcggtgagcgcccgtgacttcgtgctcgctgcacgcctggccggagattcgtcctggcgcatcgtgttccgcgagatcctccccaacatgacgtcgctcatcgcggcgagcttcttcggcgcggcgaccgccgcggtgctcgccgaggccggactcgagttcctcgggctcggcaatccgaacgccgtgagttgggggacgatgctctactgggcggagaactccaatgcgttgctgacgggccagtggggcgtcatcgtcggtccgggtctgtgcatcgcactcctggcctcctcgctgtcgctcatcaacttcggtgtcgatgcgctctcgaatccccggctgagggagcgcgcatgagcttgctcgaggttcgcgatctcgtcgtcgattaccgcatgggcacgaccgtcgtgcacgcgctccgaggcgtctcgctcgaggtcgacgagggccagttcatcggcgtcgtcggtgagtcgggctgtggcaagagcacgctcggcaccgcggtcgtcggtgtgctcggtccccctggcttcatcgtcggtgggtcgatccgcttccgcggtgtcgaactcgtgggtctcgacgccgcccagcggcgggccctgcgccatcgagggctcgcgctcgtcccacaggccggcatgaacgccctcaatccggtccgctcgattgaggggcactttcgagacgtgctcgccggtaccggtgttcgtcaccgagcagaggtccgagctcgcgccgtctccctgctcgaacaagttgcgctcgcgccgtcggtcttgcgcagctatccccacgagctgtcagggggcatgcgccaacgggttgcgctcgccctggcgctcgctctggaaccccagctcgtggtcttcgacgagccgacgacggcgctcgacgtcctcgtgcagcgctcggtggtcgataccatccgatcgctgcagcaagcgaggggcttcgccgccatcttcatcagtcacgacatcggtctcgtcgcgagccttgcttcgcgagtggacgtgatgtacgcaggtgaggtggtggaggcgggaccaaccgagcgtgtcgtggcacgaccgctgcaccgctacaccgaggcgctgctgggctgctacgccgaccctcgggcggaggaggtcacggtgcgtggcattccggggagcccgccgaacctcgttgcgcagatcgaagggtgcgcgttcgcgccccgctgtggcgtcgcgagcgacgagtgtcgttgccccctgccgacggtgacgctcgacgaccagtgggcacgctgcgtgcatccagccgtggcggtcgagggacggtcccgatgaccgaacggctcgtggtcgacggggtctcgaagtcctatcgaggggagcggcgtcacgagacgatcgaggcgctccgagacgtctcgctcgaggtcgccccgggtgggtcgctggggatcgtcggccagtcgggaagcggcaagagcacgctcgcgcgcctcatcctcggcgcggagcgcccggactcgggcagtatccgactggggaacgtgcgcgtcgaccagctcgaccggcgggggctacgagcgcactggcggcgcgtgcagctcgtgttccaagatccctacgcggccttgaatcccttgacgagcgtgcgcaccgcgctcgaacgtcccctcaccaaccaccgtcacctccgaggcgccgagcgtgagcgcgcgctcgccgagctcctcacgaccgtcgggctggtgccagtggagcagttcgccccgaagctcccacaccagctctcgggcggtcagcgtcagcgcgtcgtgatcgcgcgtgcgctcgcagcctcacccgaggtcctcgtcgcggacgagccggtgtcgatgctcgacgtctcgctccgtgccggcattctcgagctgctcgcgtcgttgcgtcgcgagcgcgggatctcgctgatctacatcacgcacgatctcttgtcggcacgggtcgtcaccgacgagctcgtcgtcctccgcgagggagcgatcgtcgaacgcggccccaccgtgtcggtgctgcgccagccgacgtcggcctatacgaaggcactgctcgatgcggtgccggtgctgccgaggagtacgcaagcgtcgacgtgagctcggccatcgtcgcgtacagtgacggaggatgactcgaacccagctccggagcctggtcgccgtcttcgaggcgggctcggtcgcgggtgcggcgcatcgactggtcgtcagcgccgctgcagtctcggcggcggtggcctcgctcgagcgggaggtcggtgtcaagctcctcgagcgggtgggtcgcggtgtgcgcctcacacctgcaggcgaggtgctcgtcgactatgcacggcgcatcgaggggctcgaagaagaggcgctggtccgcgtgcatgagctcgccgacgccgcaggcggggtcctacggatcggggcggtcgcaacggtcggggaagagctgttgccgcggtggctctcggtgttccgatcggcgcggccgaaggcgagcgtccacctcgaagtcgccaacaaggcgcgactgctcgagcggctccgtacgcatcggctcgatctcgtgatcgcgggtcgacccggacacgaggccggtctgcgcatcgtcgcgacccgtccgcacgagctgctcttgtgtgccgccgcaggctgggcgcgcgagtggttcggcccctcgctcgaggtgactccagagacggcaagcgcagtgacctggctcgtgcgcgaagagggatcgggcacacgtgcctcggcagaggaggtcctgagcgcgctcgacatccatccgccatcgctcaccatcggctccaacctcgcgatcaagcggggggtggagctcggtctcggcgtcgccgtcctgtcgagcgatctcgttgcacgagaacgtgagcagggcgagatcctctcgctcgcgctggggccgctgccgtcggtccggcgttggtgcctggtggtgggccccgaggggcccccagagccggtccgcgccttcgtcgcccagctccaggcgatgggggagctcgaaatcccccctgcgctcacctgaggggcgggtgggcgagcctccctgcccgcgtagcgtgctggcagcgcgtcgtccagtgggtcgacgatgaccagggcgcgccacgattcagtctcgagccgaggaggcgttgtggacgacattcgcacgatcgctgcggccatggtggcacgaccgaagggcattctcgctgccgacgagagcagtccgaccctgaccaagcgcttcgacgcgctctcgatcccatcgacgccggagagtcgcctcgcctggcgggagatgctcttctccacgcccgagctctccacgtggatctcgggggtcatcctctacgacgagacgttcaaccagcgaacctccgatggttcgacgatccccgagttcctcgccgcccgtggcatgatcccagggatcaaggttgataccggtgccaagccgctcgctggctcgaggggagagctcgtgacggaggggctcgatgggcttggttcgcggcttgcgacctaccacgccaagggggcgcgctttgccaagtggcgcgcggtgatctccatcggggacggtcggccgagttcgatgtgcgtcgccgccaacgctcacgcgctcgctcgctacgcgaagctgtgccaggagaacggcatcgtccccatcgtcgagccggaggtcctgatggaaggcgatcactccatcgaggtcaatgcggccgtgacccgacgcgtgctctccgaggtgttcgccgaacttcgacgcttcgacgtcgacttcgagggcatggtgctgaagccgtcgatggtcacgcctggggtgcttggcgaacccgtgagcgtcgacacggtcgcacaggcgtcggtggcggtctatcgcgacagcgtgccggcctccgtcgccgggatcgccctcctgtcgggtgggcaggcagacgacgtcgcgaccgcgcacctgcgcgcgatgaacgccggagcgacgttgccctggccgatcacgttctcctacggacgagcgctgcaggacctgcccatgcgcatctggcgtggtgatgcggccaacgcggcggcggcgcagcagtcgctcgcgacgctcgcggcggcgaacgctgccgcggccgaaggccgctaggtctgcgacgctgtcgctgtaggctccagagccgtggagcgtgaggcatcgtgtgaccccgtcgtgctcgcatcgttgctcgcgcaggtcgacacgctcgaagcggaggtcgaggccttcctcgaggtcctgcacgccgagatcgagccgacgcgtacgctgcccgatccgcggcagcgtgtgtccgagggggcgagcgagacgaggcctgagcgtgcgggtctcgcttgaactcctcggtccggtccgcgaggcgatcgggtccagcgtcatcgaggtcgcgctcgagcccgacgccacggtcgcagacgtggttgaggagctggtcgagcgtgctggcgagccactgcgtggcctgctcgaacggtgtcgctttgcgatcggcgatcgcgtggtggacctcgacgagcctctcgccgatggtgcgaccgtcgtcgtgatcccacccgtcagcggagggtcgtgatggccgtgaccatcgtgctcgtcgatgaccaccaggtgatcatcgacggggtgcgtgccatgcttgcgccctacgccgaccgggtcacgatggtcgggtcggcgaagacgcgggccgagctgttcgaggtgctcgagagcgtgcaccctgatctcatcgtgaccgatgcgaggctcaccaacgactcgggcttcgagatcctcgaggacctccagcgacgtggcgtggcggtgcccgtcgtgttctacagtgcctatgacgacgaggcctacctctttcgtgcgttgcgcgccggtgcgcgaggctacctcctcaagcaggcctcaggcgaagagctcgtagggatgctcgagcgggccgcaggtggcgagacgatgatcgatgctgcgctcgccggcagagtagccctgctcgcagcccgcttgcagttcggtgagttctggccgggagcacacctcggactcacgcagcgcgagagcgagatcctcgatctggtggtcaaggggctctcgaatcgagacatcgcgcagcgactgttcctgggagaagagaccgtcaagacgcatctgtcctcgatctatcgcaagctcaaggtcaagggacgcgccgaggcgatcgcggttgccctgcgcgaagtgcggttccgatgagtgcgcgtgagctgaccctctaccgacgtcttgccgagctcttggttgcgccactcgaggtcggcgaggtggcgagccgcaccgctgcgctcgtcgtcgaggcggtcgatgcgagcgtgtgcttcgtgcacgccgtcgatcacgagcgcgggcgcctcaccctgatcggggccaccccgcccttcgatcgagtcgtgggtcgcatccagctcggcctcggtgacgggatcgcaggatgggtcgctcaaaccggtcgtgccgccgtggtgcccgacaagtgggcggaccaccggtatcgctatatacccgagctcggtggggagcacttcacctcgctggtgtcggtgccactcgctcgcgacggaaggccgaccgtcggggtgctgaacgtgcactggcgcgaggcgatcgctgacctggagcacgaggcttccgtgatcgaggcggcgggtcgattcctcgtcggggcgctcgagcacgcgctgctcgcagaccagctcgtcaccggtgaggccgcgctcgagcgtttcgcgacggaactcatccgtgcccaggaggccgagcgccgtcgcgtccagctcgacctccacgacggcgtcgcccagtcgctgcacgccgcggcgtaccgtctcgaggggcttcgagccagcgcaccgccggcgctcgcgtcggagctcacggtggtgagggacctggttcgcgcggcgaacgccgaggtgtcacggctcgtgcgcgacccgggacgtcaggtgctcgaggacttcgggctcgccgaggcgctccagtccgtcgcacacggctatcccgacctcgaggtccaagtcgacgtcgagctcgacgatctgacgctgctgctcgagcccgagcgggggctcgccgtcatgcgcatctgccaggaggcactcaacaacgtcgcgagtcacgccgcgaccgacgctgccgaactgcgcgctcgacgcgtcggcgacgacttggtcgtgaccgtacgcgatcgtggcgtgggtttcgagcccgaggcaaccgtgcccggtcgtctcgggctcgtcgggatgcgcgagcgcgcgcgcctgctgggcggaaccatcgagatcttctctcgcctgggtgaaggaacgctggtccgtctgcgtgtgccgatcgtgccgtcggtcgcgtcgtcctaggctgagtgcgctcaaggcgccatgctggggcagagtgacaggggcagctcgtgagccgtggaggggacagttcggcgctaccgcctgagctgtggcaacgtgcgagccgttacacctggatcgccacggcactgctcctgccgaccatggtgcccgccttcgtcatcggtgggtgggcgctgcgggtgtcggacgcctcgttcgcgctggccgcgctggtgggatggctcgcgcgtcgccgactcggtctcggggcaaacctccttgtcacgaccgtcgcgagtgcaggcgccctgctccagctctcggtgccggtcgatgccgtgacgaccttgatcgcagcgagcgtcatccgctccaccttgctcctctttgccggggtgggcgtgtacgcgatgagcttcatcggcgggcgggtggggctcgcgttcgccggcgtgctcctggtcgccacggccctcgtgcacccggtgggtttgctcggcgcggtgctcgccctggcgctcgccgccctgctcggctacatgatccacgggctcgtggagcatcttgcccatcgcgagcgtgagctgagtgctgctgcgctcgtcgatccgctcaccggtctcggcaatcgacgggccctcgagcgtgcgttcgacgtcgccgtggccgaagccgcacgacaggacaccacgctcttcgtgtcgctgtgggacctcgatgcgctcaagcgcaccaacgatgaacgtggtcacgaggccggcgatgccctcctgcgggacttcgctgcggcgctcacgcggacgctccacgatcaagaccaggcctttcgtatcgggggcgacgagttctgctgcttgcatctcggcttgaaggacggcgcatcgatcctcgcgcgcatggcactcgcgtttccgagcgtctcgggcggctttgccgaggttggcaacgactcgctggggacggcgcttgctcaggccgatcgcgccatgtacgccgcgaagcgccgtcgtcggcgccacgacggctccgacggctgagcgcgtgctaaactcgacacgtccatacggatggacgtcaccgcggtcgtggaaggcgtggcgccttctccccgttcccggcgtgttcgcgctggtggtgatgccgtatggcgccacgtatgacagaagctcatggatgggcgcagtggcgacgagctgctgcgacgctggcgctcctcgtgagcggtggctttgtcgcgcgttggggctcgacggccccgtcgtcgtccgtgcagtcgctgcaggctcaggcacaggttatcgaggcacagcttgccaacctgggggcctcggtgcatgccatcacggtgcagatccaagagactcaggccgcgatcgcggccaacgaggcctctgaggccatcctcgaggggcagctacgagccgagcacgctgcgatcgcgcggtcgcgtcgagtcctggtgacggccgctgatcagcagttcgtgacggcaggccaatactcgagcgtgttggcgtcgctgcggtcgaactacagctcggtcgggctgacgcagggctacgagcaggtcgcttcctcgtcgatcacccaggcgctctcggcctacgagcaggccggtctcgagatcgaggtgacgcaggcagcgctcgcggcgcgcgttcgggcaaccgaggccgagctggtgcaggatcaggcgcaacgcgctcagctcagccaacgggttgcggccaccgaggccgaactggcccaggtgcactcgcagctggcctcggccatcgcggctgaggcggcagctcccttgccggctcccggcggagcggcccaagccgtccaggtcttgctggctccgccgccgccctcgccgacgtcgctgtcggggcccgcgaccgccgcgcagctcctcgcgttgcgcgactgcgagtccgggggcaactaccaggccgacaccggcaacggctactacggtgcctaccagttcgcggccagcacctgggctgcgctgggttacggtggcctgcccaaccaggctccgccagcggtgcaagaccaagccgccgagcaactgctggctcgagctggctggggtcagtggccggtgtgctccgtcctgatcggcatgtaacgccgatcgttgcgccacgagccgaggcggccccgggatcgctcccgtggcgccgatcggagcgcgcgccactacgtcatggcgtgcgccccgaggaggctctggcgtgcggtcgcgtcatgctcgctgggttcacgcacccgtggtggccgactcggcgagaagctctggaggcgtcgaatcgagcagcgacaagatggcggtggcgagggcgcgggcgcttgcgacatcgagctcgagcgcactgaggcgcctgaggccggtggcctcgcgagcgaagacgtcgatgttgagcgaatgggtcgctgggaacgccacggggtggtcgaagtagacggtcgcctggtcgacggcctcccagccctccggggtacgtgcgcgccccgtgagaggggcgtgttcggtcgcgtaggtgcacatggctaggcgagatgctcgccgaggaagcggaagatccgctgccaaccgtcgttcgctgcttcgggtcggtacgagggtgcagcggtgttgaagaaggcgtgcccggcaccgtcgtaggagtggaactcgtgcgccttgccgagtcgggtgagctcttcgtcgagtcgacgtacctcgtcaggggctgggaacgagtcgtcgttgccgaagaggccgaggagcggggcgtggagctcgggagctcggtcgatgaccggacgcaccctgaccggggctccctcggggggctcgttcaccacgaaggcgccgtagcagtcgatcgctgcgtcgaaggggatcgcgcatgccgcgaggaagctctgtcgaccgccagaacagtagccgatcacaccgaccttgccgttggcgctgagggcggcacggaggtagtcccgtgccccggcgacgtcgccgatgagacgctcgtctggcaccccaccctgggcgcgggcgatggccgcggcctcgtccggagccgcgttcggagcctcgcgccagtagaggttgggcatcagcgtggcatacccgtggcgagcgaagcggtaggcaatctccttcgtcgcttggtcatagccaggcatgtgatggatcacgaccatcgagccgtggaccgtcgcgtccagcggtcgcgcgagaaacccctggacgaggtcgccgtccgcgccgcgaaacaagatctcctcggtgaggacacggtgctccatgcagactccctgtgtgcatctgggtggtcgaggccaccggtcgagttggagtagttgtaccttaccagcgactgggttcggcgtcgccacaggtggcaggccggggtgcgatgaccgacggcgaggcctcgcgggcggagtggtggtccctagtgctcgaccgagggcgaggcgacgagctcgaaggcgtcgaacccgacggtcggggccgctgggcgttgcacgaagccggcggcgaggagggctcgagccgagggggtgttgtgtcgtgcgacacgcgcgacgatcacctcgacaccaggctccgcgctcagcgtcgccgtgaggctgaggatcgccgccgtcgcgatgcctcgcccccgttcggatttgatgacgtcgtagccgatctcgacctcaccgttgatcgggttgccgtgcgcgccgatggagccgacgacgacgcccttggcgaggtcgacgatcacgaacgggccgaacgggaactcaggcccgacgcccgcctcgtggagctcgaggaagcgctgcgcgacgcctcggtcgatgtcgtcggggaagtccggggcccagtcgggagcgcgttccgccgtcgcgatcgctcggaggaggtcgacgctacaccagcggagctcgacggcggcacgatccatgcgttcggatcagtggaacgtcaagacggtgatggtgccgagcaggaacagcacgccgctgacaccgtagagcagcgacttggtgatgaccttggtcacggggcggtgcacgtagtcgttcacgatggtccgaaggccgttaccgccgtggagcagaccaagggcgaggaggagccagtcgaacaggcgccagagcggattcgaccagcggtgggcgacgaacgccacggtggtctgggtcacgtcgttctcgatgtgcatgatgtacatgtggatgagggccaggaagaacaggacgatcccggacacccgcatgaagagccatgcccaggtctcgaagttctggcgaggtcgtcgtgcgctccgaggagtggcgaagacggccatgtcagtgcacccccacgaagaacggcttgacgatgtagtagccaccgacgatcgtcagcagcacgctgagtccgagcatggcctggaagagcgctcgttcgttgcggacggcgcccgggaagaagtcgatcatgatcactcgcagaccgttcagcgcgtggtagaggagggcgaagagcaggccgacctcgaacaggcgcaggaagatgttgccgtagagctggtggatctgttcgtagacgtgcgggtcgttcagcgtggcgacgtcgacgatgtggagcaggatgaacatgaagacgaggaagccggtgacccgatggaggatgaacgcccactggccggtcttgcctcgatacatcgaggcgcgcgctcgtactgcgcgccctccagccggagccggcgtcgctggcgacgtcatgactgcctcctgaaccaccgggtgctgcgggtggtcgtcgcgacgacgtaggcagcgaaggcaacgatccccaacgcgatcagaccgagggcgatggagaacaggatctgggccagactgacccccgaagagctcacactcatggcgcttacgctagcgcccgctcggtgttggtcgaaatcacggcgatgcgtccttgtcgtgggtcaacccagctcgccaccggccggggctgtcgtgagcgtccttggcgatgcagtcgggctccgtcgtgagtggtgcgacacgacctgcgatcggtggggcgctggctcaagcggtcttgggtgcctcgagcctcgaggtgccgaggtagggggccagcgcatcgggcaggcgtatcgacccatcgggttcgcgaccttgctcgaggagggcagcgatgacgcgtggccacgcgagcgccgagccgttgagggtgtgcacgtactctggccgcgccgccggctcccggcggaaccgcacattggcccggcgcgcttgatagtcgctgaaccatgacaccgaggagacttcgagccacgcgtccacaccgggcgcgtagacctcgaggtcgaaggtgcgggcggacgactgtccgaggtccccagtgcacaggtcgacgacacgatagatcaggccaaggcgctggagcagcgcctctgcccgaccgagcagctcgaggtgcatgctcgtggcatcctcgggtgcgacgagtgccaggatctcgaccttgtcgaactcgtggagacgcagcaggcctctggtgtcgcgccctgcggaccctgcctcgcgccgatagcacggggtcgcggcggtgaggcgcatggggagcatcgcaaggtcgaggatctcatcgcggtagagcgacgtgagcggcacctcggccgtcgggatcgcgtagagatcatcgcgctccatcacgtaggcgtcgtcggcgaacttggggaggtggcccgttgccaccatcgtctcgcgacggaccagcgtcggaggatggatctcttcgaaggcctctgcgtgggcatcgagcgcgaagttcgtcagagcgcggacgaggcgtgccccgaggttgcgatagagcgcgaacatcgatcccgagagcttcgctgcgcgctcgagatcgagaatgccgagctcgcgaccgatctcgaagtgcggtacgcgacgatggctgggtgtggtggacgtgagatcgacgtcgggctcgaccgtgccggtctccggcgaccattggcgtaccacacggttgtcgtgttcgtcctcgccgatgggtgcgttcgggctcgggatgttgggcaaggtcagccagatcgcgtcgcgatcgccggtcaaggtgtcgacgcgctgctcgagttcgtcgagccgattaccgagcgctcgggcgccctcttgcagctcggtcgcgtctcgaccgctgcggcgagcctcggcgatgtcgcgagagcgggcacgcagctcggctcgaagctggtcacgctcggtgatcaccgctcggagttgctgatcgatcgtggcgaggtgggcgaccacctcggggtcgatcccgcgggacgcgaggcgccgtgcgacgtcgtcggggtgggcgcgcagctccgtgaggtcgatcatgcagccttagactagcgatgcgatggaggatgctctcgaggtccacgacctcgtcgtgcgctacggctcgttcgaggccgtccgcggcgtgtcgctgcacgtcgctttcggggaggtcgtgggcgtcctcggtccgaacggcgcgggcaagacctcgaccgtcgagacgttggagggctaccgacgggcggctcgtggcgaggtgcgcgtgctcgacgtcaccgatccgtggcggcaccagcgcaccctcgcgcgtaaggtcggcgtgatgctccaagagggaggcgtcccgccgcggatgcgggccctggaagccctcgagatctacgcacagttctacgacgatccctggcccgtcgctgagctcgtcgatcgtctggcgctggcgcccgttgcgacgacgccctttcgtcgactctcgggcggcgagaagcagcggttgctccttgccctcgcgatcgtcggccgtccacgggtcgtcttcctcgacgagccgacggcaggcgtcgatccggtcggcaagcgcgccatccgggacttggtcgccgagctcgccggatcgggcgtcgcggtgctgctcaccggccatgagctcgaggagatcgatcgcatggtggatcgggtgctgatcatcgaccacggcatgcccgtcgccgccgggagtcccgcagagcttcgggagcgcttcggagaggccggggtcgagttcaccgtgcgaggcaggctggacccaagcgtgctggcggcacgactcggggtcgaggttcggctcgttgccgaggatcgggtgcacgtcggggcttcgccgacccctcagttggtcgcgtcgctcgcggcggtgctcgacgagctcggcgccgaggtcggtccactcgagacggtggagtcgtccctcgagtcgatctatctgcgcctgctggaccgcggggagacgacatgagtgcccatccagtacgcgcccaggcggtgtccgagctcaagctcgtcctccgccaaggcgaagccgccctccttacgatcgtgatcccgatcctcggtctcgtgttgttttccaaggtcaaggtattgccggtgcctggcggcatctcgcgcgtcaacttcattctcaacggcgccatcacgttcggcatcatggcttctggcatggtctcgcagtcgatcaccgtcgccttcgatcgttcctacggcgtgttgaagcgtctcgggatgacgcccctcggacgcagtggggtgatcgccgcgaagctcgtggcggtcgcaggactcgagatcgtcgagttggtactcctgctcgtcgtgggggctgtgctcgggtggcacccagctggcaatcccatcgagttcgtcgtcggttgggtgctcgcgaccgctgcgttcgctggtgtcggtctcgtgctcggaggaacgttgcgggcagagctcgtgctcggattgtcgaccctgctctggctggtgctcctcggtctcggcgcgatggtggtgccgctcgggagtctgccgggcccagtcgccgatatcgccaaggtgctcccagcagctccggcggccaccgtgctgctccatggcatcgctgtcggcgggagcgcgccactgtgggcgtgggtgagtctcgtcgcctgggcagtcgtcgcaccggtcgcggcgtctcggctgttccggtggagcgcctgagtatccgccaagagcgggccgtcgaagcgtcggtaggatagagccatgcatcccgtcgtcgagcgagttcggtcggccgtaccggtctcgccgcaagtcttccgacgtgtggcgctcgccacgctcggcgtgtcgacgttcatcatcttcaccggcggcgtggttcgtctgacgcagtcagggctcggctgcccgacctggcccgactgcacgaccggccacttcgtggcgggcttcgagatccaccccatgatcgagttcacgaatcgggtcgtcacgttcttcgctggcctgctcatgtccttgacctgggtggtggccctgttgcgacgtccattccggcgggacctcgtgtggtggtcgctcggtctcgtcgtcgaggtcgtcgccgagagcgtgctcggcggtatcaccgtgctggagaagctcgcaccccccttcgtcatggcgcacttcttgctcgcgctcgtcgtgctatggaatgccgtcgtgatctaccacaaggccggccagcccgagggacgcccaaccttggcggtctcgtccgaggtgctgtggctgtcgcgggtgatgttcctcgtcctcggtgcgctcgtcttcgtcggtacggcggtcgcgggtaccggaccctactccggatccccggggagcaagaggctgcacatcctcaccatgctgcaggtgacctacctgcacgccgacatcgccctcgtcttcattgcgctcacgctcgcggacctgttcctgctccaccaggggcgctaccccgcacagatccagcgtgcggctcggagcatcctctggctgggcgctctccaaggcatcatcggctacacgcagtacttcacgggcttgccgcagtggctgatcgcgctccacatccttggtgcagcggtcatctggctcgcgatgaaccgctactacctcttgctgttccgcgtgccctcgacgcgcagggcggaccacgcggtcgcgccgcagcaggcgccttccgtcgcggctgccgactagcgatcgcgacggacgctagccttggtggtgttcgtctcgggaggtgcgtggtcgatgtcaccgtcaccagcccttgcgccggtcgagtccgaagaggtagccgagactcgcaccgaagagagctgggcgaccattctgtgggatgacccagtgaatctcatctcttatgtgatctatgtgctgcaggccaccttcgccttctccaaggtcaaggcgaccgagctgaccatgcaggttcacaacgagggcaaggccatcgtggcgaccgggtcgcgcgaggacatggaagatgcagcgtcaaagttgcatgcctatggcttgtgggccacggtgtcgcgcgcgtgagtgccgggccgttcgtccgtgatggcgacgtcgtcgtggtggtgctgtcggcgcaagctcgagatgttgtgagtcggagtctcgagctcgtcgctgggatcgttgcgtcgggacgcgaggaagcctggcgggttgctccgccgctctacgacgacccgttgctcgaagccgaggcgtcgctcgcgagccgaggtgatgccggcggcaccctcgatgaggcccagtcgctcatcggtcgttgggcgaagcgtgtccgcgacgtcgagcgcctcgatctcgacgcggctgatgaattcatgcgcgcgttgaacttcggtcggctggtcctcgcggagacccgaagcgtcaccgatgatcgaggactcctcgacctgtttgcttggctcatcgaggcactcgtggaggccctcctcgagggttgacgcaccctacccttgcgtcgtcacgctggacgagcgcaccgcacgacagtagggatctcgcacgtcgacgtcgacccgcgcggctcggcgtggtcgtcgagcagcgcggcctcgggcgtcgtggtgcccgaggccgtccctgcgacgcggccgctcagtcgccgagctctctcgggatcgcggtctggaagctgcggaacagctgcgtgaggtccgcgtagccgaggcccgatcccggattgaacacggcgccttgggagccggtgtagaagtcgttcgtgttggtgaactcaccggagatcgcaagctgggcgttgccgatctggccgctgtagtaggccgagccgtcgatggtgttcgaatcgagcggcgtgaacggcgacgacgtcgaggtcgcgaagcggtagatgttcggattccagaagccgagccgtacgcccccgagggcgctctcgtagacggcgtcggtcccgttgagctgaggcgcgatgaagctcgtgccaccgaagtccaccagctttgacccgtagacgctctggaactgtgggtcgtagaccgcatagccggtctgggggtcggcgttgaacgccaggtccggcgtgacgcggccaccgctcatgcccgtctgaagcgtcggggcagggttgaacgagaactgcgtcggctcgacgaggcctggtgcgacctgctgtggatcgatcggcgtcaagaactcataggccgagtagctccctgcccccaccatctgaccctgttggtagagcggacggccgaagagggtggagtagccaccgcctgatcccaccggcaagctcgtggctgcttgggcctcgttctggaagccgagtgcgatgtacatcggccacaggtagtcccagccccaggtcatctgctgcgggatggtcaccgactcggtgccgacttgggtcccgttcgccatgatcgggtaggtctgagtacccgggagcgtcgtgccgccagcggcggtgtcgtagggggagtcggagggcgagataatgccgaggttggtggtgccgatgtcacgagctgggttgtaggccccataatcgccgctcgcgatgaagttcgactgtccctgcgccgccatctcgaggaaggcctggttgaacgaggccgcataccccggtgactcctgcgctgcgtccaccgcagcttggatcgcggtctcggactcaccccagctcgacgagacggagccggcgacgttctggctggccgcctcgtagaaggcgtcgacgaagccgtagtcggtgttgggcgcctggtacacgacgatcttggccatcggcgcgatcgtgcccgactgctcgacgtcgagggtggtctcgtcggagccagcgttcagcgacaccggccctgcaccgccgtcgacgttgacgagcgcaagacgattcggcaacgtcacgacgtgcgcgatgttcctccagaagtacatcggcaccgaagggttcacgctcgccaaggtcacgatgccgatggtctgcccctgaccgaggtagcccgcttgctggagcggtgtgaggttgtagtcgctcgtgaaggcctgcggcagctgatcggtgggtgctgcggtttgcgacgacccagccgtgggtgcgacctggttgatgccgggcaccgcgagcgactcgtagggcgcgtagttcgacaacccgagcacggccagaatgttcgacgccaggttcaacggcatctgcggcgcgctgcgcgtcccgtagaccgtctgggtcgtcgcgggcgcactggctgcgggcctggtggtgacggtgaagttctcgagcaagatcccaagggccttgtcgtactgtgcggccgtgccctgcgaggtgacatcgaggccatcgctcatggcctgggagctgatgccgaactcacggaggaacccacgcagcgcgaggatgtactcttcggtctggccgtactcgagcgcgaactcatggggcgtcaggtacggaccacgccaaccagcagccacccgagaggcaagctgtccctggttgcgcatcttcaggatgaacgacacccgcatcatcgtcgacccagccgtggtgcccgtcggggtggcgtgcgagagcacatcggcaccgatgccctgcgacaccggcaccagcggatcagacgccgacgcgagcgactgcgcgcctggcatcgccagtgcagcgccgacgaggccgatggatccgaggattcccaggtatttcgtgcgagccaaacgcttcatcgctccaaccccctctgtggatgtgacgagggatctcgcagaccccgctggatcatacatcgcgtcgcgtcgtgcggtgggatttctacggagagtttgtgcgcttggcacgcagcggcaacattaccactcgatgtgggcgcgagaccacaaacgatgggccagagctgggcgcggcgcgctgaagtgagtggtcgggcgcaccgtgcgaggtggcccttccctgccgccgcgactcgcgctttcgaccagacagagccgcgtgggaacggtgcttgggctccatatcccagggcatcgagccaggactcatcgtcgtggcgctgagttcggctcgcctccgagctttcgacacacgcattggcgctcggagttcgccgacgtcgcagcggtcgaccaacgaggagccgagcaggtcgcgggcgcccgacgctgatgatgtcctggccgcgtaaggctctggtcgacaagggtggtctcggacagaggtcgtggtgtgccccgccggctgggtggtgagccgaaggcggtggctgtgcgggtgctcggtcggcgccgggcacgggctgtgccggcgatgtcgggtcacacgaagcactcgtgtcgacgacggctcagggcacgaggatgaccttgcccacggtggtgcgaccggcgagggcttcatgagctcgacgggcctcctcgagggggatgcgctcggcgatggtcacctcgaggaggccagcggcgacatcggcaaagatcgcctgagcgcgccatctgagctcctcgggcgtcgcgacgtagtgcggcagcgacgggcgcgtgaggaagatcgatccctgccggttcaggatctggggatcgacgggcggcaccgggccgctcgcctgtccatagagcacgagcatccctctgggtgcgagcgccgcgagcgatccatcgaacgtcgcacggccgacaccgtcgaaggcaacgcttaccccaccgagcctacgagcggcatcgacgaatccgtcgtagtcggtcacgatctgagcgcccagacgacgggcacgggttcgcttctccgcggtcgaggccgtcgccacgaccgtggacgcgacgcgacggacgaggtactgcacgagcagggaacccacgccgcctgcggctgcgtgcacgagaaccgtcgcacccggttccactcgagcgcaggagttgacgagcgcatggacggtcatgccctggagcagcaccgcggcggcgacatcggccgtgacgtcgtcgggaatcgtgacgagccgaccagccgggacgaccaccacctctgcgtaggcgccgagatgattggcaaaggccacgcgatcgccgatgctgacggaggtgacaccttcaccgacctcgatgaccgtgcccgcgccttcgctgcccaggacggtcgggagcgagaggggataccagccttcacggtggtagaggtcgatgtagttgacgccgatcgcctccagtttgatcgcgacctcaccgggggcggggtgcggctcggggacgtcggcgatctcgagcacctctgggccgccgtggcgctggatcagcaccgccttcatggtcgcctcctggttcaggtctgtgcgctagcaacggtagcctcgtggtgcgacaaggagggtcacggtggggcgagtgttggtggttggagccggcatcgtgggtttgtcgacggcatggcacctcgcagagcggggggaggacgtgacggtgctcgagcgccgagacgtcgctgccggcgcttcctacggcaacgccggctggctctcgcctggcctcgccatcccgctcaacgagccgtcgctggttcgtcagggcctctcgtcccttgcgtcgccgtcatcgccgctgtaccttgcacctcgtctcgagcgaagctggttggagttcgtgatccgtttcggcctcgcatgcaggacggacgtctggcgacgatcgatgcagatcctcggtgggctgaatgctcggtcgttggaggcgtgggaacgactcggcgatgccgtcggctaccagccgacgaccgcaccgatcgtggcggcgttcgcccgccgtagcgatgctgcggcgctggagcacgagttcgctctcattcgcgaggcgggcttctcgctcgagacgaaggatctgagcggcgacgagctgcggcagatggtaccgatcgcggcccccgcgctctcgttcggcatcgccatcgaggggcagcgcttcgtcgacccggcgcgcgcgacccaccgtgtgggttcggccctcgctgagcgcggtgtcgccgtcgagcgcgcagacgtggttgatctcgagcggcgcggagctcacgtcgtcgtgcgtacggtcgagggggccgagcacctcgccgatggggtggtggtcgcgatcggagcgtggctcggcccgctcgcccgacgtctcggcgtgcgagtaccgctgcaagccggtcggggctactcgctgcgcgtgccgatcgaacgcccgctcgacgtcccggtctacctcccgactgcgcgactggcgtgtacaccgctcgacggtgagctgaggatcgcggggacaatggccttcgagaggcccgacgatccgccgcgccaggcgcgcttcgacgccatgcgtcgtgccgcgcggcggttcttcgaaggggtgcagctcgatgcgccacgcgaggcctgggtgggcccgcgacccgtgacggccgacggcttgccgttgatcggccccaccgcggtgccgggggtctggctcgccgacggacacggaatgtggggcatgacccaaggcccccttaccggggaactggtcgccgagggactgctcagtgggacggtaccggaagcgttgatcccactcaatccgctccgctgaggtgaagcgatgtcacgctcttgtcgctcgaatccaacgggcgccagggagtgtgccgcctcgtcagtggtgttctcgagcactgcaggctgcgcaggtgccgacgatcgcgaagtgtgacaggcgtgcgcgaaagccccattgggtctcgatgcgcgcgatggcgggcgcaaagacgtcctcgggaatctccgtgaccgtgccgcagtgctcgcacaggaggtggaagtgcgacgatcctgcgaggtggtaggtggcggggctgtgaccgatgtggacgtgttcgatgatcccgacgcgttccaaggcgtcgagggttcgatagatggtcgcgcgatggacgagtgcatctcgctgctcgagggcgcggacgagttcgtccgccgtcagatgaccgcccgcctccgcgagggcatcgatgatggcgcgtcgcgcctgggtgacccttccgccccggcggcgcagacggtcgagggcttcgtcgcgatcgagggtgacgcgcgtgcgctcaggcacgggcgtggtctcgttcgagccggtagccgacccctcgtaccgtggcgatgatgctcgggttgttgggatctggctcgatcttggagcgaaggcgcttgacgtgcacgtcgagcgtcttcgtgtcgccgtagtagtccgacccccagactcggtcgaggatcagatcgcgcgtgagcacgcggccggggttgcgcaggaacagcaagaggagatcgaactccttcggaggcaggcggacctcggtccctcggacatcgacttggtggcgatcgacgtacacggtgatgccgtggctctcgaggatctcctctgcggcctgggcttggccctggtgcttggtgcggcgcatctgcgcacggatcctggcgaccagctcgctcatgcgaaacggcttggtgacgtagtcgtcggcgccgagttcgaggccgagcacggtgtcgagctcaccggaacgtgccgtcaccatgatgatcgggaccgaggactcctgtcgaatggtgcgacagacgtcgagccctgacaggcgcggcagcatcacatcgagcaggatgaggtcgggatggtgcgagcgactcaacgccagcgcctcttcgccgtcgttggccacgatcgtctcgaagccttcgcgcgtcaggccgaggacgagggcctcgacgaagctcggttcgtcgtcggcgatcagcaccgtgccgacgtgggcgcgcttgtcgtcagcggccatcgttcggaccacctcgtggaagcctcagctcgaatgtggatccaacgccctccatcgaggtcacgttcagcctgccgcggtggttctcgaccacgtgcctcactatagagagaccaagaccagttccgcccgttgcgcgtgagcgggcagcgtcgacccggtagaagcgttcgaagatccgctcgcgatcgcgagcggggataccgatgccctcgtcgcgcaccgcgagcacgatggtgtcgtcgctcgcgtcgaggctgatctcgaccgtgccccctggctcggagtacttgatcgcgttgtcgacgaggttggacagggcgctctcgagttgccaacggtcgccgacgaccatcgtgggcgtgacgggtacgagcgcgtccagggtgagatccgctcgacgtgcggtctcgtcgaagcgttcacgcaccgcttcgaccagggatcgggcgtcgaactcggcgagcacgacgccgctgccctcttcgatgcgcgacaggtcgagcaggtcggagacgagacgagcgaggcgatcgccctcgtccacgatgcgctggaccaggcgttgcgccgtcgtgggctcgtcctcctgggccagggcctcggcgaggagaacgatcgcgccgaccggggtcttgagttcgtgcgagacgttggccacgaaatcgcgccgtaccgactccaggcggcgcagctcgctgacgtcctcgacgaggatcagctggcctcgatcgtcgagccaggttcgacgcacgagaaaggtccgccttggcggaccgaacagctcgacagcgcgctcgacgtcgccgtgggctgccgggtcgtggagcaacgtggcgatcgctcgatcgagcaagatgcgctggttgagactctccgcaccgaatttcgcctcgacgtcacgatagagcgtgtgtccttcagggtcgacgagcacgatgccaaagggcatcgtggatgcggcgctgtgccagagccgcgcctccgcagtcgtcgtcggcatctcggctgggcttggttcgggagtgtccaccgtcgctccagtctaggagcctcatcgcgccctgatcgtgtcagtgatgacattctatgctacgctatgcctactcatggatgatggtgtcgtccgcaagggcgtcactcgagcaaaggagtgcaaggacatggtcacatggacgttcctcgacgtgtcgctggcgccggatccctcggcgttgccgggaggctccgtcctccagaccctgatcaacggcctggcgggctgggcgctgctggcaagcttggcaggtctcgtcatcggtgcggccgtgtgggcactcggtgcacacagtcagaactaccagcaggcctacctcggtcggcgggccgtactggtcgcgggggccgctgcgctgctcgtcggggcagcccctgccatcgtcaacttcttcttccacctcggacttggcgtggggtaagtcgtgggcttcctccttgcacacggcgcggcggcgatcgcccgtgcggtgtggacgacgttcacctccggcctcgatcacttcgccaccagcgcgatcgtggcgctgctcgcatggctgctcggcaatctcgggcctgttgttgccgctgccccgaccgtgctcccgaccgcgccggcactcgtcggtccgtacgatcacgtggccacggtcgcgggagccttgctcctgccggcgttcatcgtggcgatcatcgcgcgcgtgcgggagccggctcacggatcgatcgccgaggtcctcgcccgacctgcagcctgggtgctgtcggtcatcgcgacgccgcccgtggtggccacgctcgagcgctgggttggcgtggtctcggccagcgcctacggagcgttcgccgtggtgccgtccgctgctctgtcgttgcggccgaccgtggtggccggagggttgcgctcgagcgccgcggtcgtactcgcccttgtcgcagccctcgctgccctcgcgtgctatctcgaggctgtgggacgcggggttgcggtcgacgtcctcgtcctgctctggccactcgtctcgatcgggctggtcctgccgggggcacgaaccctggtgcgccgaagcgccgaggtcctcgccggtctcgtcctgctccaactcgtgctcgccctcacgctcgggctcggggccgcgattgcgcaggcgaatggttcgcgtacaacggccctaccggtgatcggcgccgccctcgtcgtggcggcgagcctggcgccggcgctcaccttcggcatcgtgccgatcgccgaggtgcgtctgttcgaggtgacccggggccttcgacatctggcgagcacgggcctccgacggggcatcgaggtcggagggggagtcgtcgccgaagccatgccacctggagacgctcgccctacgatcccgccgtacgaggggtatcccccgcccccggaggtgctcgagcgcgcgaagcacgacccatgggtgcgggcgctcgtcgacccccctcgtcgtcgtccgtggcagcggaggcggggatgagcggcgtcgagctcggcacgccggccctcgggtcgcgggtcttcggggtgccggttgccaaggcgctcgcatggggcgcggtcgctgtggtggtcgcggcggctgcggcgcgcatcggcgggatcttgggcgtggtggtcgcggcggtcgtcgcgaccggcgtcgctggagctgcctcgatcgccgggtggcacccactctggtgggtcgtggtcgcggtgcgggagcgcgcgcgacgcgctaccgagcgggttggccagccgcgacgcgccgttcgcttcgatcccgatgccggcagtgtccgcattgctcggctcgtggcacgccacgctggcgtcctcggtcgggggcatgatggaagtctcgacgacgcgtggggcgagctgctccgggtgctcgggacgagcttgcgtggccgcgaacggtttctcgtgcgttcggatgtgatcccggcgatcgaacgagagcagttcgctctcgagccagacgatcgctggctggccgagcggacctggatggtcgagacccatctcggggtcgcgagtgacgagcgccgtgggcgtggacggcgcgtccgactcgtccgcgctctcgaggccgccgaagctgcggctcggggccagctcgcgctcgagccgatctcgtccccgtctgccgtcgcatggagcgtgctcccgcgcacgggtgaccgtccggatgccgtcctcgagcggaccgacgcactagagatcgacggcggcttcgtgcgcgccctccacgcggcacgctttccggttggggcggtccacgcgtggcagctggcagggctgttcgcccccgcaggaccgcgccgcgtcgtgaccctcgtcgcccaaccgctcgatcctcgaagtgcgcttcgccaactggggcgccatcgtgtcgagacagctgccgaccaggagcttcgccggcggcatggctatcggctcgggatcggtgagctcgggcgatcggatcgtctcgacgagatcgagcgggagctcgcgaacggtcacgccctgtgtcgatgggagctgttcgtggtcgtggccgcgccgacgctggccgagctcgcagctgagaccaccgccgccatcgagcgggccgcagcctgcagcgtcgatcttgccaccgtgctcggacgccagcgtgaggcggtcgaactcgcgctcttgggggtgtccggatggacctaggttggcaggactcgacccgtgcgctctcggtgctcgcgtttgcgcccacgcctccgccgcagccggcgccgagcaccgtcgtcgggatcgctggcagtggcggactgtttcgcttcgacgccttcgacctctacacccatgggtggctgacgaatcccaatgtgctgatcctcggcgacgtcggccgcggcaagagtacgctcgtgaagctgctcctcgtccggtctgcgatcgcggcctccggcagcttgctggtgctcgatccgaagggcgaatatggcgccgtcgctcgcgccgtcggcgcgagcgtcatgcgcccgcgcgcggaccatggcgggatcgatcccctcgctggctcgctcgatcagcgagagcgggctcgcgccctcggcagcgtgctcgaagcgttgtgtgagcgtccgctcgacgagctcgagcggcgtgcggtgtcggccgtgtgcgtgggaccgctcgcggggctcgccgacgccgctcgacgcctcgcggcgcttgacgcagaggtgttcgatgcgcgacttgccagtgccggtctcgaacgggcggcgcggctggcgctgtggctctcgcgcgtcgtcgacggggatctcgcggggatctgggagacgcgaggtggggggagtgcgctggctccgcgggtcgtcgtggatctcagcgacgtcggcgccgagcgttgggttcggatcgcggtcgcagcactcctccgcatgcggttggcgcagcttggcagcggtgaggttgcaggtgggctcgtggtcgtcgacgaggcatggacgctcgcgagcgagaccagtacgcgaacgctgctcgtgcgagcgctcaagctggcgcgcgcctacggcgtcagtgtggtcgcggtgacacatcgcctagccgacgtcgccggtgcgatggatctcatcggcgacgtcggtaccgtcgtcgccttcggacagtcgtcgtctgcagcccaggacctcgtcactgagctccatctcgacgagcgcgtgcgcgagctggtcgccggtctcgggcgcggtgtcgcgctgtggctcctcgggggacacagctggctggtccggcacgtcgttcgggaggaggaggtcgcactcgtcgacaccgacgcgcggatgcgggctccagcaccatgagcctcggtgcactgatcggaggcctcgctgccatcgcgaccctggccggtgtcggcaggccccgtacaagagagcatcgcagtggcccgcgaccactgccgcgcaccgcggggatcggcatcgtccgcagcgacgagatcgtggttcgactcgggcgctggcgccgtgtcggcgtggggcgaggatcgtcgttgctcgtggtcggcccgacccagagcggcaagacgcgcagggtcgtggcggagaacctgcgacgtcatccggggaccgtcctcgtcacctccgtcaagggtgacgtcctcgatgcgcgtgcgctcgagcggcgtcacgacctcggggacgtgtgggtcctcggtgatacgccgcgagcgacgcacgagtggcagccctggttcgaggccatcgacgacacccatgcactcgcgatggcagatcgactgctggcgatggtgcccgagcgcagaaccccgagcgccgaggttcggttctggcacgagcttgcacgtccctacgtggccgcgtggctgcgccttgcgtggtacggagagcaggtgccggtgggtgagttgctcgtccgcgcagccgaggtggcgggggacgaacttcgtgcggcccttgatgagacggtcgccgatggccgtcagcgtgactcgctgcacgtgaccatccaggcagcgctcggcgcggcccgaggaccgaggagtcgtgggtggccggtccgactcggcgaggccctcgccccgacggtcgtggtggtgggttcgctcgccgagcaggagcgccgctccgcctggtatgcgacgctcctcgacacggccttcgaggccatcttgcgccagccggccaacacgctcgtcctcctcgacgaggtggcccacctcgcgccggtgcctcgcctcgcgcacgtcgctgccgtcagcgtgggtctgggcgcacggctggtgacgatcgcacaggactttgcccagttggaggcggccttcggggtcgaagcagcctcattggttgccaaccaccgtgcccgactgttcctcgaccccgcccacgatcctggggttcgagcgcacctcgcggccctcgggctgcgaggtgacgagggcgccatcctcctcggccctcgtggtgcgcggcgtccgatccttgggtcggtggcttaggttcggcgaggcgctgccgatagctcgcacatgagcccttccacgattgcgcaggcgcttgacgacgtcgaggtcgcactcaccgctctcgaggcggcactcgaccgagacgacgtcgctgcgctcggacccgcgtccaacgagttggctcgtgcggcggtgtcgctcgggtcactcgtggccgaggaggcgccggtcgacgccctggatcgagaacgttatcgctccctcatgccgcgcgtcgacgcggtggtcgctggctgtgcgtggcgtgccatgctggtcgcgcagctcctccgcgacctcggagcggatcttggtatctacggtccggatggactcctcgaggtgaccatccccgagcgctcgagtcagctcgcatgagcggcggtgccctctacatcgcactctccggcctcgaggcgcagcaggtcgggctggacgtcgtcgcgcagaacgtcgcgaacgccaacactccgggttaccagagcgagtcggtggacctcgcgaaccagcaactcccaggcagcccggtcggcgacggggtcaccgtgcaaggagtgctccaggcgcagaacacgttcgcgcgctccctcgagctcgggtcgcaggcggcgtcgtcgtacgcgacgcagttgtcgtccacgctcaccgcggcgcagtccgggtccttccaggagccgtcgtcgaccggcatctccgagcagctcaacggactctggagtgcctttggccagctgtccgacacgccgacacagctggcatcggcacagtcggtcgtcgctgcggcgcagcaggtcgccgaggcgctcaaccaagcggcctccaacctcacgggtctgttcaacgacacctcccagcaggcttcgctgctcgtggcacaggtgaacacgcaacttgcgcaggtggcgtcgctcaacggccagatcgcggcgcagagcggcggtgaggtcggagcggcgaactccctcatcgatgcgcgcaaccaggtgctgtcccaactcgccaacgagatcggtgccacggtggttccggcgtcgtcccagcaggtgaacgtcctggtcgggggagtgacgctggtccaggggacccagtcgaacgcgctcgccgcagcgatcgcggctcccggctctccgccgaccgcatctgggacggcccagatcctgctcgcggggacgagtacccaggtgccggtcacgagcggatcgctcggtggcatgctcgcgtcgttgaacaacaacctcccgcgctacggcacccagctcaacgcgactgctcaggcgttggcgacccaggtcaacgggctgctcgcgtctggtcagacccaaggcaccactggcccgattgcaggccctccgttgttcgtcgcggctggaggtggcacgctcgatgccggctcgatcgctgtcaacccccagatcgaagcctctccgtcgctgctcgcggcctcgacgacgccctatgccggtggcaatggtcagaacgccgccgcgatcgcgaacctcggcagcgccgcagacggcccgaatgcactctggtcacaggcggtgggtcaggtcggactcgatgtgcagtcggcgacgtcgctcgcgacctccgcggcccagcaggcccagagtgctcagacagcggagcagtcctctgtcggcgtcgacgtcaacggccagctcgtcaacctcgtcacctatcagcaggcctaccaggctgcagcgaaggtgatctcgacggtccagcaagccctgtcgtcgttgctgtcctcggtgtcctaggaggggcgatgcaacccatcatgacgtccatcagcctggcgaacacgctgtcgtcctcgctcgatagctaccaaagccagctcagccagctccaggtgcagctgtccaacgggcaagccatccaggcgccgtcggacaaccctgccgggacggtgaacctgcttggggcccagacccagctcgccgcctaccagcagtaccagtccaatctgtcgtacgggcagacggtggcccagctcgcgaactcctcgctgacgcaggcggtgagcatcgtccagcaggctcgaagcgtcctgctccaagcaggtgctcccggggtcacctcacaggtcgcctcggggcttgcaacgcagcttcagggactcgagacctcgctgctcggcgttgccaacacgacgtatgagggccaggccatcttcgccggcacggcggacgtcgcaaccgcctatgtccagcctggcgggcccggtactgcggtgacctatcaggggaatcagcagagcgcgacggtcgcgggcgcgccgggcgtcgctctggcgacctcgttggccgacccattcggggcctccagcccgaccggcggcgtgttcgccgcgctgaaccaggcgatctccgacctgagttccggcaacacctcggctgcgaccaccaccgatcttgcgtcgctgactaccgcgctccagaaccttacgaaccaagcgggggcggccggtgaggctgtcacgcagttccagaacctcacgcagcaggtcacggcggcgattacgcaggtgcagagccaggtctcctcgctgcaggggctgaactatgcccaagtcacgacccagtaccaaacgctgctcaacaactatcaggttgccttgtacgcagcggcccaggtcaagcagccgacactggcctcgtacctcgcctaagggatctcgcatgacacgcacaacggaggatgccgctatggccatgaccaccacgcagccggcgatcgcgacggtgccgatcaccttcccggtcggtgtgcccggcttcgaggaacatcaccgcttccacctcgtcggactcggccccgcctatggaccgtggctcgcgctccgatccgcgatcgagggaggtccgaccttcgtcgtcgcccagccctatgagctcggcgtcgagctgacggtcgagatcgacgacctccatcaggccgtgctcggcattgcggatccgcagcaggtcctcgtgctggtggttgcgacgctgcgcaacccacacccgaccgtcaacctgcgcgctccgatcgtcgtgaacgtcgaagtgctgcgcgcggcgcagatcccgcaggatcgggacgactacctgctcgaggcgccggtgaccgtcccgctctacgacaccgctcgcctgcgcccgtcggaggcgagcgacgagcccggggctgatcgctgaggccccaccgtcaggatcacgcgtggcgctgcctcggcgcgacgggatctgccgacgcccgaggttggcgccctcgaccgacacggttggttggctgccaggatggggagctgcggcctctccgcccccgcatcggctcatggctcgcgagtcggtgagcggccactctcgtgtcatgacggtggtcggccacgagggaggcgtcgttcgacgtcggtctcgagcgacaggctcgttcgcactcagtttcgcgattgaccgtgccgtcgtcgtggtccgcgctcgacgtggcgaagcacggtcacaactggccgccgcgccggtcgcaagggcgtgtcgagagcgtgatgagtgcgacctcgatccctaggcctcggctcccgggcctgaatcctcgagatgcgctggatctgtgagtactcgagcactctccgcggcctcacggttcgcctgttggagcgcctcgaagacttcttgtcggtggacgtccacggatttcggcgcctcgatcccgatccgcacctgatctcgatgcacatcgagcactgtgatgacgatgtcggtgccgatcacgatgctctggctcgccttgcgtgtcaggactagcaccgcgcctccttgcgcccgaaggcactcgttcatgcccccaccagggggcagttcctccacggtcgagaggcctcttgcagctctttgcgctgctctgtgcccacgacgcgcctcgttcgcaagtgtagcatcacggtcggactccgatccgagttccttcatcgatcgctgaggcttcaagcgaacgtcgcaacgtgccgatgcgccaaggtacgagtgatcggaggagcgatgaccggcgcttcgccagaggagcttgcggagttccttgcggagtcacaggagaacttggaccgcttcgatcgtgacgtactcgcgctcgagtcggacccgtccaaccgtgacgcggtggcctcggccttccgcgcgatccacacgctgaagggcacatgcggcttcctcggcttcggccgtctcgaggggctcgcgcatgacggggagagcttgctcgcacgggtgcgcgacggggcggtgcgagtggacgccgcggtagcagacgcgttgctggctctcgaggacgcggttcgcaggagtctcgacgccatcgccgccaccggcgacgaggacgacgagcactgggaggagctccgcgcacgcttggttgcgctcgcggagcaggcccacgaggcgccgcggtcggtcgcgggcgcgaacgccgtcgtcttcgcgccagcgccatcgtcgggcgcgcctgccgagctctcgtcgggacccgagtcgcaggcgtccgtcgagggcgacgtggcgcgcggcgccgagccggatgggaagtctggcgctcggccgacactcggcgagaccgcggtgcgcgtggacgtcgggctcctcgaccgtctcatgaacctcgttggggagctcgtgctcgcgcgcaatcgggtcatgcagctcgcccaatccgagggcagtgcggcgctcgcagcgagcacgcagcagctcagcatcatcgcctccgaactgcaagaacaggtcatgaagacgcgcatgcagccgatcgacaccctgttcgcgaagttgcctcgagtcgtccgcgacctcgccagggaactcggtcgcgaggtcgaactcgtcctcgaagggcgcgacaccgagctcgaccgcacgatcatcgaggcgatccgcgatcccatgacgcacctcatccgcaacgccatcgaccacggcatcgagccacccgacgagcgccggtcccagggcaaggcggcccatggcgtcctgcgcatcgacgcctaccacgagggcgggtcggtgattatcgacgtgagcgacgacgggcgaggcatcgatctcgaagccgtgcgggctcgtgcgctcgcccgcggtctcgtgcacgccgacgagctcgcacgactcgggccgcgggaggtggccgagctgatcttcgtgcccgggttctccaccgcgacgaccgtcagtgcggtgtccggccgtggcgtcggcatggacgtggtcaagaccaacgtcgagagcgtcggcggcagcatcgacatcgactcggatccgggccgaggtacgcggatgcggctgcgcatcccgctgacgctcgcgatcatcccggcgctcatggtcgagacgcacgggcagcgcttcgcgatcccgcaggcggcgcttgccgagctggtgcggctcgagctcgatggtcggcactcgctggtcgagatcgtcgaccacacccccgtgctccgccgacgcgaccgtctggttccgttgctcgacctcggagcgatcctcgggcttgcgccgcccttccccgagcgaggactcgatgcggtgagcgtggtgatcttgagcgctggcgccacgagcttcgggatcgtcgtcgatcggatcgtcgacacgcaagagatcgtggtcaagccgctcggacagttcgtgagccagctccagtgttactccggggcgaccatcctcggcgacgggcgggtcgcgctcatcgtggacgttggcgggatcgcgcagctcggcggtctcgcggtggagcgtgcacacgagacgacgtccgagtcggtaggggaagccgagtccgaggctgagcccgtgatcgtccttgctgcgggcgggacggagcgactcggggttcgtctccgcgagatcgagcgcctcgaagagttcgcgctcggcgcggtcgagtacgttgaagggcacgaggtcgttcagtatcgcggtggcgtcatgcgtctcgtccgcctcgctcacctggtcgggctggcgtcccagcctgcgcgccccgacccgatcaacgtgatcgtggccgttgatcctgctgggcagctcgtcgggctcgtcgtcgacgaggtgctcgacatggcgctcgccccggtgagcaggacgcacggcgcgatcgtgctcgacggcaagctcgtccgggtcctcgaactcgacgcgctgctcgagcgtgcgggtgaggtgagccatgtctgaggtctcgacgctcgcgaccttccaggtggcccatctccggttggcgctcgatgtcgagcgcgttcaggaggttctgcgccgccaggaggtcacgccggtgccgctggctccgagttcggtcgaggggctcatcaatcttcgaggccagatcgtgaccgcactcgacctcgccgacccgctgggggtgaccgagtccgggacccgcgagacggcgttgatcgtccgtgtgggcgacgagctgctcgcgctgctcgtcgacgacgtcggcgacgtgatcgaggtgcccgacgagcagcgtgcaccgatcccggagacgctcctcccaccgctgtcggacctcgccgccaacgtcgtcgtcggcgctgacgacgtggtcgtcgtgttggacctcgagcgactcctcggtgcgttccgttgaggtcactgctcgtcgtcgacgactccggcgtcgtgcgcatgatggtgcggcgctggctgctggaggcctgtcgtgatctcgaggtcgtcgaagcctcgggtggtcgagctgcgctcgagctcctcgagcagcgcaccgtcgatctgatcctccttgatgtcgagatgcccgacctcgacggcctgagcgtggtgcgcacgctgcgcgtccggggcgttcgtaccccggtcgtgatgttctcgaccctcacgagtcgcggcaccgacgtcgcggtggcggcccttctcgccggcgcaagcgacgtcatcgccaagccgcaggcatcgaaccagggcgcgggccgtcaagcgctcgtggaacgtgtctgttcgttgctggcggccgaggaggagctcatcgtggccgcggcaacccagggcgtgcctgcgtcggcccgggtcgtcgagcccgccacgccgcgcgtgggcgcgggtgccccacgcatcgcacaccgcgtgccgtggcaggccccggcgatgcgcacgagcccaacaccgcgtcgtcaggaggtgccgacccatcgtgcggcacctccgctgaccgtcctgcgccccagacggccacaagccccgggcctcgtcgttgtggcctcatcgaccggtggaccccaagcgctggcttcgttcctcgcgggcctcggtcgagtcgcggtgccgacggtgtgcgtgcagcacatgcccgccagcttccttccgctgctcgctgcccgcctcgccgagcagctcggctcggacgtcgccctggccgaggacggtgaggtcgctcgcgcgggcaccgtccgactcgcggctggaggccgtcatctcatcgtgacggcggatcgccctgacgggagccttcggctgggctacgtcgatcaaccaccggagaactcctgtcgcccatcggcggacgtgctgtttcgctcggccgccgcgaccggcgtgcgagcgatggcggtcgtgctcacgggcatgggggccgatggggccaagggtgctgctgccgtcgccgaggcgggcggtgtcgtcgccatccaggacgcggcgagcgctgtcgtctgggggatgccgggtgcggtcgatgccctcggcgtggccagcgtggttgcgccgccagccgagctcggcgaccgcgtccgtcggctggttggcatgccctgatggtcgatcccggcgtcttccagcgcattcgtgcgttcctgcgccgcgagatcggtgtcgatctgggtgcggatcgggcctatctggtcgagactcgcctcggttcggcgcgatcgctcggccgttggcgctcgatcgatgcgttgacgcaggccgcggaggccggcgacctcgaggcgcggcgtcgcttggtcgaggcgctcgtcaccaccgagacgttcttcttccgagacagtgcggccttcgacgcactgcggacgcgcgtcttgcctgagctgttcgagcagcgccgcggtggcaccatcgcgatctggtgcgctgcgagttcgtccggccaggagccgtactcgatcgccatcttggtggcgagccgatttccgtcactgcgctcgcgggtgcgcatcctcgccaccgacgtctccgaggacatggtcgagcgcacgcggcgcggggagtactccgcgttcgaggtgcagcgcggcctggaaccgcggatgctcgagcaagccttcgtcccgatcgccggagggtttgccgtacgcgacgagatccggcgcatggtcgaggtccgtctcctcaatcttgcccagccgttcccgtcgatcgggcccttcgacgtcgtcttcgtccgcaacgtgctgatctacgtgccgccaacggaccgacccgccatcttggcacgcgtcgcagaacggatgcggcccggcgcctacctcgtcctcggcaacggtgagtcggtcggccctgaggtgcgcgcgttcgagcgcgcgagtgacctccgggcaccgatctatcgtcgggtcgacggagtttgccgagcaacgcagcatctgcgagactcaagggcagcgccgagccgaggaggagggggtgccacggggtagcgtcgtgccgctttcccagagcgcgtaccagagcatcagatctgccatcgtggacctgacgttgccaccgggatcgttcttcctggatcgagacgtcgcggatctggtcggtgcctctcggacgccgattcgtgaagcgctcgcgcgtctcgaggtcgagggttgggtcgagtcggtgccgcgcaagggctttcgcgtgagcggcgtggacctcgacgaggtcagtgagatggccgagatggtggccgggatcgaagcggcgggctgcatcagccttgccaccgagcaagatcgagtgcgtacctcgctgctccgtgagaccaacgcgcagctcggcgtgttcgccgaggagggcaacgtcgtggccttcctcctccacgacgaccgattccaccgactcaccgcggcgggtgggctcggtcatcggctcaccggttcgatctactcgctcttgatcgatcaactccatcgcgcgcgccgactgcgccccgcgtctcccggtgacctcctgcgtcacgtcgaggagcatcgcctgctcatcatgtcgctcgagctcggtgatgccgaggccgcggcgctgatctgtcggggccatcgtcgccgcatggtcgagcgactgcgcacgacgatcgagagcctcggacgtgaggtggtcgagacgacctcgatgctggtagacgccgcgggtgacgagacctcgtcgagcgcgagcgatgaggaggccgcggtcggtgacgcggcgcgatcggacgccaaggaacccgaggaaatcatcggccagatgagcgctgaggccgccgagcgttcgcagcgtcgtcgggtgaggctcgggcggcgacgccgcagtgagggaggctgaggaccaggaggcgtcaagcgtaggccgcgccgtgccgataccacgatggaagaacgagtggcgcaaggaggcacggtgaagattctggttgcggacgactcgcgggcgatgcgcatgatcgtcattcgacagctgcgtcacgcggggctcgacgacgccgagttcctccaggcagagaacggcttcgacgcgctcgagctggtgcggcgcgagcagcccgatctcatcttgtcggactggaacatgccggagatgaacgggctcgagttcctccaggcgcttcgctccgagggcagcgacaccccgttcggcttcgtcacgagcgagggaaccccggacatgatccggatggctcgttcggctggggcgacgttcctgatcgccaagccgttcacgcccgagggattccgcgagacgctcgagggtgcgggggtcttcgcgtgagcggtgtcctcgacctgtggtcgacggcactcgccgacggcgtcgcctcgatgcgtgaaggcatcttcgcgctgttcgatggcgtggtcgagcaggttcccggagcgagcgtcgagggcctgccaggtgcgtgggtctcctacgtgggggagcgcctcgccgtggagtttgccctcgtcgcgccagacgtgaccttggtggcgctcacggcggccctgacaggcctcgcagagccctcggaactggccgtcagcgacgctgtgatcgagatcgcgaacatgctcggcggcgtcgccaagcgtcgcctcgtcgccgctgatccgacgttgcgcaccggcatgccgaagttcctctacgccggtgcggtcgtgccacgccagaccgattcgctcgtcctcgaggccggcaccgtggccggtccggtgctccttggcgccatggtgagccgcgcagcggatcgcgagcttgcggagctccacccatgaccgtcgctggctacgacgtaccgttgctcccacgcctcgacgacctcgagcggttgttcatcaccttgctcggtcgagaggtgcggatcaaccgactgcgccagggcgtgacgatcgccgagcccgatcgcatcggcacctatgtggaccgtagcggcgccctccggtgcgtcgtggccgtcgatcgcacgctcggtgctggcctcggcggagcgctcgcgctcatccctcccggggcggttgaggaggacctcgccgagtccgacgagctgcccgagcacctcgcggacaacctccatgaggtgctcaacattctcgcgagcgccttcaacgagacgcgcgagcgggcgctgcacgtgcgccttagcgacgtcgtcaccgccagcgagggctcggaggcagttcacgcactcctcgcaggaggcacgggtcgcgtcgactgcgacgtcatcgttcctggctatcccggcggccaactcgcgattcggatccagtgatgctcgttcgcgtctgtgaccacgagcgtgtgggggccgacggtgcggcgtgggtgctcgttcctggcgagtccgtccctcccgaccagatcgctgctgcgcctgccgtggtcatcgtggtcgaggatgcgctggtcgatgcgcggagcgcgcggcgtctcgtcgaactcgcgagccagggggtcgtcgcggtacctcgctcgccgagtgtcgtcggcagaggacatgtcctgctcacgaccggtgacgacgtcgggaccgtcgagggtcgtgaggcgctcgccgaacgagtctcgaagcactttgcgggcctcaccgaggacctcgagctggtgcccacgctcgccgtggccgtgcccggcgcttgggcagcgagagcgctggacgaacgttggacgacggtccatgagctcttcgcgcggctcgtcgactcacggccagccgaacttgcgttcgatgccgtcgcggtggcgcggcgtcccgttgaggggctcgtgccggctgcaccgcggcgacgccccctggtgtcggcctgcatgatcgtgcgtgatgaggccgtgtggctcgctgacgccatcgattcgttggctggcttcgcggacgaggttgtcgtctacgacaccggttcgaccgacgcgacggtcgatgtggctcggcgtcacggggctcgtgtgatcgagggcacgtgggatgacgacttcggagcggcgcgcaaccggagcgcggcggacgcgcgcggcgagtggatcgtttggctggacgccgacgagcgcctcggtggcgatctcgccacggcccgggcacgtctcgcagacccgctagcgcagtgggagggctacagcgtccggatccgcaacctcacgggtgtggggctgacatgggcggatcactttgcgatgcggctctttcgccgtgcggcgggcgcctggcgcggagccttgcacgagacggtctggtcgcgtgatcacgctcggccgctcaacgcgcacccggcgagcgagctgcatctcgttcatctcggctacttggacgtggtgatgcgccaacggggcaagggggagcggaaccttcgggttgcatcgcacaacgagtctgcgtccgaaccgctcgaggcgctcgtgcacgagatccgctcacggttgctcgccggtgagcacgccacggtcgttgcgctggtggaggaccgggtcctgccggctcctcctgggccgttgcgcaagctcggactgctcgctggcttcgagagcgccctcgcgctggggagcttcgacgtcgcccgtaccttcgtcgacgcattggccacgcagcccgatgtcccagccgccttcgcgctcgaggcgagcgctcggttggccgccacgaccggcgacctcgagggggcccttcgcgatctcgccggcatcgacacgcgcgtcgaggatgtcgacggtctcgtggtcgatcccgagcgccttgccggcctcaccgctcgctgtctcgccgggctcggccgcttcgatgaggcgagcgacgtcgtcgtcgcggcgctcgcgcgtggcacggtcgacgtcgatcttcgcgaagtcgtcgcctggttcgaccacgccaaccgaccactcgccgatcttgagtccgcgatccatcccgagcagcgtcagctcatcgcggcctcggtactccccgctgcggagcttgccgagcgtctcttctgggcgttcgtcgaggcgaaccccgcttgcaccgtctggcttgccgcgggcgagctggcagcgcgacgcgtcggcggcccggtccacgagcggtggcgtcgactgctcgccgacgccggcctcgtaccgagtgcctagtaggggtgcactggactgtaacgcactggactgtcacgcgcgggcgctgcaagagccatcggctccaggcgggaagagagtggcgcctccgggacggccggcgctggtgtgcggcgtcctctctccggtggctggagcagagatcgcaccccggtagctccgagtggcgccagccactgcctcgcgcgtcgtcgtccccgacgcaggcgagggctccggtgccggtcctctcgctgcgcggacggccgtggggcgtggtggcgcgtgcggaaggccccggagcgagccctagtcgtcatccacgtggataggagcgctgctcgtgtcggtttcgcgagccgtgcggggccgtacatcttggtcggtgcgacgacgtgagctcctcgccggggatgattccagaatctgacccatcccgtgctccgctggtgggtgtcgatcgggagagggcagagcagttcaagcacgcggaggagcgtgactgacgcgaaggaagccttctcggccctcaggcggtggtggcgtcgctcaaggggagtgtgacgtcatcgaatgcgagttcatggccctgacgcaggaggcgcaccgtaccgactccgacgcgctcgagggtgccgtcgcctcgaacgacgaggcccgtctcttcatcgatctcggcaaccgtgacgttgggtggagcaagacgaaccgtgcggcttcgtaggtcgcgtggccaggtgtcggcgtgcgggatgacggcgagaccggggatcatcccgagccccaccgtgagcgcgccaccacgtgggtcgaccatgggatcgccgatgaccatcgccccagccgacgaggcgaggacggtcgccccctgatcgagtgtggcgcgcagtgcatcgaggatcggggtcgcgcgcagcacgcctcgcaggtgaaacggtgagcccccgatgaggtagaggcaccgcgcggtgcgaaccatgtcggcgagcaccggatcgaaggcctgagcgcgctcgtacagcggtagctcgacgacgcgaacccctgctgccccgagtacggattgggctcgttcgacggcgcgttcgggtcgctcgaaggcggccgctgtcgggacgagcagcagttcgccccctgcctcggtggcgaacgtcgcttcgaagctcgcgcgcgaaccgaactcgccacccccgaccaacacgatggttcccagccccacgtcgaggatcctaggccgcgaccgtggcgagcgcgccggccacgtccccgataggatcgcgccatggagggcagtgatccacccttgtcgatgcccgatcccgtcaggcggctcggcgtcgtcggtacggggacgatggcgaccggcatcatcgaggtcgccgcgcgaaaggccatcgacgtcgtcgtctgggcccgctccgaccagagcgcgtcagcggtccgggagcgcttgcaagcccggctcgcgcgcgaggtcgctcgtggcgtcatcgctgagcaggccgcccatgaggtcggggagcgtgtcagcatcacgcgtgcggtggatgacctgggtgggtgcgaggtcatcgtggagtcgatcgtcgaggcgctcgagcccaagcgggttctgttcgcgcagctcggctcggtgaccggtcccgagacggtgctcgcctccaatacgtccaccctcggcatcgggcagctcgcccaggtcaccgagcatcccgagcgtgtgtgtggactccacttcttcaaccccgtgacgcgcatggagctcgtggaggtggtccggggtctcgagacgtcgcccgcgaccatcgctcgtgcgactgcgttcgcggtgcagctcgccaagacgcctatcgaggtcgaggacgaagccggcttcgtcgtcaacgccttgctgttcccctcgatcaacgccgcagtccgcctggtggagcgtggtgtcgcgagtgccgaagacgtcgaccgcgcgatggtgctcggcgcgaaccaccctctcggaccgctggccctcgccgatctcgtggggctcgacgtcaccgtcgcgatcctcgatcggctctgggcggcgactggagacccggcgctcgtgcccgcgccgacccttcggaggctcgtcgcggcgggccggctcggtcgcaagagcgggtggggtttctaccgttacgacggaggggatcggtgatccgccttcccgagcccgaccgaccctgggtcatgcggacctatgcgggtcactcgagcgcccgggccacaaacgcgctgatgcatcgcaacctcgcacgcggtcagaccggcctctccatcgcgttcgacctgcccacgcaactcggctacgaccctgacgacgcccttgctgagggcgaggttggcagggtcggcgtgccgatcgcccaccgcggcgacgtcgccgaactcttcgacggtctccggctcgacgccatgaacacgtcgatgaccatcaacgcaaccgccccctggctcttcgccctctacctcgaccgggcgagcgaggaggggagtgcgtggggggcgctggcgggtacgacgcagaacgacctggtcaaggagttcctctctcggggcacctacctgctcgaccctgccaactcgaagcgagtcagcgtcgatctgatcacgttcgctgtcgagcacgtgccgcgctggaaccccatcaacgtctgttcgtaccacctccaggaggctggcgcgacgccggtccaagaggtcgcgatcgccctcgcgacggcgatcgacgtgctcgatgccgttcgagctcgcggcgtcggtgacgacgtgctcgcacgagccgtgggtcgcatgtcgttcttcttgaacgcaggcattcgcttcatcgaggaagtcgccaaggtccgggcattctcccgcctctgggaaggcatcgttcgtgagcgctatggcatcaccgacccacgtctcgcgcgctttcgctatggggtccaggtcaactcgcttggcctcacggagctccagcccgagaacaacgtctaccggatcatcctcgaagcgctcggggtgacgctctcgcgcgatgcgcgggcgcgggcgttgcaactgccggcgtggaacgaggcgattggcctgccgcgcccggtcgatcagcagtggtcgttgcgggcgcagcagatcctcgcctacgagaccgacctcctcgcctacccggacatcttcgagggatcgtacgtcatggagcagctcaccaccgagctcgccgatgcagccggcgccgagctcgagcgcatcgtcgccgacgggggtgcgttcgcctgtgtcgacacgttgaaggcggagctcgtcgcgtctcaggccgagcgcctccgagccatcgaggccggcgatcaggtcgtggtcggcgtcaatcggttcgtcgagtccgagccgtcgccgctgcgtcgaggcgacgacgtcgtccaccaggaggtcgaccttgccgccatcgaggcgctcatcgcgcggctgcgcgagcatcgacgccagcgtgagggacgtcgtgtcgtcgaggcgcgccgggccctcgaggaagcggctcggagtggaacgaacgtcatgggacccacgttggagctcgtccgtgccggcgggaccaccggtgagtgggcggcgacgctccgcgacaccttcgggtcctatcgcgccccgaccggtgtgggtgcggttgccgaacgcctcggccggcggggtcggtcggtgtccatcgtcgcctcgccgccgccgcgcctcctcgtcgccaagccgggactcgatggccactcgaacggcgcggagcagatcgcggttgcggcacgcgatgcgggtttcgaggtcgtctaccagggcattcgccagcaacctgccgacattgcggcggtagcgcgcgacgaggacgtcgacctcgtcggcctgtccatcctctcgggctcgcaccgcacgctcgtaccgcaggtcctcgaggcacttcgggcagctggcgtgacggttccggtcgtggttggcgggatcataccgccacccgacgcggcctggctcgaagagcacggtgtggctcgcgtcttcacaccacgcgactggcgtctcgacgagatcgtgcgcgagctcgtcgtcctcgcgcgtggtgctcgctcgtgagcggcgtcgctgctcaagccgacgagccctgtgccgatgattgggcatatgcggcggttcgtcgacgtggtggcagcggtcctcggtctcgcgggggtgctgctcggggtcctcgggactcgtacgcaggtggccaacgatggactgctggggtcgctcgtcggcgccctcgggatcgtcgtgctcctcgttgctggagcgcgacgcctcgagcgcagacagctgggtcacgacaaggcctcgacgacggggggtgagaggactatgacacagtcggcagcgtcgagcgacctcgaggtcgtcgtcgatcgcgaaacgggactcatgaacgcagccttcttcgctggtctgctcccgacgaagctcgcgacggcacgacgacgtctctggccgctcagtatcgtcttgatgcgggtcatggaggctgaaggcgaggcgagcgccgagggtcctgcgaccatggccgggtttgccacttcggtgctcgagaccattcgcgctgccgacgtggcgtgtcgggtcgggggcgacaccgtcgcgctcgtcctcgacgacaccgacgaggacggtgcggcatgggtggccgagcgggtacagatccaggctgcgcgttcggggaatgccggcatcgccaaggtctgctgtggcgtcgctgcctatccctctcatggcatcgaggccgacgaactgctcgccgtggcgcacgaagcccttgcgcgttccgtcgccgaggcggaggggccggggctcgggccggtgatcgtggctccgacgcgtccgctctagcgacgagccgaggtggcacatgtcataagctggcgcctggtgagagtcgggtgagtggcgagcctacgacgtgagtgatgcgtccgagcgtgtcgtgctcatcggcttcatgggggcgggcaagaccacggtgggtcgcttgctcgctcgtcgcctcggtgcagacttcgtcgacgccgatgacgcgctcgttgccgagaccgggcggtcgatcccggatctgtttcgagtgcgtggcgaggtcgggtttcgccagctcgagggggatctcctgggtcgcctgctcaggtcggcgcgtggcgtcatcgcgctcgggggtggggcgatcgagcacgacgagctcgcggagctcgttgctccgtggctcgtgatctatctcgaggtcccctacgacgttgcccgtcagcgagttggatcggacgacgggcggccgatgctgaccaggtccgatctcgagtcggtctaccgacggcgcgtcgctcgataccggcgactcgctgacctcaccgtcgacgccaccgacgcaccgtccgtcatcgtcgacgagatcgtcagcgcgtttggtgcgctgggcgacggctgaggaagtcgtagagaacgacgaggaagagcgtcaaggtcatcacgtggacgctcgtgcaccagaggcagatcgatccgatcttgacgatctcggcgtagaccagccaaaggacgaacaccacaccgaccccggccagcgcgaggcgcacggcgtcgagcgcgcgatggcgccacgcgaacggcagcgagagcactcccatcgcgaggaagaatccaagacccagcaccgcgaccgggatgccgaggatggtcgactcaggcgaggtggtgaccttggcgcagttgacgatgccggtgtcggggcacgcgagcgtcacggtggtgtcgtagtgcgcgatggtgagatacgtcgccacgcccaggcccgcgagcgcgatgagggcgacgaggccgcgcacccatcgcggtggcgtggctagagctgcgactcgaggtgcgagatcactggatcggtgcatacggcccctggtgcgttgtgggtgagcgtgcagaacgcggcggtgaactcgttggcgagcgagtcgattgcctgggcgggcttggtcgacgggtcgcgcaggcttgctgcgatcgtttgccaactcagcccatcgaggatcgacggcgtatagctcgcgccgatgtcgaggaacttgccgcccatgtcgatgaagggaatcgatccgtcgtactgcgtcgacggcacgtacggaggggcatcgagcttggtgagcagtgcctgctcggctcgggtcggagcctggagggcttggtaggtccgcgtctcgatctcgaccgggacgaagctcaggtaggggctcgtgtagtgcgaaccatagaaggtgaaggtcggggtgttcgcgaagacatcggtcgacgacgagcgcatgaggtgcaggttgctgaacgtcccaaaccgagagagtgcgacgatgagcccccagcgttcggcggcgcagtagggacagtagtcagcgccgatgtagagcacttccggcttgccatcggcggtgagcgcgggctggccggccagccgatggaacgtgctcacgacggagctgtcgaagccgaccgcgtcgagcgccgagcgaggtaccgaggtgatcgccgtctcgacatcggctgggaccggggcattgatgctcgatgcgtcctggctggttccggaggagcgtagggcgaagaaggcggcgacgacgacgatcaccacgacgacgaccacgctcaccgcgatggcaggtcctcgacgagtcgggggccgttgtgcggttcgcgctcgagccgtcatggttcgctcctttgctaccgtcgtcgacgatcgccagcctacggcttcgatcgtctcgatggctcgcgtctgactcagggaacgctccgaggatgcagagcaacagctgaatcggcgccggctgcactgctagcgtggcgccatgagcgcactcgatcggctccgggaccttggcatcgaactcgttgcgccaccaccagcggtggggtcgtacgtgcccacgctggtcgtggacggttggtgctgggtgtcgggcatgctcccgctcgccgacggctcggtcgtccatccgggcatcgtcggcgccgacgttggtctcgaggaggctcgtgaagctgcgcgcgttgcgacctcagtcctgctgtcgcgtctcgcggcggatctcgggtcactggatcggatcgagcagtgggtctcgctcacgggctacgtccagagcgctccaggattccacgatcagccggcggtgatgaacgccgcctccgacctcgtggtcgaggtcttcggcccggcggggcgacacacgcgcgccgcggtgggggttgcggcgctgccgctcgcagcaccggtggagatcgcagcagtcctgcgcgtccgctagacgtccatgctgggcgttcggcggcgctgacctgtctggcgcggccactgcgccagcgcgagcccgatcgcgacgagcgcgacgccgacgagtggtcgaggaccgatcggtgtggtgtggagggcgagccccccgacgagggcgcccactgggatgagggccacgtagggcgcggcgcgtgcgacaccgagacggtggatgcctcgaaaccagaggacaaatgcgccgacggtcacggcgagcgcgatggcgacgtcggcggcggtctcggtcacggtgggggcaggcggcactccgccggtgatgagtccgatcgcgacgaggccgatgcccgctgcggcagcgctcacggtggtgagctcgccaggttcgaggacgcgcaagagcggcgctgatacgagggtgaaggtggcgtcgctcgcgagcgcgacgactgcccaggcaagtccggcgggcgcgaggctgcctgcgccgttgaccacgatggcccccatcgtcgcgatcacggtgcccgtgatgagcgctcgagggatgccgcggcgagaggcgagtgcagtgcccgcggcgatcacgaggggagcgaggccgaccacgacgccgacgcctgccgcggtgccgtggcgcaacgcctcgatggtcgccacggagaagagcccgagtcccacgaccgtatcgacgacgagcaggagcagcatccgcgcagggaggtgacgctggagcggcagagcccgccgtcgcagcacgatgacgagcaccacggcgccgatgaggtagcgtgccccctggctgatgagcggtgggtaggcgacgagcaaaccggaggtagcgatgccgagcccgacgagcaacggggcggctccggcggtgaggtgagcgccgtagctgggatcatcgcgtggcatcactcttaccttacggctggctcggcgtgcgggccctcgggtggatcccgtagactgagcgcggcactcggggagtggaggtgtgcgagatgctgagtgagcgggtagttcgagccaggactctcggggacgtcgtcgcgcccggggcgctcgcgcgtgtcgtggcggtcgtcggctacgcggccttcatcggagtgctcgcccaggtggcgatcccgctccccttcacgccagtgccgatcaccggtcagacgttcgccgtcctcctcggggccctggcgctcggtccggggctcgccttggcgggcacggcgctctatgccgcggtggggctcgcgggggtgccgtggttcgcgggagcgacggggggcctccacatggtctctgatccatcgttcggttacatcgtcggtttcatggttgcggcggccttcgtgggctggctcggaacgcgtggtgcggatcgtcgaccgctcaccacgatcgtggcgatggtggtcggcaacctcgccatctacgccgtcggtgtcgcctggctcgccgtcgcgctcggcgtctcgctcccacgggcgctcgaactcggcatggtgccgttcgtcgtcggggacctcgtcaaggtcctgctcgcggcgggcctgctgccgggagcgtggttcgcactgcgccgtctcggtgcacgtggtgtcgaggggtcgcgtccatgacgcactccgtcgcggagcggctcgaggagctgcggcggcgtcgtgaggaggcgtaccacgccggcagcgagcgtgccgtcgagcgccagcacagccagggcaagatgaccgcacgcgagcgagtcctctacctgcttgacgagggatcgttccaagagctcgacctgctcgcgcggcatcgggcgcacggccttggcctggaggagcgccggccctacacggacggcgtcatcaccggcttcgggacggtgaacggtcgcaaggtctgcgtcttctcgcaggacttcaccgtcttcggcgggtcgctcggggaggtgttcgccgagaagatccacaaggtcatggacctcgctgccgcgtgcggcgtgcccatgatcgggttgaacgacggcgcgggcgcacgtatccaagagggcgtggtcgccttgcactcttacgggggcatctttcgtcgcaacgtcgcgagttcgggcgtcatcccgcagatcagcgtcatcctcggcccctgtgctggcggtgcggtgtactcgccggccatgacggacttcatcttcatggtcgaggggacctcgcacatgttcatcaccggtcccgatgtggtcaagacggtgaccggcgaggaggtcaccctcgaagagctcggcggagccatgagtcacgcgacgaagtcgggcgtcgcgaccttcgtgctcccggatgagaagagctgtctcgacgaggtgcgctatctgctcgagttcttgccgtcgaacaacatcgagatgccgccggccgtgcaggcgaccgacgatcccgatcgcgaggtcctgtccctgcgcgaggtggtacccgacagtcccaaccagccctacgacatgcacgacgtcatcgcggccgtcgtcgacgatggcgagtatctggagtacttcgcccactgggcgcgcaacatcacctgcggcttcgcacggctcgacggcaaggtcgtcgggatcgtcgcgaaccagccctcggtgctggccggggtgctcgacatcgactcctcggagaaggctgcacgcttcgtgcgcacgtgcgatgcgttcaacatcccgctggtgacgttcgtcgacgtccccggcttccttccgggtgtcgaccaggagtacggcggaatcatccgacacggcgccaagctcttgtatgcgttctccgaagccacggtgcctcgcatccaggtgatcactcgcaaggcctacggcggcgcctacgtcgtgatgaactccaagtcgatcggcgcggacttcgccttcgcctggccgagtgccgagcttgcggtgatgggccctcagggcgcggtggaggtcatccaccggcgcgaactcgcggccgcagcggatccgacccgtcgacggtccgagctcatcgacgaatacaccgagcgctacgcgaacccctacgtcgcggccgagcgcggctacatcgacgacgtcatcgacccggcggacacgcgacgggtgctcatcggtgcgctcgcgatgctcgagaccaagcgagaggatctgccgcggcgcaagcacgggaatgtgccgctgtgagcgagctctcgtccgaggaggaactcgctgcggtcgtcgctgcgctctgggcgcaccgggcgaggtcgtcgcctgctgtggccgagccggcccaggacgacaccaggtggcgtttccagcgccgatggtggctccagggcgtcctgtcgctccgtcagcgacctcgtccgacgctgtgacagacgccttgccgccgagctaacctcgcctccgtgtcgaccatcgatctcgctgcgtatgtcgacggcgtgagccttgcggccgcgttgcgccgtcgcgaggtgggcgtcctcgaggtgctccaggcgacgctggagctgatcgacgagcgcaacccggcgctcggggcgatcgtgtggctggaccgagacgacgcccgccgccgggcggagcgggcggctcggcgcctcgacgccgacgaccccgcaccgttcctcggagtcccgctgccagtgaaggacctgcacccggttgcgggatggccgatcacctacggctcgtggggaggtccggagggggtgagcgcccggagttcgatcgccgtggaggcgctcgaagaggctgggttcgtcctggtcgggcgcagcgcgacaccggagctcggcgaactgcccgcgaccgaaggggatcgctacggggtcacgcggaacccgtgggacctgtcgcgcacccctggcggctcgagcggtggtgcggcagcagccgtggccggcggcatggtcaccgtggcccatggttcggacggtggcggatcgctccggatccccgccgctgcgtgcgggctcgtggggctcaagccgagccgaggtcgtgtgccggcgcgctcggccccctggttcggtctctcgacggaaggtgtcgtgacgcgcagcatccgtgaccaggcggcctgtctcgcggtgctcgccgctccgcgtcgcggtgcctggctcccgcagccgcccgctgggttcggcgacggtggctggcacgtggcgccgacgcgcctgcgtgtgggggtcgtcaccgaaccaccgttcggcctcccgatcgacgatgcccggcggctcgcggtcggcgaggttgcgcgtctcgtcgccgatctcggccatgaggttcgggaggtgaccctcgcgttgcccgacgagctgatcgaggccgtctcggtggtcgttggggcaggcgtcgccgagcacgacgatctcgattggagtcgggtcgagccccatacggcggccgagtacgagcgggcgaaggcgttgccggcgaccgagctggttcgccagctcatggtgctcgagcgcacgggctcagacctcgcggcagccctgccaggcgacgtcgacgtgctcctcacaccgacgacagcgatcgcccctcccccggtcggtacggtgctcgaagcggcgcatgcggccgcccacaccggcctccctgcgctcgaggtggtgtcgctcgcgatcttcaccctgccgtggaacatcgctggcctgccggcgatctcgctcccgacgcacctcgacgtcgatggcttgcccatcggcgtccagctcgtcggaccgcccgctggcgaggcgacgctgctcgcgctcggggcggcactcgaggaggtctacgagtggaccacccgacgacctcccgttcagcgctagcatccgagcccatgacccttgcggaccctgtgtgggtgcgccgatggctcgaggatcacggtgtcgcgttcctcgagcgcttcgtcgccctgaacagtctctcacctgcgttcgatccggagtgggagcgccacggcacgctcgccgccgcgatcgacctcgctgcggagacggtcgaggccgctggtttcgaaggaaccgagatcgtgcgccagacgatccccggccgatcgcccgccctggcggtgcgcatccccgggcgcgggcacggtaccgccctcgtctacggccatctggacgtgcagccggccgtcggcccgtggcgtgacgggagcgatccccatcgtgtggtgcgtcacggcgagaggctggttggccgcggcgtggtcgatgacggctacagcgtcgtggcggttctcgccgcactcgagggactgcgggcgatgggcgcggatgccccgacggtgtgggcactcttcgagacctcggaagagagcgggagcccggacctcgatgcgcacctcgacgccctcgccccgaccatcggcccggtggacctcgtcgtctgcttggacgcaggcggtctcgacacaaagcggctgtggctgacctcgtcgcttcggggcaacctcgtggtcgtcgtcgacatcgccgtgctcgaccatggcatccactccggtgaggctggaggggtcgtaccggagaccttccggatcctacgggccctgctcgagcggctcgaggatcccgtcaccggcgacattcgtgtcgatgccctgcgatctgcggtccccgagcccgtgcgtgaggcggcccgcgccctcgtcgaggcgctgggagatccgttcgccggtgcctaccccctcctcgagggcgtacgcctcgagggggcggacccggtcgaacgactgctccgccagagctggggcacggcgatcgcgctcaccggcatcgacggggtgccgagcgtggacacgggcggcaacgtgctgcgcccgtcactcaccgccaagctgtcggtgcgcatcccacccgacgtcgatgcggtccgcgccctcgatgcgttggtggcgaccctgagcgccgatcctcccaacggcgcgcgtgtgcgcgtcacgccggaggcccccgcgcagggctgggcgggggcggccctcccggactggctcgccgatgcgctggctcgcgggtcgatcgcgagcttcggtgagcccccgcgatcggtgggggtcggtgggtcgatcccgttcctcgcgtcgctgggcgagcgcttccctggcgtaccgatcgtcgcgaccggagcgctcgccccgacgtcgaacgcgcacgggcccgacgaagtgctcgagctgccggccgcgaccggcgtggcggtcagcctggccgaggcgctcggcgcactcgctcagcgatcgttctgaggctgtgccagccgagcgtaagcccacaggcgggcggagcagtggtcggagcgtgcggcgagctctctggtgatggtctcggccaccacacgcacatcgtcgtcgacgagaccgatcgggagcgtggcgagcagcggtacgccgaggcgctgcgcgagcaaggttccgcccccttctccgaagggtcggatgaggtctccgtgttcgcatcggagccaggacaggttctcgatgacgccgaggacgtcgaggttcgccttgcgggcaaaggtcccagcacgtacggcgacctcgacggcgagcggggagggcgtggtgaccacgaccacccgggcatctggcagcaggcgtgccagcgcgagcgggacgtcgcccgtgcccggcggcagatccacgacgagggtgctgggctggccccaggcgacgtcggccacgaagtgctcgagcgcgcgagcgagcatggggcctcgccacatgatggcgtcgtcggcgtcgtcgacgaggagccccatggacacgagtcggagttcgccgtcgtcgacctcgatgcgggccggctcgatctcccagcgatcgctggtccctcgcgcgacgaggcgttcgcgtcgttcggtgaggtggggctgcgagaagccccagatgtcggcgtccagcagtccgaccgcgttgccaccgtgtgtcagcgcacgtgccagggcgtgcgccaccgtcgacttgccgacaccgcccttgcccgaggcgacggcgatgacgtcggtgccgagcagcgcggccggaacctcggcccggcgctgagctgcggcccgcgcggcgcgcatggcgcgcgcacgtccggcatggtcgagttcggtttcgtcgacgatgagcgatcgtccgggggcgagctcgtcgacgatggccccgatctcccctcggaagcgagcgcgcgctggacagccgagcgtggtgagggcgatccccacgcgaaccgtcgttgccgtgaccgtgacatcgccgagcatgccgagttcggagagggtcgcgtcgagctcagggtcgcgaatcgcgccgatgcgagctcggagttcgtcgatgtcgacgccggccgtcatggctcacccgccgactcgaccggcagtgtctcgccaggggcgagtcgcgtgggctcgacgagcccatagcgtgggtcgccgggcaagaggatgcgaacgacgtcgccgtcgcgccagaggcgcggctcgatccgcggcacccgctcgagcgctcgggcccgtgcgagtgcctcggcgaccgagcccacgtcggcgaggaacgtgacgttcgccaccgtcggcgggaccatggggagcgcacctgcctcgtggtctcggagggcttggctcggcgcgagccagcgagcctcggtgacctccccggcgtcggcggacgcgtcctggtcgctcggcgctgctgccacgaagaagcgcgtgtcgaagcgccgtggactcccagccggggtcacccagtgggcgacgtagccgagcacggccacgtcgattccctcgaccgctcgcacgacctcgcggaagccgatggtgccggcgagcagacgctggcgcagttcgcccagacgatcggccccgagcgacacctgggcacccaacagcacgcccgcttcttcgaacgcttcgcggaccgcggcgacaccgagggccgcagcacggggctcgtcgggcatgtgcgctgcgaggtcggcacccgagcgcacgagaccgtcggcgacgagcgcttcgtcctcggcgtcgagcgacccgcccgggaacacgtaggtgctcgcgacgaacgcggcgtccttcgatcgacggagcatgagcacctcgagcccggtcgtcgggttgtcgcgcagcaccatcaccgtcgaggcgggacgaagttcgtcagtcactggtcgggaaggcgggatttgaacccgcgacctcagcgtcccgaacgctgcgcgctgccaaactgcgctacttcccggtgtggcttagtctacgccagctcctccggggctgctgcgccagcgacgccgagcgcgacggagctcgccggcaccggcgccaggacgggctggtaggagtggtcgatgaacacaccgccctcgaggacctcgcggacggccgtccggatgaggaccgggcttgcgggcctcacgacgaagccgtcgacacgagcgcgtttggccgtgaagacgtccgcccgacgatcgagcagcagcaggacgcgcgtcggccggagtcggccggcgtcggcttcgagccgaaggtccaccgtgcaggcgataccgcccatcgtgccgatgtgggcgtcgagcacgacgagttcggggtcgagttcggcgaccgcacgccgaacgcgacgtccttcgtccacgccccagagttcgtagtcgccgtcggcgagtgttgcaacgagctcgtcgcggacttccggagcgtcggttgcgatcaggatccgtgccatgcgccgatgatcctagtgttcggggctcgcagattccagctcgcgctcgccaagccgtgcgccgaggcgtccgagggcctcgaccgacgcgatcggctcggcgagatcgtcgaccgcgagtaggtcgaccgggccgagggtctcgcgcacgcgcccgagaccgcctcggcgtgcgtcgaggagtcccatggcagcgcgacgcaggtccggaggcgcgtcggggtcgctcgggagcgagccgagatcgggcggcagacggttgacgaccacggcgcgaacgtcgcgttcgagctcaccgagcgccgtgcgcagccgacccgccaccgccatggcgtcctcgtggatcgtggtcacgagcaggtagcccgttctcgcggaggcgagcagctcctcggtctgggtggcgcgctcgcgaaaggccccttcgagtcctccgaacgcctggaagaacgcgatagtgtcgtcgaccacttgggcgcccaccacagaggcgatctgacgaacgaggctgcgggtggcgagtgccagcggtcgcaacaggagcggcggttggcgaaggaggagacgaaagacccgattgtcgaggaatcgggcgagtcgactcggtgcgtgcaggaagtcgatggcccactgcgcgggcggtgtgtcgaccacgatgacgtcgtagcggcccgtggctcgcagctcccacaggcgctcgaaggccatgtactcctgggtccccgacagtcgtgagacgaggctcgcgtagaccggactcgagaggacctcggcgacctgctcgggcgagttcgcccctcgccggaccatcgcctcgaaggtagcctgggcgtccagcatgaccacgtcgaagcgtgcgctccccacctcgacggtgaccgggtcgttgccgacccccacgaggccgagcgcgtccgcaaggcgtctggccggatcgacggtgagtacgcacgttcgccgcgaactcgcaaggagtgcgccgatggcagccgccgtcgtcgtcttgccgacgccgcccgccccgaccaccacgatcgtctcgaacggctggagtgcaccggtgagcgtcgtcacggctcgacctgctcgaggtggtcggccagcgcgtcgaggaagtggccgtggggaacgagatcgaggtgcggcaggacgaagctgcgcgctccgaggacgtcgcgggccccttcgagctgcgtctgggcgagcgcccaccgctggcggaggtagctggcggcggttgcctctcgagagcctggtcgagctgatcccgcaggcggcgcaaggggcatctgattgaccacgaccgagaggacgttgatgtcggcgcgcgtcgggagcgcctcgaggagctcgcgcgtctcggcgatcggcgtctcctctgggatggtcacgacgagggctccggtggtgtcgtggtctcctaggagttcgatgacctcggcgctctgctgggcgatcggtccatcggacgcgatatcggcgagcccctcgggagaactcagcaaggagagggcatggccggacgctggcgcgtcgaggatcacgagatccagggtcgccgcgttgacgagctgcttgaccttggcgagcaggaggaggtcgcgaatacccgggatcgcggtcgcgacggcgtcgagcaccccggcctgcaccagccgcccggcgagggcgccgaagccgtgcgtctcgaggtattcgagcatcactgcctcggggcgcagggtgaccgcgcgaacctcggggtgctggcgcggtgcgtcgtcgacgtggacgacgagcggtcgaaggcctgcacgctcggccaagaggccgacgaggagggacacggtcgtcttgcccgtcccgcctttgccggtgacgatgacgagtcgagggtcgccgacgagcgcgccgagacggatgcgcgcggtgtcgacgtccatgcctccaccctagagccggcgcagggctcgagcatgtgcacacagttgtgacgcggacgtcacacgacccttgacagcccgagcgaaggctgcataggctgcccgacaagaggtacggacaaagcgacgaggtggatggagtggacggggcgtgtcgtcgtgaccgactcggaggggcggtgcgaagatgatgcggctgatgtcgagcaggagcggcgtgctggaggggggcgagtgagccgacgtgctcggtgtgtggagatcgaccgggctccgatgtacgcctcggcgatcgagtcgactcgggcgctcgctgggcaccatgccatggcgatgcggggagcgacccctcgggcgtggggcgtagaacgctcccgtgcacaggcgagcatgtggtgtgggcgtcgccggtgcgcgtgggggtgctcgcacgttcgccgcatcagatggtcggcgggtgggcgcgtgtgaggtcgataccgacagtcggtatggctacgttggcgtagggtggtctgacgtcgtggcgtcggaccgatcgatgagctggaggggggcgtgctatgcgatcggagtcctggagggagcgagcccagtgtcggggagtcgggttcgacgtcttcttcccgccggaagatcctcgcatggaagggctcgcacagcgacgacagcgcgaggcgtcagccaagcggatttgtgcgcggtgcccggtcgcgggagagtgcctcgaatgggcgctggaaaatcgagagacgcgcggcatctggggcggacgtacggaacttgaacgcaaggccatcttgcgcgcccagcgtcgcgtgcgactcgtcgtgtgatcccgggcctgatcgagggcatgcggtatactttggacaggcacgctggttgggcaatcggctgcaccaaggtgaggagggctcatggcagtcacgagtgtgaagatcggtaagcgcccttcggtgatctcgctgacggattcggcggttcgcaaggtcgccgagttgatcgcgcaggaggacgacgccgcgtcattgttccttcgtgtggcggtggcgcccgggggctgctctggttatagctacgacatgttcttcgattccgagcgtgcgagcgatgacatcgaagcagagttcggtggagtgcgggtcgtggtcgatccgcagtcggcagagttgattcgtggctctgtcctcgacttcgtcgatggtctgcagggagctgggttccacatctcgaatccgaacgcaacgcgcacgtgcggctgcggttcgtcgttctcctaacccgcctcgttcggtctcgtcacgagccgggcagccctctggggctgcccggctcgttgctgtgagttcccctccgggtcgcatcggaggggtggagggggccgtggctcggcagcagtgtccagttggcgtggcttcgatgtctgggctggcagcgccaggaggcagcggggccgacgcgcggagggggcgcaatgggtgggattggtcgacccagtcgtggtcgggacccggtcaggcgtcgccgaagcggtagccgaccgagcgtacggtgtgaatgaggtgctcgtgcgcttcgccgagtttggcgcgtagccgtcgcacgtggacgtcgacggttcgtgcgcccccgtagtattcgtagccccacacccgcgagagcagggtctcacgggagaagaccttgcccgggtgcgatgcgaggaacttgaggagctcgtactccatgtaggtgagatccagcgcggtcccgttgatcgaggcatggtaggtgtcgagctcaagcgtgagcgggccatagcgaatgacggtcctcacgtcgccgcgtccgaagcgcacgaggaggtgccgaatgcgcatggtgagctccctggcgtcgaacggcgacaccgcgaagtcgtcgagcaggccctcgcggagcgcgaggtcgtcgacctggtggcgctcgacgaggaggagaatgggtggcgggggggcgaggcggcgcttgagttcccgggcggttccgagcgcccattcgagcccggtggttccgtcgacgaccgctgcgacgagtggtccgacggtcggcggcagtgcgtcgagggtcgtcacctcatggctggtccatccgatgagctgtgcgatgcgcgtcgcgtgctgcggcgagatgatcgcgagctgctccatgtcagatcagcgtgaggtagcgggctcgttcggcgtcggagacttgactcgccgaagcgcgccactcgtctcgcttgttgcggaggaaccactcggtgacgtggtcgccgagaaccgagcgaaccaggggcgacgcttcgagctcttccagcgcttctgagagtgtctggggaagacgggcgatcccgagtgaggcgagctcgcgctcgggcatggtgaagaggttgtcgtggacctccggaggcagctcgtagccctgttcgatgccttggaggccggctgcaaccatgagcgcgagtgcgagatagggattggcgccggcatcgggtgcgcggtactcgacgaacgtgtcctccccacgagctgcttcgggacttggaaccctcacgagcgcggagcggttgttgcgtgcccacgcgacgtgcatcggcgcctcgaagccagggacgaggcgcttgtaggagttcacccactggttggtcaccgcggtgatctcccgagcgtgccgcaggagtcccgcgacgaacgatcgtgcccggcgcgagagaccatcgggagcctcggggtcgaagaaggcgttgtgttcttcgtcgtgacggtcgtagagggctaggtgggtgtgcatgccggacccttggagcccctcgaacggtttgggcatgaacgaggcggtgatgcccttggcccgtgcggtctcggtgacgacgagtctcgcgctgatgacggcgtcggccatctgcaggacctcgtcgggcgcgaggtcgatctcgtgctgagacggcgcatcctcgtgctgagagtgcttgacggggatgccgagctcttcgagtaccacgaccgcctcgcggcgcagctcgctcccgaggtcgttcaatcgcagctcgaagtacgagccgtggtcgaggggctcccagtgtcccggggtggtctcgcggaggtagaagtactcgagttcgggggctgcgtggacgaggtagccctgctgtcgggcgcggtcgatctggcgacgcaggacgttgcgggggcaaccttcgaagggcgttcgatcgaggttcaagatgtcgcagaacatcctcgcggtgctcggtaggcccggcaccacgctgaacgtggccgggtcgggcatggcgagcacgtcggcctcgtggatgcgtgagaagccgtcgatggccgatccgtcgaaggtcatgccctcgtcgagggcggtggcaagttctgcctgcgtgatttggaaggctcgtgggatgccgagcacatcggtgaaccagagctggatgaacttcacccggcgatcctcggccatgtgacggacgtagtcgacgccgacactgcgctggtccggcacgggccacctccttcgcggtcatgctacgggggacgtccctggatcgctcgtcgcgccccgagcatttaactcggagttcacatggctctccggtctgcgtgctcgctggccataggttgggcgagcaacggcgacggatggaggagcccatgcaaccacgcgcaccacacgaggtgatcgcgatggccgaggagcagggggtcgagatggtcgaccttcgcttctgcgaccttccaggaacgatgcagcacttttcagtgccgatccgacagctcaccgaggattccttcgaggaggggttcgggttcgacgggtcctcgattcgtggcttcaagacgatcaacgaatcggacatgatcttgaagccagatccccgctcggcgtacctcgatccgttccgcaagcaccgcacgctggtgctgaactgcttcatctacgatccggtgaccggccagccctacgatcgtgacccgcgtcgcgtcgcagcggctgcggaggagcacctgcgcgcgagcgggatcgcggacacggcctacttcggtcccgaggccgagttcttcatcttcgacgacgtccgctaccaccaggacgagcactcggcatcgtacgtggtcgactccatcgagggtgcgtggaacaccgaccgtaacgagcagggctcgaacctcggcggcaagattcccttcaagcgcggctacttccccgtacccccaatggacaagttccaagacctccggtcggagatggtgctcaccatgcaggcgctcggcatcgagatcgaggtgcagcaccacgaggtcgccacggcagggcaggccgagatcgacatgcgctatgacaccctgctcgccatggccgacaagctcatgctctacaagtacgtcgtgaagtccgtcgcccagcagggtggctacaccgcgactttcatgccgaagccgctgttccaggacaacggctcgggcatgcacacgcaccagtcgttgtggcgcgacggtgagccgctcttctacgagtcgggggggtatgccgacctgagcgagctggcgctccactacatcggtggcatcctcgcgcacgcgccgtcgatcctcgccttcgcggcgccgacgacgaactcctacaagcgcttggtacccggttacgaggctccggtcaacctggtgttctcgcagcggaaccgttccgcggcctgtcgcatcccgatgtactcgctctcgccgaaggcgaagcgtgtcgagttccgctgcccagacgcgatggcgaacccctacctcgcgttctcggccatgctgctcgcggggctcgatggcatccgcaacaagatcgagccggccggacccgacgatcgcgacctgttcgacttgccgccggacgaagcccgggctctgccgacggtcccgtcgtcgctggagggctcgctggctgctctcgaggccgatcacgactacctgctcgaggggggtgtcttctcgcaggacctgatcgacacctggatcgcctacaagcgtgccgaggaggtcgacgccattcggcttcgcccgcacccctacgagttcgcgctgtactacgacgcctagcgcgtcgttgatccttcgcgaggccctgctcgtcctcgggcgagcggggcctcgttgctgtcatgggttttggtgcgatgggatcgagcgcgacacgatcgagcaacgtccacagggcgctcgacgatggccagctcaggcgaggcctgcgctcccgaggagcgcgcgcgggtcgaactcgtcgatcgggatgatccgaaccctcggcaggacgacgtcgtcgaggaacgcgtgcatgtcgcgctcgagatcgaggagctcgaggtcgtgtcggttgagcagctggcccgcgacgtactcggtgaagcaggccagcgcgacgcggtgaccgtggtcgaggagctgctcgagtgccggagcgaagtcggcgtcgtgcgaggcgagcacgacggacccgtgacgccgtccgatctcgccgagcgtcgccacgatcgcatcgtcgacgaccttgccgggacccgagaggaggaccggcgtgtagccgtgggagcggatcgcctggatgaacggcccggggatgaggcctgaggtggcgttgatgaagaagtagctcttcagcggcgccgatccccacgacgctgcggcgccagcgactcgatcccagcgaggtcgctcgttgggttctggccggtggcccaggatctggccgaggacgccgtcgatgttctcaccgtcgacgagcaagaacgtgaccggcgctaccaccccggccaccccgccgggagtgagccgaccaccggcccgtagacgatcccgcccggggcccccagtgccgacaggagctgtgagaagttgagtccgaaggccgtggagttcgagttgttccactggccggcgtagcccgcgtaggcctcgccgatcccgcccggcgccgcccagccggtctcgatgccgtcggatcccgggaaacaggttgcgatctgctgtccagcgctcaccgcttggcctacggcgaccgttgggaccacgtcctcggcgacgtagacgtagtcgccagcggctggaccgctcgtcagttgataatccaggaatacgccgttgggccagccgccttcgtaggtgctcacgatcctgccggccccgagcgcggtgatcgggccgttgcagaggtaatccacaccctggtcgatccgttcgacctggaggatctgggtgtcggcgagcggattgacgtagccgctcgggctggtcggcgttggggctggggccgacccgccgctcgggctcacgaccacggccggggtgggtgctgagtcctgggcggcacgggcttgctgggcctgggcggctgcgagtgctgccgcctcgcgctgggctgccgcggctgccgcctgggcctgggccgcttgttcggccgcgagttgctgggcgacgagctgctgaatctgggagttgacgctcgcgagctgggcctgggcctgcgcctgggcgttctgggctgcttgggcggcggactgagcctgtgcgctctgggtcgcaagatcgctcatggcgcttcgcagcgaggcttgctggagctcgagggcctgcttggcggtgacgtaggctgcaacggcggcttcctggttcgcggtcgcggcggtgacgtcggtctggatgatggccgcgtcgttcggggtgcccttggcgatcgagatcaccgacgaggacgcccctgcttgcgtgaagatgttcaccgcctccgaggcgaccttggccttgagccgggcgacgtcggcctctcggcgaacgatctgcccttggagggtggcgatctggctcttcgtcgtggcgagtttgagctgcagctgatcgtaggtgttcatggctgcctgggcctgttgatcgagcttggagatctgggcagtgagctgggcggcctcagccttggcctgggagagttgggtggttgcgtcagcgggtgtcacgttcggtgtcgccacggcgaacgtggcgatcgctgtggcaacggtcgtcgtcacaagcgtcttccaacgcacgagcgaacctccgtgcgagattcggggacctccgacgtcctcgacgaggtcatcggcatggtcgacaatcggttgagcccgtcgtgggcgccggcaccgcgagcctagcgggcgaggactcggggctcgggtgctctgtggcaatgttgccaaagttgccgtgctgcctgggaggagctcgagccgtgtcccatcggacgcggcgagcaaacggtgacgggcggtcgggacgacgggattggcggcgcgggttccgatccctgggtccgcgtggcgccgagcgcggcactatcgtggtcgcgtgcgctccctcgtgatccaggctgcgcagctcaacctgaccgtgggggccgttcggcgcaatcgcgacgcggttcgtgctgccatcgagtcggcacgtgcagccggcgtcgacgtcgtggcgttcccggagctgacgttgaccgggtacccacccgaggatctgctcctcaagcccgcgttcatcgaggagcagcgagccgcgctcgacgagctcgccgggtcctgtcgtgacatcgtcgccgtcgtcggtttcgtcgatcgcgagagcgacctccacaacagcgcggcagtcctcgccgacggtgcggtccaagcggtctatcacaagcagctcctcccgaactacaccgtgttcgacgaggctcgctacttccagcctggctcggtggcgccgccggtggtcgaggtcaacggggtgcgtctcgggctggcgatctgtgaggatgcgtggtccccgacgggtgcgatcatgcaggcagccgtcgctggtgccgaagtcgtggtcgtgatcaacgcctcgccgtacgaggctggtcgccaagccactcgcgagcggctcgtcgcggtgcgagccgccgacgcccacgtcgcggtgtcctacgtcaacctcgtcggcggacaggacgaactcgtcttcgacggcggatcgttcgtggtggacgcggtcggtgcggtcatcgcacgcgcaccgcagtttcgcgaggcgaacctcgtcgtcgagctcgagctccgaggcgaccgctaccgacagcgtctcgtcgacccgcggggcaaggtcgcgctcggcacgtcgagcgagcctgccgtccgactcgccacacccggagtgcgcgtggcgcgcgatccgatgccgctcgccccggctccggtcgacggtttcgaccccggcgaggtctacgcagcgttggtcctcgcaaccagcgattacgtgcgcaagacgggcgtaccgggtgcactcgtcgctgtgtccggcgggatcgattcggcgctggtggcgacgatcgcggtcgacgccctcgggccggatgcgctgaccctcgtggccttgccatcgcggtactcctccgagggctcgctgcgcgatgctcgtctgctcgccgaccgtctcggcgtcaccttggaggtcatcgccatcgagccggcgcacgcagcgctcctcgagatgctctcacctgccacggcgacgtccggggtcgtggaggagaacctccagagccgcgtacgcgggacggtgatgatggcactgtcgaacgccagcgggcggctcgtcctcacgaccggcaacaaatccgagctcgcggtcggctattcgacgctctatggcgacatggccgggggtttcgcggtcctgcgcgatctctacaaggaacaggtctacgccctcgcgcggtgggtgaacgaccgggcgggcatcgaccggatcccgacggctattctcgccaagccgccgtcggcggagctgcggcccggtcagctcgacacggactcgctgccaccgtacgagatcctggatcgggtgctgcgctccctgatcgacgaggatcgcaccgcggccgagtgcgagggcgtcgatcctgagctcgcgcgcaccatcgaggcgatggtcgatcgcgcggagtacaagcgacgccagggacccatcggcccgcgcatctcagagcgcgccttcggcaaggaccgacggatgccgatcgtcaaccggtggcggttgtgaccgacgagctgcgtcccaggtggctgggtggtggtgattggtggttaccgctcgcggaggtttccgaactcatccggcgtctctcggcggtgctcatcgatctcgcacgggtgtgcgcagacgcgcgcctgccggacgtattggtgagggccagcttcgagtgctcacgcgttctcggaggacatgcgggcgagcttgcccacttggacctgcatccacagcccgatctgctccagccagtggccctcgacggcaacgacgcgttcgcggcgctgcgtgatcgcctcgtcgagatcgcacccaccgaggaggccctcgacgtggatcggtggcgtgagacgctgcgtgtggggttcgacgaactcgaactggtcgcacgagggctcgggtcgtcgagcgggaccggccagacgaacctcgccgcctgggcacgcgagctgggctcgagccttgcgacatggcgcgagcaactcggtatcgacgggagcgtcggtacgaacggccgcgatcgatagcatgaatgcgtgctgtcctgcgtggctcggctccgcatcggttcgtgcatccagcgagccaggagtcctcggggggtggggaactcgtgacgaaggaacgtcaggaacgtgaggacgaggacctcgtccggctctacctcggagacattggcagccacgagctgctcaccaaggatgacgaggccgaactcggtcggcgtatggatcgtgcgcgtgacgcccagcgtcagctcgatgccggtgtgaaggaacctgcgcgcagggccgagctcgaggagctggtgcggcagggagaagaagccaagcgcgccttcatccaggcaaacctccgcctcgtcgtctcgatcgccaagcgctaccaggcttccggactacccctgttggacctgatccaagagggcaacatgggtctgatccatgcggtcgagaagttcgactggcgtaagggcttcaagttctcgacctatgccacctggtggattcgtcaggcgatcactcgaggtatcgccaacacgggccgaaccattcgccttccggtccacgctggtgactcgctctcgagggtccagcgagcccaggtccagctggaggtacgactcgggcgtgccccgacggttcgtgagctcgctgccgaggtggatctgccctacgacaagctggtcgaggcgcttcgcttccgtgccgagccggtctcgctgtcggagccactgcgcgacgacggtgatgctgagcttggcgacgtggtcgaggacagccagtcggcgacgcccttcgacgtcgcggccgagcacctgctcccgtcggaggtgtctcgtctgctcgctccgctcgacgggcgtgagcgcgagatcctgaggcttcgctatggtctcgatcgcggggagcctcgaacgctggaggaggtcggagagtatttccacctcaccagggagcgcatccgccagatcgaggcgcgcgcgatgtcgaagttgcggcacccatctgctgacatcggcgcgcgcgacctgttgaccggatagccgctgccgttccgagatcgcggcccgtcgcggctaggctggatgcatgaagaagctgttgatcctcgcggttctcggagccctcgctgcgttcgcggtgaagaaggttcgcgaaacgctcgcatagctcgtgggggcgtgggcagtcgtgtccacgccctttgcggccatggtgtgcaaaccggcgggtcggaggaccgacctgctgaggccggtgttgtcgggtggcccgatcggatgggaatcctcaagggcgcggtcgagtgtcgtggcgccacgagccagcgcgacggtcgcggcgcatggcgtcgtggcaaaggtcgcccgttgagcccgagacgcacgaggccgaggctcgggtggcctgatgttcggacggcttggctccgatgggtcgtaaggccgagggcaacagttggggctgtcggtcgtcatggcgcatctcccgggtgaggtcggtgcccaacgaggtcgtccgggtcttcgagtgaggagctggcgatggcctcgcctgagggttgtcagatgcccgggccggcccgactggtcctgaccgacgcctcgccggtaggctggtagtgcgccgctgtgtgatgctgtggcgtcggatgggtgccaaagagaggtccggtgtcgctcgttgctctgagcatcgcggaacgtgaggtcggtggccggtttgaggcgtgtgcgctcgaccgcgaccggaccgagcgcctcgaggacggtctcgcccgtctggtcgccaagggagcgattgtcgaggccgctgtgctcgcaacgtgtgcgcgcaccgagttgtaccttgccgtgacgcagttccatgccgccgtcgagcaggcagctggcgtgctcgccgaggtcctggacgtgccgcggagtctcgtcgagcagctcgcgaccgtccacttcggcaccggcgcgctccgtcatctctaccgcgtgagcgcgggtatggagtcggtcatcatcggcgagtccgagatcgtggctcaggtgaaggacgcgatcgcacgggctcagcgtcgacgtctcgcaggtggcgagttgacgcgcgtcttcgaccgagcgctcgaggtcgccaaggacgtgcgcgcgagtaccgaactgacgcacggctcggcttcggtcgtcacgatggcgaccgagctggctctcgacggagcatccgcgcgcgacgtggcggtcggggttgtcggcaccggtgcgatcggatccgaggtggctcgcgtgctcagcgaacgcggggcttcggtgacggtgctcacccgtcgggcagacgtcctgagtcagcaacccgtcggcgtcgaggtccgagccttcgagcagctccggagcatcatcgaatcgttggacgccgtggtgctggcgaccaccacggattcggcagtgctcgatgcgtcgatgatgccgagcggacaccccttgcggatcgtcgatctgtgtcggcctcgtgctgccgatccggcgcttgccgccgtggacggcgtcaagctggtcgatctcgaggaggtcaacgaactcgtcgcggcgcaactgtcgaagcggcgtgaggcgctcaccgatgcggaactcatcatcgagcgggcgctcgccaacgacggagtgctgctccacgctggtgaactcaaccccaccctcgctcgtctgcacgcgtggggtgaggcgttgcgccagtcggagctcgagcgcgcgctcgctcgcgtcggcgacgacgagaaggcgagagccgcactcgaggaactgagccatcgtctggttcgcaaggtgctccacgagccgagcaaggccctgcgtgctcacgcctcgtcggaggatctcggcgcattgctcgcgagcgtgcgcacgctcttcgatctgtgatggctccggtacgcatcgccactcgtcgtagcgccttggcgcgctggcaggcgagcttggtcggcgagcggctcggtcgctacgagctcgtcgaggtccacaccgcaggtgatcgcgaccaggcgagctcgcttgccgagatcggtggccagggcgtcttcgtcaaggaagtgcaggccgcggtcgtgcgtggcgaggccgacatcgcggtccacagtgccaaggatctgcccacagccgcaggcccgctcctgctcgcggcggtgctcgagcgcgcggacgcccgcgacgcgatcgtgggcgcgcggctggaggagctcgcgatcggcgctcgggtcggcacatcggccccgcgtcgagctgcgcagctgcgcctcctccgccctgacctcgaggtggtatcgatccgcggcaacatcgcgacccgtctcggtcgcgttggggagctcgatgcgatcgtgatggctgtcgccgcgctggagcgcctcggcctcgaggagccgccttggtggccgctccccgaggaggtcctctgtccacaggccggtcagggggccattgcggtggagtgtgcccccgacgccgatgggctgatcgagcgccttcggtccctcgacgacgatcggagccgccgcgagatcgaggcggagcgggccgtcctcgccgcgttcggtaccggctgcgcgctcccgctcggtgcgcgggcccatgccgatgggtcgagtctgcggctccgggcggtcgcggttgatcccgatggcacgcgccagctggaggtcgagcgcgagggagtcgatcccgcgacgctcggtgcaacggtcgccgaggtgctgcggcgcctgggcgccgacgcactcgtcggagctcgtccctgatgggacgcgttgcgctcgtcggtgccggccctggcgacccagagctcctcacgctccgcggtctgaggctcgtgcgtgcggccgacgtcgtcgtcaccgacgctctcgttgatcgacgtgtgcttgccgaggtgcggccggcggtcgcggtgcacgacgtcggcaagcgtgctggagcacccttctcgcaggctgccatcaacgaactcctgatcgacctcgcccgcggccatgagctcgtcgtgcggctgaagggcggcgacccgttcttgttcggtcgcggcggagaggagctcgaggcgctgctggcagcgggggtcgccgtcgaggtggtccctggcgtgccgagtgcgacggccgcggcggacctcgtcggtgtcccgctcacccatcggggcgtggcggacggcttctgtgtgatcaccggtcatcgccacggcgacgcgtcgctcgactacgactggcgtgcactcgtcgcgagtgggctcacgctcgtcgtgctcatgggggccgcttctcgtgcgaccatcgccaaggagctgatgggcgccggagctcctggtgagaccccggtcgcggtcgtgacacgcgcatcgtggatcgatgaagaggtccgctggacgagcctcgcggcgctcgggtcggtgcctgtcgcgtctccgagcacgatcatcatcggcggcgtggtcgatccgcggcgccgatggcgaccctcgctgccgctcggtggcctccgtatcgtggtgacacgcccgagagcggtcgcagatgcgctcgcggtgcgcctccgcgatctcggtgccgtcgtcgtggcgagcccggcgatcgagatcggtccgccgtcggatggcggtgccgcactggccgcggcgctctcgcacatcgaggactacgactggctcgtcctcacctcgcagaacgccgtcgatcgcgtcgtaggaggcatcggcgaccttcggcgtctcggtggcgtgcgcatcgcggccattggccccgcgaccgctcgggcgctcgagcgggtccacctcacggccgatctcatccccgggacgtgggttggggaggggctggtcgaggtgttcggccctggtcctggctcggtgctcatcgccagggcacgccaggcccgcgacgtcgtgccacggggcctcgaggcgaaggggtggcgcgtcgacgtcgtcgaggcgtacgagacgcgcacagcagcggcgagcgtgcctccagagctcgtcgagagcgccgatctcgtcgtgttcacggcaccgtccaccgtcgagggtttcgcgacccagtacccggggctcgtccctcgggccgcggcggcgatcgggcccgtcaccgaggaggcgctggtgcggcgagggtggccggtcgcgctgaccgcgacgcactacgacgccgatggcctcgtggaggtgattcgcgaggcgcgcgaagcgggtcggctcgtgcctcgatccgaggcgccctaggctcgtcgtcatggcttcgttcccaaggcccaggcgcctgcgtgccacgccggcgcttcgtgacctcgttgctgagaccgtcgtcagaccccaacagctcgtgctcccgctgttcgtgaaggaagggatctcgacccccgtgcccatcgcgtcgatgcctggggtcgtccagcacacggtggactcgctcgttcgagaggtcgacgaggcgctcgccgtcggcgtacgaacggtgatcctcttcggcgtcaccgacgagcgggacgaggacggctcgctcgcgtgccgcgcggacttcgtgctcgagcgcgcaatcgcggcgctcgttgcgcgcttcgcaacggacgtgacagtggtggccgacctctgcctcgacgagtacaccacgcacgggcactgtggggtgctcgatgctgccggacgcgtcgacaacgacgccaccctcgttcgctaccaggcgctcgccgtggcccttgcgagcgcgggcgtccacttcgtcggcccctccggcatgatggatcaccaggtcgccgccatccgtgaggccctcgacgctcatggattcgacgacgtcggcatcctcgcctatgccgcgaagtacgcatcggctctctacggccccttccgcgacgcggtcgaggtcgagatcgcaggcggcggcgaccgcgcgagctaccagcaagatccccgcaaccgtcgcgaggcgtggcgagaggtcgacctcgacgtcgccgagggcgcggacctggtgatggtcaagccggcgagcttctacctggacgtgctgtcggacgtcgccgaacgctcaccggtgccggtccttgcctaccaggtttcgggtgagtactcgatgatcgtcgcggcgagcgcgaacggttggctcgatcgccgtctggcggtgctcgagtcgctggtcgccatccgacgagccggagcggacggcatcctcacctactttgccaaggaggcagcgccgtggctgcgatgatcttcgagtccaacgaagcggcgttccgtgccgcgtccgaactcatggtcggcggggtcaattccccggtgcgttcgttcgcgtccgtcggcggcacgccgtatgtggtcgagcggggcgagggtgcgtgggtcatcgacgtcgaggggcggcgctaccttgattacgtccagtcgtacggggcggtgatccatggtcacgccgatgcgcgtatcacgcgcgcgatcgccgatcaggccgcccgagggaccaccttcggtgcaccaacggtgggcgagatccggctggcgagcgcgatcgtcgatcgcgtggccggcgtcgagcgggtgcgcctcacgagctcgggcaccgaagcgaccatgacggccatccgattggcgcgaggcgtgaccggacgatcgcggatcgtcaagttcgatggctgttaccacggccacagcgacgcgctgctcgcggccgctggatccggggtggcctcgctgtcgctcccggggtctgccgggatccccgatggagcggtggccgacaccatcgtcgtcccctaccaggaggtgcccacgctcgacgagcgcgtggctgcggtcatcgtcgagccgatcgcggcgaacatggggctcgtggcgccggagccgggattcctcgagggcctgcgcgccgagacccagcgcgtgggagcgctgctcatcttcgacgaagtgatcaccgggttccgcgtggcgcgcgggggtgcgagcgagctgctcggcgtgcaaccggacctgtggtgcttcgggaaggtcatcggcggcggtctcccgatcggggccgtcgccgggccagggaccatcatggatcacctggcccccgctggctcgatctatcaggcaggcactctctcgggcaatcccgtcgcgaccgccgctggcgccgtcgcgctcgaactcctcgacgccgggtcgtacccgcagctcgaggggcgcgcacgggcgctcgcgaccggccttgcctccgtcatcgccgaggcggggctcccggtgcaggttccgcaggtggcctcgttgctgggcctgttcttcagcgacgaaccggtgcgtacctatgccgatgctcgccgggccgtcgggtcgggttggtacgccccgttctttcatgcgatgctgcgacgagggatcgcgctcgcgccaggcccgtacgagatcctcttcccgggactcgcgcacagcgccgacgacgtcgaccggacgatcgacatcgcctcggcggccgcccgtgacgcgttcgtcgccgggcctgtgcgctaacgggtggaggcgcgcggagccagcgcgctgatcactcgcccgcgcctgcgaggcgcgcggagtagatcgagtagccgtcgaccgtgcgtgccaccgcggtcgcgagcaccgttgcgatcatgagcggcacgatgaggtcgaggcccgagtgggtgagctccagtaccagcacgatccccgcgagaggggcttgcattccggcacccatcatcgccgccgcgccgatcatggcgtaggagccgatcgctgcccccggcatgacgaacgaccagatgccgccgaggaacccgccgaggaccgcgcccgtcgacaacgtcggggtgaacaggccgccggaggcaccggtacccagtgccatcgcggtgacgatgggcttcaagaggaagagtgctgcgagcaagccgaggctaccgagctggttcaagaagaccgcgtgcgccatgtccttgccgttgccgaagagctggaaatagcgcatgccgatgaagccgaggatcgagaacgacaggagtggtccgatgaggacccaccgaccggtgaagcgatggtgcgtgacgaggcccatgaggcgcacgaaggcgaccgagaagaggccgatcagcggtccggcgatcacggcgaagacgatctgggcgaggtggaactggtagttggccaccccgacgtaggtcgcgtggtcggggaggtagaggtagccgacgtacgtggcgatgacggatgctgcgagtgccgggaggacgacgggcagggtgacctcacccatcatgatctccgcggtgaacagggcgccgccgaggggaacgttgtagacggcggcgagtcctgcccccgcaccgcaggcgatgaggaggcgcttctgcgctggcgacagcttgccccatcggccgaggtagctgccggacaccgcgccgaggagcttcggggcggcctcgcgtccgagcgaggcgcccatgccgatgacgacctcttggatgatcgaggtgccgaggctcttgcggatgtgcagatcgccctcgcccttccagacgacgtcgtccacctcggagcgctcacctttggtgaacttcgagaggatgaaccatgcgggcccaccgatcgcgccggcgagcgtgagcatctcgaggcggtagatcggcgcggagcgcccgacggccgcctggaacgagccgatgtggtagtggtacgtgatgtgctggacgttgaagaggatgaccatcatgaggtcgccgaagagcccggccccgacgcccgtcaggatgaggaaaatccagaacttgagcgtgagctctgcgtcaccatcgccggtggcgttgggctgctcggtcgcgcctcgcccggtggggagtcgacgcctgatgagcggctggggtgagcgaacgcgacgcaggtgccagggatgctcgcggtccgccttgaccatcgggactctctccagtcgctcgcttgcgttcggtgctgtcgcggggcctcggacgtcactcggcacccgccggggtatgcgcgctgagtctagtggccgtcacgtccggacaagtgcaacgcgtcgcatgctactgcatgagtatgcatgtcactacgacccagccgccccaccaggctaggcggcgatggtcgggaacagcgaggatcccccaccggatcaccgccccaggggagccgtgacgacgcgaggacgtggcggactacgccaaccagggaaaggctgaccagtcgggttcgcgtcgctggaggaaggcgtctcggccctccgttgcctctcgggtgccatagagcaggcgcgtcgcttcgcccgcgaagagctgttggccgaccatgccgtcgtcgaccaggttgagcgcatacttggcgaggcgttgcgcggtcgggctgcgatcgaggattctgcgcgcccatgcgacagcaaccgcctcgaggtcctcgtggtcgacgacggcgttcaccatgcccatggcgtacgcctcctcggccgagtagtcgaagccgaggaagaagatctcgcgggcgcgcttctggccgacgagacgagcaaggtacgccgagccgtacgcgccgtcgaccgaggcgacgcgggtgtcggtctgcatgaagcgtgcatgctggcgacttgcgatggtgaggtcggcgacgacgtggagcgagtggcccccgccgaccgcccagcctggcaccacggcgatgacgacctttggcatggtgcgaatgcggcgctgtacttcgaggatgtggaggcgtccatgggcgtgctcggtgtcgtggtactcgtagccctctgcgccacggactcgttgatcaccgcccgagcagaatgcccagccgccgtcggtcggggacggaccattgccagtcaggagcacgcaaccgacgtcgtcgcggagcgtggcgtcctcgagcgcacgtgcgagctcgtcgaccgtacggggccggaaggcgttacgcacctcggggcggttgaaggcgatgcggacgaagccgccctcacgggcgcggtggtaggtgatgtcggtggcgtcgaagccttcgacgggctcccacagcgacgggtcgaagagcggtgagggccgatcaggctggtgcacgatgccatgctatcgacgacgcgcccggtcgtctcaggctcgagcgcaggcgcgcctccagcgaccacgcagctcgggggcgcgggtcccgacatccaatcgtcggctggacgtaacctcgtcgtcggacgggctcactacggtcgaggtggggcggccaagtggcgccgcgcaaacgtgaggaggtggcgtgaccacgctgctgcacatctccgatctgcactacgagcgagctccggagcgcctgagcgtgggcgtcggcgagcgtctgcgccgcgcaaggaccgcactgcgctctcgtacgttcgatctgctcgccgtgagcggggatctcacgagctacgggacctgggacgtccgcgagctcgtcgaggcgcgccggtggctggaaggcttcgagcgccggatgctcgtcgtgcccgggaaccacgatctcggggccaatcccgagcgcgccgaacgatttccggtcttcgagcgctacgaaccagttccctggagccggacgaacttcggtatgaccttcggggagggcccgctcgtggcgcgtgcgacgggtgacctcctggtcgtcggcgtcggcctgaggcgcggcgatcccgatggcgcgctcgcgctgttggagcgagcgctcgcaggtgcgacgacgcccgtggtcgtcgttggccactacccgatcgtgccggtacgcgagtcgggcgtgctcgcgtccttcggcgcgatgggctacgtggatggcgaggtcgcggagctccatcgtctgatggtccagtccacgcgggtcgtcgcgtacctgtgcgggcacgtgcacgcggcgagcgcggcggtcctcgaaggtggtgtgctccagctgagcgcgggagctctcggcccaggccccgcgctgggatggctcgtgcacgtcgagcgcgatgaggtgcgcttcgagcaggtggaagcgcctgggcgaacgacgttttggccgagcgatcagttggggggtgtcgaccccgtggcctaccacgcgggggccgtcaggagtggcgtggtgccgctcggtcggaccggtcgccccaccctcgtcgattgagttcgcggttcgcgggcgccgtcgcgagaccgccgcggccagacgctgagctccgacgatcgccgcggtccgtgcgcggtgtggaagctgtgaggcgctgcgagcgttgccacctgccatgagtcatggtgctgcgcgctatgtcgtgaccggagcgaccggtgccgtcggccgctcgctcgtcacgcgtctggtcgaggggggcgccgaggtcgctgtcgtcgtacgcgatcgggatcggctccacgagcgcctcggtccggtcgccgacgcgctcgccgccgtcgaggttgctgacgcgcgcgatctcgagcgattcgaggcggcgctggtggcggcagccggtgcccttggttcggtggacggcatcgcccatctcgtcggtggcttccttcttgcgacgccggcacggacctcgatcgcgcagttcgaggagctcatgcgcctcaacctgacgagcgccttcgtggtcgtgcgggtggccgagcgcgtgatgggatcgcgcggtggctcggtcgtgctgatctcctcggcggcagcccacgtcggcctcgcctcgcacgaagccgtcgcggcttcgaaggctggtgtcgaaggactgacccgatcggccgctgcgacgctcgccagagctggcgtgcgggtgaacgcggtcgcccccggactcgtcgaggccgagatgacgcgcgggatcgtcgagcgagaggatgcgctcgcggcgtcgatcgagctgcacgccctgggtcgcatcggcaccggtgacgagatcgcccgaggcgtggcgttcttgctcgacccggagtcctcgtggatcaccggcagcgtgctcggcatcgacggcggtctcgggtcggtgcggccgcgcccgcgccgacggctcccttctcagaccgggggccaaggatagggccgtccgtgctccggcatgggcgggagcgcgccgcgtcgaacgagacgcattgctcgctggaggagcgcacgtcgttcttcgggctcgagcagccgtgcgaggtcgtcgggcagatcatctgccaaggaggcaagacgtgcggccaacgcggtggggagcggatgacccgcgagatcccagatcacggttcgtagcttcgactccgggtggaaggtgagcgcgttgtcgatcgcccagagtcgcccctcgtcgtcgaggaggacgtggctccccttgcggtcggcgttgtttgcgacgatgtcgagtgccgcgatcaccgcgagagactcgtggtgggcctggtcctcgacgagctcgaagtaggtgaggtcgaagtctgcgtccacgaaggcttggagggtgccgctgccgtagggtaggtcgtggcgcacgacgataggcggcacgtggcagatgccgacgaactcggcgagtgctcgaaaggcgagttcccggcggcccagccccggggggaagtcccacaacgggcgctcgagggcgtcgggcttgtagatcgcgagtgctccggagtggaccagctcgacgaggtgggcgccgttggacgacgcagtgatccgcccgaggaggcgaacctcgtcgtcgaggatggcaggatcgtctaacgcgctggggcgcgatgcccgttcgtccgtggacacgcgtggccttcgggattgatcggatagccgcagagcggacaggtcggtctgccttgttcgaccacctcggcgatgcggatcgcgagacgcgctgcgagctcccgcgagagggtgaaccgtgctcgacgtggctcgacgtcgacgtcgcgctcgtcttcgatggcctcgatgacgagcactcctgcatccacgtcgaccgcgagctggagttcgccgacgcggaaggctggttcggcgggttcggtgagcggtgtcgtcggtggcagctcgccgggtcgcgcgaggtcctcgagcgccgtggcgatggccctggcaagggcggccatctggagcttttcgacgaggagggtcacgatctcgccgttggcgccagcctggaacaagaagacgcgttcgccgggtctgccgtgggtgccgagggtcgcgaactccgcaggatcgaactcccagacgaactcgttcacctccgccacctggccccagtgcgttcgttgagcgtgagcaggccaaggctcgtcggcgtcacgctgaaggtggtcgacgaggccgtctcgacccagatccggtggacaccgtcgacgtggataccgagcgcatcggcggcgagcaggcggatggggtccgcgtgtgaggtggcgacgacgacctcgccgggatggcgctcggcgatcctggttgcgaagcctcggatccgggcgagcacatcgacgagtgattccccctcgggaaaccggaacgtcgacgcagccgcgaggagcgttgcccactccttgcggcgacgcacgcgtcccaacgaccagccggtccaggcgccgacgtcgacctcggcgaggtcgtcgtcgacgatcgcggtggtgccgaagacagcctcgagtgcggctgccgtctggcgagcgcgctcgagcgggctcgagtacagcctgatggcatcgaagcgccctgcaagcaccgctgcggtgcggcgcgcttcggcctcgccgcggtccgagagggcgagacccggccgtcggcccggcaactcggtgccggtcgtcggtgtgcggccgtggcgaaccagcaccagcgtcgccggtcggtcgctcatcgggccgtggctgtggtaggagcgattggcaccctcgtcaccttagcgccgaaggcgcggtccgtacggatcgacgcctcagtcgaggcgctcgacgatcatggccataccctggccgccaccgacgcacatggtctcgaggcccagacgagcccccaactcatcgagctcgtgcagcagggtcgtcatgatccgagcccccgtcatcccgaacgggtggccaagcgcgatcgcgcctccgttcgggttgagttggtggtcgatcgagatgcccgtctccttgacgacggggagcacttgggctgcgaaagcctcattgagctcgacgacgtcgatgtcgccgatcgtgagaccggcgcgttcgagcacggcgcgtacggcatcgatcggtccgacgcccatgatctccggagcgatgccggtcacggcggaggcgacgatcttggcgagtggccggatgccgagtgcctccgcgcgtgagcgctccatgacgatgacccctgcagccccgtcgttgagcgggcaggagttacccgccgtgacccgtccgtcgggcctgaacgctggcttgagcgtggcgagcacctcgagggtggtgttggggcgcggcccgtcgtcgcgccgaacgacgttcccactcggcgtcgtgacggcgatcgtctccgcatcgaagaagccccgttcctgggctgcgaccgcacgctcttgcgagatgaccgcgtaggcgtccatcgcctcgcgcgtgacgccgtagcgatcggcgacgttctcggccgtgaggcccatggggatgtacatgtgattgacgaagtccgcgcggctctcgtcggtgaagcgagggttcatgtcctcggggtcgaaccccttgatcgatgcacgtgtcgtcgactccacaccgccagcgatgaaggcgtctccctcgtcggccatgatcgcatggaacgccatgcgaatcgcttgcagcgacgatgcgcagaagcggttcacggtggtgccggggacggtctcgggcaggccagcgagggctgccacgttgcgcccgaggttcatggattgctcgccgtgctggatggccgctccccagatcacgtcgtcgacgctcgccggatcgagggccggcactcgggtaaggagctcggcgatcacgaggccagagagatcgtcagggcggacgtcgacgagggatcccttgaaggcgcggccgatcggggtccgggcggtggcgacgatcaccgcctcgcgcgccgtcatcgctcgcctccggtcgccagcgcgctccgttggcgcagctggcggagcacgcgctcgacgtggccggtcgcgcgcacgttgtagagcgcgtcgacgacggcgccgtcggcgtcgatgagcaatgtggaccgcaggacaccttccgtcgtgcggccgtaggacttcttctcgccataggcgccgagggctgtgatgacggaccgatcgggatcggcgaggatgtcgaagcgtaggccgtgacgctccgcaaagcgggcatgggatgcgaccgtgtcgggagagatcccgacgacgcgccaaccgagcgccgccagctcgtcgacggacgcgttgaactccgtcgcttccagggtgcatcctggggtcatgtccttcgggtagatgtagaggatggtcgcggtgccagcaaacgagtccgcgcagacctgctcgcctcgttggttgggcaggcagaagctcggaagacggtcgcctggcgcgagccggttcgtttcggtcatgggccaacgctagcgcgatcgcgcggcggtcacagggcgggcgtcgctacgctccgtcgaagaaggaggagccatgggagatgacgagctcgtagccctcgcgtcagcacttggccaagcacgcggtgatgctgagacgctggcatcggtgctcgccgatgcgctcgagcgatggctgggcaccggcgcggtgcgcgtgcagcggcgcgggttgcgcacgcgacggatcgtcgagctcgcggtcgacatcggcgaccgtcgactggtgttgcgcccaggaccaccggtcgtggcggagatcgtcctccgttcaggtggcgttgcgatcgctcatgatcgggtgtcgctctcggcgtggttgtccgcgctgaccgaggcactcgccgcgcagctcgggacggcaacggacgacgtgcgggcactgcgccgtgccctgggcctcgatgactcggtcgactagcgtggcactggtcccaggaggtttgcgtggaactgcagccatttgaagcaccccagtccgtcctcgtgatcagtgcgcacccggacgatgtcgatttcggactcgcgggcacggtggcccgttggaccgcggcgggcacggaggtcgcctactgcatcgtcaccgatggcaacgtgggcgggttcgacccgtcgatcccccgttcggacattcctgcgattcggcgccgcgaacagcgggctgcggccaaggtggtcggtgtcgagacggtcgagttccttgggtacgtggatggcgaggtgacggtgacgctcgggttgcgacgcgaccttgccgcggtgatccgacgtttccgtcctcacaccgtggtggcgcagtcaccagtgcgcaactttgcgcggatcggtgcgtcgcacccagatcacatggccgtcggtgaagccgcgctgtgcgcggtgtatccggacgcgcggaaccccttcaccttcgtcgagctggcagaggccgggctcgaggcgcacaccgtcagtcaggtcgcactgatggcgtacccggagccgacccacttcgtggacgtcacggaaacgctcgacgcgaagctcgaggccatctcgtgtcacgcgagtcagttgcccgatcccgaggcgacgcgcaccttcgtgcgtggctggctgcgtcaaggagccgaggctgccggtctcggcgacgatcgctacgccgagctcttcttcgtgttccccacggcctagggcgcccatggcgcgcacgtacggatcgggtcgccctcgctcgcgatcaggtgacgcgtgtgcggcttcgacgtggcgcacgcgtcgtcgtggcccagatgggacctctgccgtgggtgtgctcggtttcgagtagtgtggtggttgctgagtcggcagggctcggcgctccccgtgttcgagcgcgttgctccccgccaggtgagcgggcatgagttcgcgcgtcagagacgagcacggcgtgtctcaccacttcgtggtcatcggcgtgatgttgaggagtctcgttgcgtgctgctgtctttcatcgtccgggtctgatcacggtcgacgagcgtcctgatcctcgggtgctcgagccgaccgacgcggtcgtgcgggtcgtgcgagggtgcgtctgcgggtccgacctctggtactggcggggcctcagtgagcgcggtccgggctcgatcggccacgagttcatcggggtggtcgaggagatcggctccgccatcgacggcctccgccccgggatgctcgtgatcgccccgttcgcctttgcggatctcgcctgccccaactgccagtggggcgccaccgtgaactgcgtgcacggtggcctgttcggcgacggcactatcgacggaggccagggagaagcggtgcgcgttccgctcgccgagaccacgctcgtgcccgtcccgggtacctcgtggtcggacgccgagctcgcgtcgttccttgcgctctcggacgtcatgccgaccgggcaccacgcggcggtgtcggcgggggtcacgaagggtagcaccgtcgcggtgatcggcgacggcgctgtcgggctctcggcggtgctcgcggcgcatcgactgggtgcggagcgcatcgtggccctgagttcgcacgcggaccgacaggtcgtggcccgggctttcggggcgaccgacatcgtcgcccaacgcggcgccgaggccgtcgcgaccgtgctcgagatgaccggcggcatcggtgccgacgccgtgctcgagtgcgtcggtacccaggaggcgatggagaccgccgctgcgatcgcgcgccctggatcgatcgtcggtggagtcggcgtgccccacggtgtgatgcccgcgacggcgctgttcggtcgcaacgtcggctggcgcggtggcccggctccggtgcggatctacctcccggagctgctcgaggacgtgctcggcggcacgatcgatccaggtcgcgtctttacgtacgagaccgacctcgacggcgtcgtcgaggcgtaccgggcaatggacgagcgtcgggcgatcaagtcgatcctgcgcgtcagcgagccgtagcacgttcgctggggcgacacgacagggcgaagggcagaggcgagacgagaagcggaggtgaccatgcagtatcgaatgctcggcacgacgggggtggaggtctccgtactctgtctcggggccatgatgttcgggagctggggtaacccggaccacgacgagtcgattcgtatcgtgcaccgggcgctcgatgcgggcatcaacttcatcgataccgccgacgtctactcggagggcgagtccgaggagattctcgccaaggcgctccgaggtcgccgggatgaggtggtgctcgcgaccaaggtgcatggtcgtatggggcctgatcgcaatgccaagggcaactcgcggcggtggatcatccacgaagtcgagcagtccttgcgccggctcggcaccgagtggatcgacgtctaccagctccatcgccacgatcccgacaccgacctcgatgacacgctcggcgcgctcgacgacctggtccgcagcggcaaagttcgctacgtcgggcactcgacctggcccgcgagtgccatcgtcgaggcgcagtgggtggccaaggagcggggctacgcgcgtccgcgcaccgagcagccgccctactccatgctcgtgcgttcgatcgagcgggaggtgctcccgacctgtgagcgctatggactcggtgtgttgagttggagccccctcgccggaggttggctctctggccgggaccggcgcgatcgcttcagtggcccgcagtcggctgcacgccagcgggtcgctcgacgtttcgatctctcgctgccggagaaccagcgcaagctcgacgcgaccgagcgcttggcccagatcgcggcggaggcggacctttcgctgatcgaacttgccatcggcttcgtgttggcgcaccccgccatcacttcggcgatcatcggaccacgcaccatggagcatctcgagtcccagctgtcggcggccgatgtcgtcgtgccgaccgcggtgctcgacgcgatcgacgacgtggtggcgccaggaacgacgatcaatccggtcgacgatggctgggttccgccctggctcgagccgactcggcgtcgccgtccctcgggtgcgtgagctcgacgcagtcggcgcgctcgatgagctcgtgggttcgttcgggccgcacctcgcgttcggccgacggagctgctcgcacctcgacgacgatcttcgggaatcggcggtgctgcgacgaacgatcgaaccgagtcggtgatgcggcgtcctggccgcgtcgtggtcgctcgtgcaactcgagcaggacacggttcgcgaacgccgtctagcggcgacgcatcgtgactctccagagccgtcggggcaggtcgccctcttcgaaggcggtcacgtcctcgagctcgaagccgtcggcgaggcgatggacgaggtcctcatcgaagaagtggaccgcgaagccaccgttctcgaagcgatcgtcgccgaggtcgatgccctggccgtagtgggcgtcgcccttgtggcgcaccgtgtagacgcacgtcgcgcccggtcgcaggactcggtgcagctccgcaccgagggcgacgagctcggacgtcgtgaacgccatcgtgaagagcatgtgcgcgaagcaggcgtcgaagtagccgtcggccagcgggagaggccgacataggtcgtgggtgaccgaggtgagccgggcgccggttccacggccatgtgctgcgtcccagagggctgcgagtccactcacggcgtagtcgaccgccgtgacctcgaggcccgcatcgagaaagtgcagggtgtcacgaccgtgcccagcgccgagttcgaggacccgagcggccccgtcagcgagcatgcgtgagagagcccatcgaccagcctcacttggcgccgaaccgtagagctgcgggctggcacgaaaggtggcctcccagtgggcttgctggcgtgttccgagatcctcgaccggtgtgctcattggtctgcttcctccgtcgcgtctgcagggtgtgcgctcccttctccccgatgccatggcgtcgctggtcgtagcggcggcccacggtccccggcggctcgatcgggagatcgtcgatctgcgctctcgactcgatctgcgctctcgaccccctgcactgctcgtccgtccatgccacgatcggatttgtcgtcgggaacatcacggagggccccgtgagcatcgccgtcgcgctgatcggcaccgtgaccatgggtcttggcctcggtctcgcgtggctgtatcgccggctgatcgagccatccgaggcgcaacgcacccttcgagcgtactcgagtcgcgagcgccgttcgatggaacgtcggctgcttcgcggtggtggtgacgagttgcctcgctcgtacctgatggcgctggtccaagatccgtcaggtcgcccgatcatggtcgccatcgcggtactcatcgcgatcgtcatcgggttcggggtttggctcgtcctctccgccctctggggaccgctgcgacccggagtgatgctgtgggacttcgtggcgacccaagtaccggcgtggagcggcgtcgcttatcggcgacggcggatcgtccgggcagcgcaacgtgctcttggatcctcaccggcttcgttgcgtcgttgacccgctgaacggcacgatgcgtgctgcgtccctggagcgtgtcgctcgtgcgacctcgctgtgacgtgcctacactcaggagcatggttacggggaagtcgcagagcgtgctcgatgccatcggatcgacaccgctcatcgaggtcgagccctccatcttcgccaagctcgagtacctcaacccatcgggctccatcaaggcgcgcatcgcgcgctacatgatcgaggcagcggaggcacgcggcgagctcgagcccggcatgaccatcgtcgaggcctcgagtggcaacacgggcaacgccctcgcgatggtcgcggcggtgaagggctaccgcatggtcgtcgtcatgccagaggggctctcgtcagagcgcgcagcgatctcgcgcgggttcggcgcggaggtcctgcgcgtcgggaacttccacgttcagcatgcccgcgagaccgcggtggagatgggcgagcgcccgggtttcttctgcccgcgccagttcgattccgaggacaacgtggccgagaaccgtgagtggctagggccggagatcgtgaccgatctcggtgcaccgccggacgcgttcgtcatgggtgtcgggacgggcgggacgctcatcggcgttggtcaagcgctccgggcggtcaaccccacgactcggctcgtcgcggtggagccggaggagagctgcacgatcctctgtggtgaagttcaccaccatcgcatcgagggcatcgccgatggcttcgtccccacgatctacgagcgccaccggacgatggtcgacgaggtgatcccggtcacgagcctggacgcggttcgcaccatgcgcgagctcgcgcgccgcggcatgttggtcgggccgagttcgggggcgaacctggtcgccgcccgtcagctccgcgagaaactcgggccgaacgccacgatcgtgacgatctttgccgacgagggggagaagtacctcacggagtacttcttgacccgtggcgagctcgctgcgatcctcgagggcagccacgacgacgactgggtcgccgcctcgggcggcatcacggcgccgttgcctccccttgctcggtgaggaactgacgctcgaagagctcggcgtagagcccacctgcggcgagaagctcggcgtggctcccttgctcgacgacactgccggcggccatgacggcgatggtgtcggcaccgaggacggtggagaggcggtgggcgatcacgatggcggtccgtccctggagggtgtcgccgatcgctgactggatgagtgcttcgttctgagcgtccaggctcgaggtcgcctcgtcgaggatgacgatgcgcgggttgcgcagcaggacgcgcgcgatggcgagccgttgcttctcgccgcccgagagtcggtagccgcgctcgccgacgagggtgtcgaggcgatcagggagggcctcgatggtcgcgaggagctgggcgcgcgcgagcgcatcgcgcagctcgtcctcggtcgcggatggcttggcgtagcgaaggttcgcgcgcacggtgtcgtggaagaggaacggatcttgggtgacgacgccgatctcggcccggagctcctcgaggtcgagctcgcgcaggtcgatgccgtcgagcgtgacgcgaccgcgctctggatcccacatccgcgtcaccagcatggtcaccgtggttttgccagcccctgatgggccgacgagcgcgagggtatggccgggctcgacgtggagcgtcaccccggcaagcgcccaatcacgctcctcgctccgcgggacaccctgcttggtgaggctcgcgaccgcctggttccgaggatagcgaaaccacacgtcctcgagggcgaccctaccctcgacgcgctgcaggtgacgtgggttcgggggcgaggtcacggcgggttggacgtcgaggacctcgaagatgcggtcgaagctcacgagtgcctggagaaggttgacccgagccgaggagaggtcggtgatgggcccggtgaggcgggtgacgtactgcgcgagcgcgacgagcgatcccagggagagtgcgccgcggatcacctggtcacctccgagggcatagaccgcgatggtcccgatcgcgctcgcaagcccgagaatagcgaagtagaccctgccgaccagggcgaagcgcacacccgcgtcacggacgcgacccgcatgatgggagaaggtgtcgagctcgtcgcctcggcggccgaagagcgcaacgagcagcgcgccggagacgttgaagcgctcctgggtgaaggcgttcatctcggcattggcttgcatctgttcgcgcgcagcgtgtgcgacacgacgcgacaagaggcggtcgacgaggacgaagaccggcacgatgagcaacgagagggcggtgacgagcggtgagagcgcgaccatgaagccgagcgtgaagatcagggtcgaaagatcgctcaccaccgagccgagggtcccgacgacggcttgtgagctggtgacgtccgaggagatgcgcgagagcaccgagcccgtctgtgcctcggtgaagaagccgagcgacagctcctggaggtgggcgacgagacgggtgcgcaggtcgaagatgatccgctcgccagcgaccgaggagacgtagcgcgttcccacgccgagcgcgctctgagcgagcgacagcgcggcgatgatgacgacgtcgatcgtgaggcgcccgatcgagcgccgaacgatggcgacgttgatgatgtctcgcaccacgagcggcaccagtgcgccgaggagtgcggagatggcgagcgtggccaggtagacgatgatgagggcccgatggcgcttcgtgacgctccaggcccgccgaagcgtgcggcgatcgatcgagcctggccgcaccggatcggcggccatgcctcgcagcgcgcgcattccgccgaagccccctccaggctgcaccgcgcctcctctctcggaaccaggctagacgcggtggtgttggccgagcagggcggctcgcgtagggttgagccgtgaaccagctcgcgcagtcgctctacgaggtcgtcgtccgtcgtcgagacgtacgtcgggagttcatcgatgggcccctcgatcccgaggtcctcggacgaatcctggccgcggcccatcacgctcccagcgtgggcatgagccagccctgggacttcgtggtggtgcgcgatcgcgagctcagggcggcctttcgagatcacgtgctcgaggaacgggcgaacttcgccgcgtcgctggatccggagcgtcgggaacgtttcgacaacgtccggatcgagggcattctcgaggcgcaggtcggcatcgtcgtcacctacgacgcctcacggggttccccgaacgtactcgggcgccacgcgatcgccgatgccggcctctactcggtgtgtctcgccatcgagaacctctggctggccgccaccgccgaggggatcggggtgggttgggtctcgttctatcgggagccgttcctcgcctcgctgctcgggatccctgcggggatccgtccggtggcctggctcgcggtcggtccggtggcacgattccaggaggttcccgatctcgagcgagccgactggcagcgccgtcgcccactcgcgcccttcgtccacctcgaccgcttcgacgccgacgcccccggcgaggacctggtggtcctgccggagcgcctggtcggggaatcggcggacatggactgagcgatctgcgggtcgcgttcgtctagggcgcgatcgtcgtcgcgaccagcagcgcgagcagcacgtcgcgggcgccgagcgctcgttcgagctcgcccagagcgtcgtcggaaggacgcggggccccgtcgatgatctcggccagggcgaggcgagcgatccgatcggtgatctcctgcagtgccgccgcttcgacgagattcgccgggaccaacgcgcgtgcgcgctcgcgcaggcttcgtgcccaggtctgatccagcagccttgctgcgtcgtccgcacccacgcggccagcgatgatggcggccagcgcgagggtcgcgccgcgccaggctgcgaggcctgctacgtgggcgtcgtgtccctcggcctcgagcgcagccgcctctgtgcgaagccgctcgtcggccgtcagctcgttgacgagagccgcgcgctcggcaagcgtggttgggtcggcaagctcgagcggatcctccacgagcagacggaggtcgagcgccgcgtcgacgagggtgtcgcggatccgtccataggcaccaagccgacccgcgaagctcccgtcgcggcgccagagaaggcggcgagcgacgtcctcggcccccgtcgcgaagatggcgatcgtggcaaactcggctgcgcgcagatagctcgttctgccaagctgggcgatgcgggccacaccgaggatgccgaggtggttcacgaggaggttggcgagcgccgtcgcgaccaactcgcggcggagcgggtgcgccacgcctgcgtccgagacgaggcggcgtacctcgatcgggaagtagttgaggaagagctcgtcggtgatcggatgatcgagcaatgaggaggactcgaggagctgcgtgaggtggatcttcgcgtaggagatctcgatcgcgagctccgatctggtgagcgggcgccccagcgagcctccgcgaacggccgctggatcgggcagcgtctcgaccgccacgtcgagctcggcctcgcggaccaggcgctcgagcagcgcgccatgctcctcggcccttcgtccggcctcgtgctcctcgaggctgaggacccagttctggtagacgttgtcggccaggacctgcgcttcgacctctccggtcagctgtgcgaggagctggttgcgctcttcggtggtcaggtgaccctggcgccgcagctcttcgagggcgatcttgatgttgacctcgtggtcggaggtgtcaacaccggcagagttgtcgatcgagtcggtgttggcacggccaccgtgcatgcagtactcgatacgccctgcctgcgtgaggccaaggttgccgccctcggcgacgatgcgtgctcgtagctcggatcccgtgacgcggatgcgatcattggcgcggtcgccgacgtcggcgtcgcgctcggtcgtcgcacgaacgtaggtgccgatcccgccgttgaacaggagatcgaccggcgccatcagcatggcgtggatgacctcgtcgggttcgtgagctccgggggcaaggtccaggagcacggcagcctctggcgagaggtcgacgtgcttggctgatcgcgagaagacgcccccgcccgccgagatggcatcggcgggatagtcggcccagctcgtgccggccccgcgtgcgaagaggctcgcgcgtgcggcaaacgaacgttccgggtcggggtcggggtcgaggaagatgtgccggtggtcgaaggcgcccacaaggcggatcccgtgcgagcgcagcatgccgttgccgaagacgtcgccggacatgtcgccgatgccgatcacggtgatggggccgtcggggtcgcgctcgagttcgtcgaggtggtgtcgtaccgagatccacgcacccttggcggtgatgcccatctccttgtggtcgaagccgttcgacccacccgaggcgaacgcatcaccgagccagaaacccatctcgagtgcgatctcgttcgcgatatcggagaaggtcgccgtgcccttgtcggcggcgaccacgaggtagtggtcgttgccgtcggtgacgaccgtgcgagggggatggacgatggttccgtcgacgaggttgtccgtgagcgagagcagggtgcgcatgaaggtgcgatacgagcgctcgaccttgtgcgggttgcgctcaccgggtgcgaggtcgcgaacgacgaagccgcccttggagcccatcggcacgatcaccgcgttcttcacggtctgggccttcatgagtccgaggatctcggtgcggaagtcgtcgggccggtcggagaagcggatgccacctcgagcgatgcgtccgccgcgcaggtgcaccgcctccgtggtgcgcgagcgcaggtagatctcgaagcgtgggcgcggcgagggcaggtaggtgagctggcgcgggtcgagcttgaacgcgatggcctcgcgttcgggctggaagatattggtccgcgtcatcgccatgacgatctcggcgagcgcgcgcagcaccttctcgtcctcgagcgtcgctgcggcctcgatatcggtggcgagctgggtcgtgatggcctcgacgtcacggggtcgatcgagttcgctggcgtcggggtcgaaccgcgcgtggacgagccggacgagatcgcgagctgcgagcggggtgcgggtgagcgtgcgtcgggccgaagcctcggtgacaccgagcgtcccaaagcgcaagtaggcacacagcgcgcgtgtgaggtcgatgtcatcgaggtcgagcgcggccgtcgtcacgagggtgttcaggtcgtccgcctctgcctgacctgcgatgaccgcttcgatggcgcgttcgaggcgatgggccgctgcgtcgtcgccgagcccatcggcgacccccgctggccagcccaggcgaagctcgatgatccacacatcctcgccggcgacccgtcccgtgtaggggacttcctcgcgtacgcgtgcgccgaagccctcgaggaccgggacgatgtcggacagcgctggtcgttggccgaccgcgacgagccgaagtcgctccacctctccggtcgcgggtcgacgtaccgcgagccgtactggcgagcgtcgcgctcggccgagcgcgaggacgtcgagcgccgcctcgcgctcggtggtgtcgatggcgtagctctcctccatgccctcggcgagcgccgtggcgaggctcgaggtctctggatcggcatcgggggtgctgagggcattgacggcagcctcgaggcgcagacggaagggggtcgtggcggcggcgatcgccgcctcgagctgactcggatcctccgggacgcgatcgaggaggtagtcgaggacgagtcgccgctcggagaggttctgcgtgagctgtgcggtggcaacgaggccacgctcgacgagcaccgcctcgaggcgatcctcgacgccatagtcgacccgagcggccggcaccacgaccacgagcctcgcccccgcctcgaccgggatcacgagggcacggggcagcccgagttcctcggcgagcaatccagcgcgacacagctcgtcgaaggttgcgtcgtcgactccgatcgccaggtcggcagggagcgagccgacgaagtcgcgcaacacgcgccatgagtggctcgatggcaggagcgcgaggagctggcggacgcgctcgaggcggctggcgatctcgggtgcgccaaccccgatcccgctgacgagcgacgggcggaaggtccccacgaagtgcacggcgcccgacgacgtcccgatggacagtgtgcgcagcggcgagtgatcgaggatgggggctgggatcgcggtgggctcgaggcgccactgccctgccgagaccgccagggttggcacggcgacgtcgatgccccgccgctgttcaccctcggcgctgactcgcagttcggcgatcgggaggaagtgggcgatcgccgaggttccgggcgtctcgccaccgtcgaggccctcggtcgcctccgcaagcgttgcgagctcgtcgcccatggcctcgcgatcgtgctcgagtcgcagcagctgcgtcgcctgcgtcgcgagggttcgcgcgaggtgctcggtctcgatgcgtgacaggcgggtcggtgtcgtcgctgcgaagaaggagacgaggtgggagccctcgacgaactcggcgttcgcgtcggtgagctcgccttcttccaagatgggatggaacgtgctcgcgttgtccacgatctggcgtaccgcggcgatgaaggtgtcgacgagccaagggacatcccagctcacgaccacgatgctcgtgagggggcgcgccggttcggcgatgacccgctcgagatcggtcgcgccgtcttggccacagtgcacacggaggacctcgttgtcctgggcgatctcgacgatgcagcggtcggagcccttggcgttcgtgagcgcatcgaagagggccgcgaccgcgacgccgatgcgctcggtggtgagcgcgctggtctcctcgtcgtcgaggtggcgcgcgaggctcgcgacgaagtgttccagggcgccagcgtgcgacggcacggcgccagaatgtctgcggaccgatgacaagagggacgccgtttctggacgcccagtaccagcttcgagcatcgtacgactcctttgtcgactttgcgatgccccgagcctaccgagctcgtgcgacttcgccaagggctcgccgggcgctcgaggcgctcggagccctatcggcagcttcggcgacgacttgcgtgcgtcgtgcacggctgcggtggagcgagctgcgacctggaggttctcgcccgtcgcagcgcccctcgcagctagcggcgcgcgatctcaggggccataatcgagatgaggtggtaggcaacgtgggaggccgcgatggtcgtgacctcagcgtggtcgtaggcaggtgcgacctcgacgacgtcggcgccacggatggaaagatcgcgtagcccatcgaggatcgcgagcaattccctggaggtgagccctcccgcctctggtgtgccggttccgggcgcaaaagccgggtcgagcacgtcgatgtcgatcgagacgtagacaggtgcggtgccgacacgatcgcggatgcgctccaccacgccatcgacgccgatgcgatcgacgtcacgtgcggcgaggacgcgaaagcccatgtcagcgtcctcggtgaggtcggagcgcgcatacagcggtcctcgggtgccgacgtgcacgctcgcgtcgggggcgaggaggccttcttcgaacgcgcggcgaaacggcgtcccgtgcgtgtagggcgcgtcgaagtaggtgtcccaggtgtcgaggtgagcgtcgaagtggacgagggcgagtggtccagtgcggggcgccagggcgcgtaacagccccagtgcgatggtgtgatcgcctccgagggtgacgatggttcgaccagcctcgccgagctctcgcgcagcactcgtgatggcagtgagcgcagcgtcgatcgagaacgggttcgccgccacgtcgcccgcgtcggcgacctgtacttcggcgaatggccagacgtcgaggtcggggttgtatgggcgcagcagcttggagcccgctcgaatggctgaggggccaaagcgtgctcctggtcgatacgacgtacccgcgtcgaaggggacgccgaggacgaccaggcgagcgtgaggcgcctcgtcgagacggggcaggcgtgcgaaggttgcggggccgccgaagcgcggcgcgacgagcgcgtctggcggtccgatgatctcgtcagtcatggagccctcctccgttccccgggcccatgcgcgctgtgcgctggtgctccttgcaccttagaggcagtgtgcggcctccgccatggcgagctagcgtgaggacgtgcaggctccacgctttccgatcggcgagcggctgcgccatgctcgcgagcaacggggtctctccctggccgcagttgccgagcgcactggcctgtcgaaggggttcctctcgcgggtcgagcgcgacggggtgagcccgtccatcgactcgttggtcgcgatcgccgatgccgtcgggctcgccgtcgcggacgtctttgcggtggcaccggtggtggtttcacgctccgtcgatcgcttccccgatggactgcctggcgagggagtccgggacacgttgctctccccacccgacgatcggcgcgttaccgttctcgagacggtcgcggcacccggagggagcggcggtgacgagctctatcacctgccatcgcaggtggaactttgctacgtggtcgccggtcgtatcgaactcgttttcgcgagcgagtgctacaccctcgatgcgggtgactcggcgaccttcgctgccgacgcagcccacacatggcgcaacctcggcgacggcgaggcccgggtgctctgggtgctcgcaccggcccttcgggatccctggacagccaaggagcgccgcgacgacggttcggtcgcggacgtgcagggcgaacgtgtctaggaggacgcctgccaccgcaggagccgctcgtgtcgtgctcctgacgcgcgacctgttgggcgcgagccgactcgactcggtccggatcgtgcgctcgagcacgagcctcgtcgacggagacctcgacctcgtcatcgtcgatgtgcgtgcggcgcccgagggatggcgatcggccgtggcgggactctcatgtccttgggtggccgtcgtctcgcacgtcgacgacgctggccgggatgaggcgctcgcactcggtgctcgacgcgtggtgacgcgcagctggctgttcggtgcccgcgacgtgggcgcgcgtctcgagcgcttgctcgtcaccgacacgaaagcgacgggaacggacgcggtggcggacgcggaggacgactgatgcgccaccatggcttcgtcctggcgcccgtgttcttcgtggtgctgggcgcgttgttcctcgggtccgttgcgttgatcggactcgatgtgctgtcgtttgcctatgtccgcgttggcgtgccggccgcctggctcttcggtgtgctcgtggcgtcgctgctcggaagcttcttcaatgtgcctgtatggcacctcgagacgcctggcgatccctacgacgagggcatcgtgagggtgttcggcgtgcagtatctgatccgacgcccggtcgcaccccagcggacggtcgtggcggtgaacgtcggaggtgccctcgtgcccaccgcgttgtcggtctacctggtcgtccacgaccacatcgagctcgttgccctcggtgccaccgtgatcgtcgccctggtcgtccacgtcgttgctcgaccggtgcgcgggctcgggatcgcagtgccgacgctggtgccggcggtgctcgctgcgctcacagcactcgtcatcacgagtcgcgacgtcgccgcggtcgcctacgtcgccggatcgatcggagtcctggtcggcgctgatctgaccaacatgaccaagacgcgttccttgggcgctggcatggtctcgatcggcggtgcgggaaccttcgatggcatcttcgtgacggggatcctcgccgtgctcctcgcggccctctaggaccgctctcgggttcgtcgcaccgatcgggtccttcgctgcgtgcacgcgagccgaaggaccctggtggcgcgccgcctcgctcatcacactgaggtgccccagatttcgtagacacccaggttacttcacgcgagcctcctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatcccgtgtcgggcacagaaggccacaactcgatggtcgctgaactgactccctcggtcggtgtgccagatgaccccctgcgcgtgggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccggcgatgccgcgcctggccatcgctgctgccaccgtgttgtggctcgtcaccacgccagcggcgaggagtgccgccgtgatccgtcgtgcgccgtaggtgccagaggatgcctggtggaccgcgaccactcggttctcgaggtcgcgtcttgcacatgcccgacgcgacggtgctacctgggtgcgtcgccatcggtagtagccagcccgggagacctcgagtaagcgtgccatccgtttgatctcgaagcgagcgtactccgcctccatcagcgcgaatctctcttgcttggtggcttcgcggcgaagtacgcggctgcttttcccaggaactcgttgtccttgcgcagctcctcgagctccctgcgcagcctgatgagctccgtgcgctcctgcgccgtgaggggcgggctgccagtggcgttggctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggggcggctcacactgtcaatggcggtcgttggagtgcgaatgactccaccgtcgcccatgcatccagattgaggaggtacaccatgagacgccgcgtctttgacgtgctgacgagcgccgtaggcctggcgatggtcgtcgtcttgctcgttgcaggatccttgctcatgtgggggtccagctttgcgagctcacaggtccacaaccagctcgcacagcagcagatctacttcccgcctgccgccgcgttccgccacgccaagcccggtacggagatcaccccatcgatgatcccgtcggtctcgcagtacgcagggcaacagctcctgaccggtcagcaggccgaggtctacgcgaacgacttcatcgcggtccatctgtccgagatgccctatcacggtgtctacgcgaagatctctgcggcagcgatggcgcagccgaagaacgccgagctccaggcgctgcgcctgacgtcgttcgaaggcaccacgctgcgcggcctcttgctcgaggcctatgcgttctcgatcttcggtgagatcgcattctgggcttcggtcgcggcgttcgcgctcgcggcggtgatggccgtcctcgtcggactcggcttctggcacgcggggcgcgtcccgctcgacaaggagatcctggtcgattcgaactccgaacgccaggtccacacgatggcttgagggcgagatcgttcacacggtgtcagcgcgctctggggcaggtcctcagggcgcgctgacgtctgcgtggttgtctcgccacgtagagttgggtcgtgagcctccccagtcgtcgatcgcaggagcgtcgagccgatctgacaacccctgctcgcacctcgacaggggtcgggcgccgaacgacgtctggagccctcgggccagagcagctcatcgagctgcagcgcacgatcgggaacgaagccgtgcagcgcaccctcgcacgccacggttccgttggtcgccggcgctcgggcgccgtcgccgggatccagcacgctccgtcgacgttggcggcgatctctgcacacgggtcgacgatccggcacgcggtggcggcggcggttgctgcggtcgtcgttgcgggggtccagaaggcgacgggatcgaagggcgggtcaccggagggtgacctgctggatgcggcgctgggcttcgcacgtgcgctcggtgcgagcctcgagcgagacgtgcgcacggggagtggtctcgtcgcacgatctggcgacgatcgcgcgacgcttggcgcacgggcacagttgctggccggcgaagggagcctgtccgacacgaaggcggcctcgacgatggccaccaggctcgccgaggtctacctgaccacggctctgaccgaggaggcagcggccgccgctgagcgcaggctcgccgagatcgcgcccgagatcggtcagatcgacggcgagctcgctcgagcgatcgcgcacgcgcagtccgaattggaggtcgaacagcagctctcggcgacgacgcacaccctgaccgatcgtctcacgaaggtcgccgtcaaggcgatcggtcagaagcagcaccgtgcggtgcgcgatgcgatcgcggccgatggccttcgtggcgcgacggacgtgctcgagcggacggtcatggcggagtccggcccgaaggccaccttgagccagacgtcgaagtcggtcatcgccaaggcactcggttcgtcgctcagtgcggacgcgctcgaggtcgtcgacgaggcctatcagtcgctgcgtgcagcggtcgcgacggcggttgcggcggagatcacctcacggatcgagggtggatggttctcgcggggatcgaagcgagcttccgtgctcgaggcacgagccgaggccgcccggctcgccgacacgctggcgttcgccttggagcgggaccttcggaccggcaccggcgtcgccggcacctatcgcgcgaccggagacgcagccacggatcgggtgggttcggcgacccacacccgataccgggctggtctgctctcgaaggagcgcagcaaggcacccgagacactcgtgtcgcagcttgccaaggcctatgggcatctgtcgctctcgcgtgcggccacgacggcggtgacgtcacacctcgacgagatcgatccgtcgcttcccgaggcacggctccggctcgtgcgcgcggtcgacggtatcgccgatcgggatcaggcgcgcgccgtggtcgccaagcagctcgcgtcgctcacgagccgctccagcgcgaacgccgtcaaggccatcacctcctcgtcgaacaagccgcttcgcgacgcactgaaggatgagagcgcgaagggcgccgtcggcgagctcgaggctgtgcagcgtcaggagtcgggtccgagcgctcgccaaagctccttgaccgatcaggtcctcgcccagaccgtcacgttgccgtcgctcacgccgttcatgtcgctcgtcggggcgatcatcgatcgatcggtgcagcacaacggggacgagatcacccttgatcacagcgtgcgcatcccggtgtcgcacggcgcattcgtcgggctccgagccgtgggcaaggcgtcgcgtgaccacgacgcgacacgtgcgggcatgaccttcagcttcacgggcggatgggacgccgccatcgcccgggcgatggccggtctcggtggctacctgaccatgacctcgaaccgtggtggacacggcgccatggagatggcttcgtacaccctctaccgacgctttcgggagtcgcggttggtgcccgccgatctcacgagcaccctctggggcatggggggcatcacgaagggcgccgacgaagagcaagctgcggcacagtaccgtgaggcagagtcctgggcctcgggcatcgagcagtcgatgacggaggcagatgccgctgagtcgggtctccacgccgaggtgagcggtcgcctcgggcatgcgagcgttgcccaggtcgagggtggattcgctgtcaacaccggtactcgctacaccaagcagacgttggagcgctctggtgcgctcgcagcaccgcttgcaacagcgggctccggccgccagccgttgcgcggcgagcgggtgacgaccttcgaagcgttcgccggagcctcgggtgggggcggcatcggcaccacggaggcgtacctcacctacagcgctcccgacgcgagcctgcacaagccctatcgcttcagcgtccaggcctcggccggggccatgatccccggcatgcccggtcagatcgtggactgggcggtcgagggagcgtccaagctgacgagcgctgcgatgggggcggtcaacaagtgggagcagggcagtaaggggagcgcggcgctcaaaggggcggaagtcaccgccaaggccgggctcgaggtcatcgagttcccggtgctcaagaacgctctcaaggaatcggctggtgtggcagcgatcctcggggcgccgatcgtcgacatcgccgagtcgtcgacgctcgcccaccagcccagcgtcgtcggcgtggccgctgcgcccctcgtcggaaaggccaatcgggagtacgccaaggaggctggctcgctcgcctccacgcggttgatgtccgcatcgaacccgacgagtgggctttccttcaccctctacatcgacttcttgcacccgaaggagcgcagctacttcgcgctggcgcgccagacgtcgacgcaccatgacgcgcacgtggtcgaggcgaaggtcgtcaagcgcacgtcgctcttctacttcgatccgaagtcgggtcgcctcgaggctggcggtgcgcgcctgggaacgacgcgctgatggcgttcgatctgttcgacgtcgttgtcgatgcgtgtcgtgtgcagggcttggacccccagcctgtcggcggctacgaccatgtcgtcgtggccgaggtcgaccggggggatcgccgttggcgcttgttcgccgaggccgatggggcaacccccggcgtcatcgtctactcggtgttgccgtacgccgtcgcgtcgacccatcgagacgaggtggctgggttcgccgtgcgggtgacctacgtgctccgctacggggatctcgaggtcgatctcgacgatggggaggtgcgtgttcgaacgagtgtcctggtcggggctggcccggtcgcactcgatgtcgtggcggaactcatcgagcacaacgtggcgatcgccgagacggtcttcccgctcgtcgagcgtgtcgccgtaggcgagctgagcgccgacgaggcgttcggtgtgcttgcgtcatgatctggggagggtcgacgttcgtcgtcgcattcgccccgactcggacggacgctcgagggacggcgctgctcgagatcgagggtgacctctcggatcagcgaacgggagtgtcgagaggcttcgggccgcctgagggtcggtggctcgcgcgggtgggccgttcggcgcgaggagcgggccgctgcggtgttgcggtgtgtgcacgcaagcggacggtttctgtggggcgttgagacggcaggacgcggtgccgtggttgcctgtctcggtggggctgtcgtaggatcgtcgcgtaccgatgaccatccgagtggaggttggtatgcggagtctctggcgtgttcgccatccggtgcgggcggcgatgccacgctccatccgacgagcacggcgtcgggcgtggcgcctacgtcatcctctgcgtgcgtcgctgtggacgctcgcgagaggtcgccgtccgcgccgacaccgccatcggtgaacaccagtgcgatcgacgggcgtccgtctcgatcctcccacgtggcgtgagctacgatccgctcatggatcgcgcggctcaggcgtcgtgggagacctggtgggtcgagggcgaagcgtgcttcgcagccgttgtggcgacgctcgaggccgatgccctgacagggccatccttgctcccgggatgggatcgtgcgacggtcatcgcgcacgtcgcaacgaacgccgacgcgctcagcaacctgctccgctgggctgcaacgggagttccgaccccgatgtacccctcaccggaggcgcgtcgtcgagcgatcgccgagacggcgagcctccctcgcgaccagctcgtcgcgcgagcggagagcgcgcgaggcgagctcgccgcacgcatgcacgatctcgctccagaggcatgggatcgcccggtcgagacccgtgacggacgcgcgatcgtggcgagagaggtggtgtggatgcgttgtcgcgaggtgtgggtgcacgccgtggacctcgcggcgggcgttgggttcgagtcgatgcctccagccctcctcgtcgcgctcgcggacgacatcgtggccatgtgggcgaggcggagcgtcatggcgccgtgtcggctggtcgccggtgagcacgcctggggcgtcgaaccgccggtcgtggaggtcgatctcgcgaccgcggtggccgttctgagcgggcgtaccccgctcgagacgctcggccctgcggtggcagggctcggtatgcctgcgtggatctgaggttgtcgtgcgcaggtgctgtcgggtcggtgtcggcgccggcgcggatgtggcaacgacctgtcgggcgacggtgacggccacgtgcagcacggcccgctgcccgacgaacgctccgcgcgaccgacgttaccactgggtcgggactcctcagagcgcatcttgttcggggatcgttgtcccatgttggccggcgcgtctcgcacacggccgtgaccgagggcgagggcgaccacactgggacgatgaccaacgtcgagaacgtccctgaagttcgtgtcgtgagtgccgctcgagaggtgcacgcgacaccggcgaccatcttcgagctgatcgccgacccgtcccgtcatgcgtcgtgggacgggaacgagaacgtggcctccgcgagcgaacaccagcgtgtgacccgtgccggcgatgtgttccgcgcgaccctcacgaccggcgctgtccgggagaaccacgtcgtggagttcgaggagggtcggcgcatcgcgtggcagccggctgagcccggcaaggagccgcccgggcacctgtggcgctgggagctcgagcccctcgacgcggagcgaacgctggttcgccacacgtacgactggacggccctcaacgatccgaatcggttcgctcgggcccgagccacgacctccgagcggctcatggcatcggtcgagcggctgtgcgcactcgcagagcgcgaggcctcggatcctgcctgagcgtgcgcacgccgttgagcgtgtgttcgatggggcgaacgttcgctcgtggatcaaggccgatgcctcagacgtcgatcgggtgatctcgaaggcctggcagagccggcggtgggattcgaacccacgacctgacgattacaagtcgcctgcgctaccactgcgccacgccggcgggcgcctgcaggttagcttgcctccaccgaacgtcgggttcaccgcagcgccgctcgccgtacggttcagcgagcgtcgtgggcgaggccacggtcctcggggccctcgcgatcgcggggccgagtgctgaccgcgaggaggtgggcgatggtcgttgccgcggcgaccatgcgatcggtctcgcgcatgatgacgcggttgcgctcgctgacgtgaggtgcgctggactcggatgcgaggagcgcggtcgccagctcgatctgggtcgtgcgggcgcgagcgacgtcgacggcgaaccgatctccgcgggccgccgccgcacagctttggaggaggtccgcgaggtcgttgccgaggcgtccgaggggcacgcttggagccggtgtcgtgcgttcgaggtcgaggagtcggtccagcacgagggcgctccagacatagcgccgcacggcggcgaggacgccgaggacccgctcgtcgtcgttgacggggtcggagcccgaatgtcgtggctcgtcgagccagcggctgaccgaggcctctgcccgctggcgcgccagccgtgctcgtcgacgcgcatcggtgaccgcgacccgagcagtcggggtgcctgactcccacgcgctgccgagtagcgctgcgtgctgcgcatccgcctccaggagggtggcgagccgctcgccgactcggcctcgttcccagctcggccacgcgatcaccgccatcaccgcgaggagactgccgagcaccgtgtagacgctgcggtcgatcgcgaggccgagcgcaggcgctcccgtgaaggcgagcagaacgacgacgagcgatgacaccgcgaagctgaagagcaggtagttcgcgcgctgggtcgcgatggcaaggccggcgagtgcgacactcgccgcggccagcgtgacggtggatggatgtgtgagcgcgagcagtgcagtcacgagcccgacgcctatgaccgtgcccatgctgcgcgcgaacgcacgacggagcgtcgtcgtgaagtctggtcgaagcacgaagatgaccgtcagtgggagccagtagcggtgggccaccggaagcgaggccgcgagcgctactgctactacgagtgtcgccgcgacacgtgcgccatggtgaccgacctcggacgagggtgccagggaccgtcgaagcgtcgccatggcgtcgtggagcgatgcgcggagctcaccctcgacgcggagattcgtgccgtcggcacggcgcatcggtgccgctcgccccaggaccactgcgccgagatggtcgaggctgcgcaggctcgcggcgaggttctcgatggcgaccgtcgcctcgcgagccccctcgccgagagctccgtgatcgtctcctgcacgctcgagcgtccagagggcgacgccgagtatccgcgcgatcgtcggcggcggctcatggtggcgctgggtcatgagccgacgtgcgagcacgtcgagcccgtcggcgagcgccgtgagcgccgtgtcgatcgcgtcggcgacgatgcgtgcgtccgggacgtcatcgtccagcgccacctgaacatgggttcgggccgtggcgatcgcggctgcctcgaggcggatgcgctctgcctcgtcggcgatggagcgtagagcgtcgaggatcgctgggtcgctaaagggctgcggttcgcgaagagcctgtcggagcgtctccgatccctctaggtcgagcacgctcggaggcgcagaaccgatcgcacgaagggtcgaggcgcgctctgcgagaagcgtcgcggcggcggtccgctccatcggtgacctgacgaagggaagggcgaagccgacgaggagcagctcgccgagcccaccggcgagcgtccaccaccctgcgacgagcgctgggccgagcgccaggtgttgatccgcgaacagtacgacgccaagcacggcctcgaggccgatgacgccagccgcagggccgagcgcgacggcccaaccggcggccaggccccagatcgcgaggatggccatctcggctacgaggacgtggccgagggtcgcccccacggtggccgaggcggcgaagacgatcgccccgaccaccatggtcacgatgcgagatcggtaggcaccttcgagcgagctcatgccggcgatgatggctccgatcgctgcctcgatggcgcccccgagatggtggctcagcgcgccggccgtgatagcgaccgcgacggcgagggctactcgagcgccagcggcgactcgcaggccgcgccgatcgaatcggtggagatcgagagccgggcgcgaggccgctagcgccgtcaccgtagccccggccccagtgctccggtgctggcctcaagacgcaggagccacgtcttgcgttcgtcgccgccggcgtagtgaccgggcgcaccgtctgcgcggatcacacgatgacagggaatcacgagcgggagcggattgcgggcacacgcagtgcccacagcgcgcgcggctcggggccgaccgatggcggctgcgatggcgccgtagctcgcggtggtgccgtagggaatgcgcacgagcgcggtgcgtaccgccgcgtcgatgccgcgtgctggtgcgagatcgatggggacgtcgatgtcacggcggcgcccacggaggtatgcatcgagcgcgcgctcgacgacgacggcgagcgccgcacgtcgcggcgagagtccgggcgtcggctcgaccgcgtcggcgtcgaacgtgatgcgcgcgagcccacgatcgctgaggccgatcgccacggttccgaggggtgtctcgacgagtgaccacgacacgtcgtgtccgttggctctgccgtcgtcaccgaggtccgctcgcacgtggcgtgccgtgacgtcgtgaccagcccctcggggtccccgatcgtcgtgcgggctgatcgctgtggcatcgatgccatgtggtgccagcgcgctgctcaccgcagtgcctcctcgtgttccaacagagaacccgatgcgcggcgcaagcgctgcggctcgggacgccccgtgcggtcacggtgcggccaccaggcggcgctggctagcgaccactggggagagtctactcgcctcgcaggtgctggtgccgggccgcgcccgactccgtccccctggtcgagatctcgctcgcaccagctagggtggttccgatgccgtgagcgttgggctcgcggacgctggcgcctcgtgacgccaggcgggccaacgagatcagttctcggccggtgtgatgcactggccgtggtgtcaagtcggccgttctttctcgagccgacaggagacattacgttcatgcatgctgacctcacgacgcccacctccaagcccgttgctggctcgtcgttcgccgacctcggcgtcccggaaccgctcgtggcggtggcgacggcccaggggctgctcgagccgactcccattcaacgcgctgcgcttccggacgccctcgctgggcgtgatgtgcttggctcggcgccgacgggaaccggcaagacgctcgccttcggtcttgcggtgctcgcacgtgtcagcgcgagcgcacgcgcgaagcatccgagggcactcattctcgcgcccacccgggagctcgcgatgcagatcgcggacgcactcgatgccttcgcacgtgcagagcgccgctcggtcgcggtcttctatggtggggttggctacgggcgccagctccagcagctgcgccgcggcgtcgacgtcgtcgtcgcgacgcctggtcgcttggctgatctccgcgagcgtggcgacgtcgacctcagccacgtcgaggtcgtcgtcgtcgacgaggcagatcgcatggccgacatgggcttcttgcccgaggtgcgtcgtctcgtgcaggcgacgtcgagcgaacgtcagacgatgctcttctcggcgaccttcgagggtccggtcgagacgctggtgcgcgagctgtgccacgacccggtccgccacgtcgtgacgcgaccggacgacgagcagggtgaggtgggtcaccacttctggaacgtcgatccgagcgagcgtctccaggtcacggccgccgccgtgcgagctgcgggaccggcggtcgtgttctgccggacccgtcgaggcgcggatcggatcgcggagcggctccgcggcgagggccttgcgacggccgcgatccacggcgatctcaatcagcgtcaacgcgaacgcgccctcgagggctttcgtgctgggcgcatcgatgcgctggtcgccaccgacgtggcggcacgcggcatccacgtcgatgacgtgccgctcgtgatccacttcgatccaccagagcggacgaccgactacgtccaccgttcgggccgtactggtcgagcgggtcggcgtggctcggtggtctcgttggtcggaccacgtgagcgctccttcgtccgatcgctccaacgcgaactcgggttgccgcacggtcttggagcaccggacgcggctctccttcctggctcaggtcgcgtcgagcatgtcgggggccgccgtcccgccgtcgggcgcgaggtcgaagagtctcgtgcggcgagcgaggggcggggtgtgccacgtcagcgcgatccgagagcccgccgtggctctatcggctcgcgtcagggtggcgccgttcggagcgacgcgcgtagcgcgcgtgcggacgcaccgagaggcggggctgcttcgcctcgtcggcctcgtcgtccggagcgctaggcgcgaggcgtctggtcgctgctcggcgcgctcgagcgtgcgtgtgttcgccaggcgccgagcagcgccagtcgacgtcgctgctgggaggcggcggcgcgatcgaggccgtggtcgcgctcgatgagagccgcgctcaccgcatcacggagctcgaccggcttctgatcgtcgtacttgaacttggcgctgacctcgacgatctcgagctcgagcgctcggatcgcgccgagcatggtgccatagggcggctcgccggggacgacggcagcgtgacgaccctcgggctggagatcgccgagctggcgctcgaggatcgccgcctttgcctcggggtcgtcgacgatgcgtggtcgacagacgaactgaacggcgctgtagtagctcgtcggcacgccgtctgccggggccgtcgcatctggcgcgcgccaatagcccggaatgaacgcgtagtcgccgtggaacgcgacgcgcacgcgcgtggctcgctcgaggtgtggccatacgggattggtgcgcgcgagatgagcaacgagcacggtgtcgacgagggagaggtggagcggcaggacgaggggagcctcgtcggggtcgaggttggcgacggcgaggacgccgaacggctcgtgctcggcgagccaacgacgccactcgtcctcgctggtggctgcgtcccacgggtgaatcagcatggcaggtcccttgcgtgtgtcgcgacggctctcggtgcgccacagcgcacctgcgcagcgtaacacgatcgccacgcggacccacacggtgccgtcgagcgcgccctagccttcgcgctgcgcacgagcgcttgtgcggactcgtaggtgacgacggcgcacgagtctcgtccgaggcatgggtcgtgaggggatgatggcggagtggctcgaggaccatctggcgatcctgttcgtggtcgcggtcgggatcggcgtcggcgttgggcggcttggcgggggaggtgccgtcgcgatcgggccgacgctcgcactgctcgtcgcagcgagcgccgtgaccgtgggcgctggcagtggcgtgcggtcaggttcgcgttggcgactggtgctcgtcgtcgtcgttgcccaggcggggatcgtcgtcgtcaccgagctcgtcgccgcgatcgagtccggcccgcttcgcgatgcggtgctgtgcctcggggtcgcgcccagcgaaatcgcaacgatcggtctggcggcgttggtggggcgggaggcagcccgcgctgcggcggtgctcgtggcgggctcggcgatcctgagcgtcgtggttgcgggccccgtgctcgggctcctcgcagtctcggggcatgtcgcgtcgaacggcgtcctcgtcgctctggcgctcgaggtggccctgccgggagcgatcgggatgggggtcgcgcgtctcgtccgacgtccttgggttcgcggcactgggcgtctcgtgagcccactcgcgctcctcgccctcggcgtcgaagtggggacgttggcgccgatcgccatcgctgacgtggctgcgatcggaagcttcgcgctcgtcatcgttgggagtgcggcggttgcgctcgcgatggcgatgctggttgggacgactgcacgtgccggtgtggtgctggcggtaggggtgcgggacttcgcggtcgcctcgggcatcgccgaggcggcgatcggggcgcacgcagcaggcgtgcttgcgctctacggactgctcggcgttggcgtcgcggccggtgccgagcgctggtggcgctcgagaggagcgcgctcctagcggctcccgagcaccatcgccgtcggcgaggcggcgtgcgcccgccgcctcggtggtctagcgtgaggcgcggaggcgatgggcgtgggagcgacggtgcgcatcgagcgagcgggtgccgtgtggacggtcctcatcgatcggcccgcggtgcgcaacgccgtcgatcggccgaccgccgaggcactggccgatgcgttccgagccttcgacgccgatgacgaggccgctgtcgcggtgctgagcgggaccggcggttcgttctgtgccggtgccgatctcggggccttcgggaccgagcgcgagaatcgtctcgacccgaccggtgacggtccgatgggcccgacccgtatggtcctctcgaagccggtcatcgccgccatcgagggctgggcggtcgccgggggtctcgagctcgccctctggtgtgacctacgggtcgcggccgaggacgccgtgctcggggtcttcagccgtcgctttggcgttcccctcatcgacggcgggaccgtacgcttaccgcggctcatcggtcgatcgcgggctctcgacctgatcttgacgggtcgggcggtcgacgcgaccgaggcgctcgcgatgggactcgtcaatcgcgtcgtcggtcgaggggccgcgctggatgcggcgacggagctggcgaggcagctcgctgggtttccgcaggcgtgcttgcgcagcgatcgcgcggcactgtatgcggccgagggacagtccgaagccgacgcgcttcgcacggagttcgtcgcaggtcagcgtccgctcgaggcagaggcgagagccggtgctgggcggtttcgccgtggggcgggacggcacggacggccactggatcaatgaccagggacgtggctgcgttgacgatggcgggccgcgcccagatcagggacgatcacgaccgcacccgtgcagtggtgcgcgacgcgggcgctcacggacccgatgagtgcatcggcgaaggggcggtgtccgtgcgcgccgacgacgaggagctgggcgtcgcgggcttcgacgcagagctgctcagcggggtctccctctcgaaggaccgactcgacggcgacggtgggatggtcctcgtcgatgtcggcgagcacgtcgtcgagcacacgtcgagccgcgcttgccaatgccgtgtcgtcggcgatcggtccgagatcgcccgctccagcgagttcgtagtcgtagggcgagcgccagacatgcacgacgcgcaccgtcgcgctgcgcagggcggcctcggcgagcgcccaacggagcgcgagtcggcttggttgggagccgtcgacgccgacgacgatcagttcggccatcagatcatgtcctccttccggtcgtggcctcggtagcgcccgctggagcgagggccgccgatggctccgctctcgacggtgcgctccgtacctgtctgagcagaggcgccttgatcgtgtcgagtgcgagtgtgagcaccccgacggcaccgatgaggccgacgacgtctgggaacggtacgggggccatgaggatgcccgtggtcgcaaggaccgccacgatcacgagatcggcaagggacgtgagggcgagccaccaactcgggggcgaggtccacagatggccgggttcacgcacgaggtagaccgtcgcctgaccggttgcgacgagcatgacgaacgcgagcgtctgcgtggatgccagcgacagcccgagcacgtcgcgtccgatcgcgacggtggcgaaggccacgaggagccacggcacagcgatgacgagggcggccagggcgagctggttcactcgccaacggtccggggagggggagtagctgacacggtcggtggcgagcgacatggtgacgacgtcgttggcgaacagcaggaggaggacgagtcggggcgtcgtcacgaaggtgttcatgacgaggagcccgagaccgagaaacagcgagacctggaaggtcttcgcgatcttgttgagtgtgtacgtgagcatgcgctggtagacacgacgcccggtctcgacggccgcgacgatgccgccgaggcccgggctcgtcagcacgaggctcgccgcactcttggcgacgtccgtcgcgttcgagaccgcgataccgacctccgcacgcttgagcgcgggggcgtcgttcacgccgtcgccggtcatcccgaccacatggccgcgtcgctgtgcccgctcgacgaggaggagcttgtcctcgggaaggacgctcgccatgacgtcgacgtcgatcgggccgtcgcttcgtcgccgaaggtcgtcgaggtcaccgaggcgctcgccgatgccgacctcccgagcgaccgcgagtgccgtctgtggtgtgtcgcccgtcaccatgatgacccgaacgccgagctcgtgcaggtggctgacgagcgcgccggagtcggggcgagcaggatcgccgagggcgatgaggccgacgagctcgagggtcgtcgtgcctcgcgcgaccgcgaggacccgcgcgccgcccgaggccagcgccgcgacggcgtcgtcgaggccggggggtgggttctcacagaggctggcgacggtcgctggcgcgcccttgacgatgcgcgtctcggtgtcggccgcgtcgcgccagagcgcctcggagcgcttggtcgcaggatcgaacggcgtgaactgcacgcgctcacctggtccggctggcgacagtgtgcgagcgagcaccgcgaggtcgatcgggtcttgggtggctgcgtcggaggcggctgcggcgaggccgagcacgtcgtcgcgggaagtgtcgccgaaaggggtgaccgccgtgaccgtgaggacgttctgcgtgatggtgccggtcttgtcgctgcagagcagatccatcgccgcggcctcttcgatcgcactcaggtgcgtcgcgagcacgccctcgcgcgcgagcgccatcgccccgacggaactcgccagcgtgaaggtcgccggcagggcgaccggaaccgccgcgacgagcaggatcaagacgaacgggacgagggttgcggggtcgagatggcgaacgagaccgtcgacgacgatcgcgaccacgagcagagcgtccaaggcgagcagggcccgcacgatacgcaggatcgtctgctcgaggtggctctgggtcgtcgccgtccgcaccagttgtgcggtgtgaccgaagtaggtgcgctcgccggtcgcgctcacgacggcggtcgcctcgccgcgcacgacgaccgaaccggagtagcacgtccccgagccatccaggttgaccggtcgcgattcgccggtgaggacggatgcgtcgagcgagatgcgtccgtcgacgacgtcgaggtcggcggggacgatgtcgccgacgcggacgtggacgacgtcgccagggacgaggtcggcggcgtcgacggtgcgccaggtgccgtcacgccgcacgcgagcctgtacggcgagtcgttggcgcagcagtgcgagcgcgccgtcggccctgccctcttggacgaagctcagggcgccgttgaagacgatcaggagggcgatgatgatcgcttcggtgaggtggtgatcgagcagctcgagcacgaccgcagcctcgaggaggtaggcgatcgggccggtgagcttggacagcaagcgccgcaggacgtgtggccgttcgggtgcgacggcgttggggccgatggcggcgagtcgagacgcggcttcgcgctcggtgaggcctgcgggctcgggcgccgaggggctggtcgcagactggaagggatccgatgtcgtcggttccgtgtccgccatcgggcctcgctcagcgatcggtcgcagattgcgggaggtccgtggtgtccggcacgatgacgatggggaccggtgcgtggtgggcgcacgtcgtcgcgatcgacccgaggaggagtgccgcgagcgagtgggtgcctcggcgccccacgacgagcaggtctgcatcctcggcgtggtggcacagctcgcgtcgcgggtcgccgcctacgaccacggcttcgacctcgaccgaaggcgcgacggaggcggtctcgtcgatgaccgcctcgaggcgctcgcgcaccgcgcggagcgcgacctcgtggtcgacttggaacctcggggcctggagctcgaaggtgagatctccttcgtaggggtcggaccagaccgagagcgccgtaacggaccaccctcggcggcgagcgtcatccttggcccaggcgagtgctcggcgcgatccgtcggacccgtcgatgccgaccaggatgcggccggaccgcggaggcgcgtcgcctgcgtggccgggccgtgtgatgagcagcggggacgccgcgtggcgggcgcaggccgaactcaccgagccgaggagcaggcgctcgaagccgccccgcccacgtgatccgacgacgaggagcgacgctccgatgctgcgatcgcagaggacgtggtcggggccgccttctgagacgaccgggtcgaccgtgagcccaggcgggaccgacgtggcctggagcgcatcagccagcacacgtcgggcggcctcggcgatcccgtcgtcgagtgctgggtcggggacgtcggctccacgtgcggccacgccctgccatgcggtgaccgcctcgaccgtcgcacccctgatggcggcctcgtcgagcgcccatcggagggcgccgagcgatgcgtccgagccatcgacgccgacgacgacgcgctctgccatgacgacctcctttgccaccgtgtccgtgagtgtagggctcgctcgacggctcgaccagggacctttggtcatggggagcctgccgaccggctcatgggcccgtgatcctacggtcgtagcgatcgggcggctcggtcgatgccctccgacgccatggggtgggggaaggccatcgtcgcgagctggtccaccgtgagcccggcgtggatcgcgagcgcgagcggcgcgatgagctgcgctgcgtcgacgccgagcacctgggcgccgagcagggtgccgcggtgcggctctgcgatgagggcgaggaacccttcgcgttcgtcgaggatctgggcgcgcgcatcaccggcgaagtcgtagtgacccaccatgacgtcgccatggcgcgtccgcgcctcgacctccgtcagtccgacgctcgcgacctcgggctcggtgaagacggtcgtgggcaccgcatcgaagtccattgcgtcggtagatcgaccccctgccatgatgcagtgggcgacgaccaggctctggcgtacggctgcgtggaacagtggggtccgtccattcacgtcacctggggcccacacacgtgggtgcgaggttcgaagctgggcatcgaccgtcggcgcgcggtcgggagcaagcccgagcgcgtcgatcccctcggggagctggacgtggcggcccgtggccatgatcacgagatcaccccgggtgacgtggacgtcgccgccgtgctgccagctcacctcgtagtcgctgccgacgcgcgtgatgctccgcacgagcgcgtcgacgtggagctgcacgcgctggccgaggaggctcgcgaggcccgtcgcaagcgccgcgtcgtagcccggcagcaggcctccggttgcttcgaggatcgtcggtgcggcccccaggttcgccagcatggaggcggtctcgacgccgatgtagcccccgccgatgatgacgggtcgcgatgggaacgggagatcggcaccgaggcggaagagctcgtgcgatgtcacggcgagatcagcgcctgcaatggcgaggcgactcggtgcggagccggtcgcgagcacgaggtcgtggaagcggacgagcgtcgtggaaccgtcggcctcctcgatcgcgatccgttcggcatcgtcgatgcgggcggtcgccgtcatgaaccgaatcgtggaggctcgcagttcgtcggtgtgctgctcgtagcgcaagcgctggacacggtccttgtgtgcgagcacccccgaccagtccacgtcgagcgcggtgcccctcaggccaaaggtctcggcgcgcgtcgagcgcgcacggatgaggcttgcctcgcgaacggccttggatggaatgcagccctcagcaaggcagttgcctccgaggttgccgatcggatcgaccagcaccaccgagcggccggcccgatccagcgcgaacgccgcagggtagccaccacctccggctccgacgatgacgacatctgcggttgcttctcgtgccatggtgacctccaccgtcgatgacgaccgtagcgcagccttggcgtcctctcccgtcacgcccgtgggcgtcggcgagcggctggttgcgctcgtcacgagtctggagcgcctcggcgcggcgggggctgcgagggcacagaaagggacagaaaagggaagaaggtcccatattggaatggatccaaggttggaagtgtgctaggttggacgtcatggagaacgacggcgagcgccgtgcgacgcacgcgaccgagcagcttcgcgcggcaggtctgcgggtcaccgctgcgcggctcgccgttgtgcgggtcttggagcgccacccgcacgccgatgccgagtcgatcatcgccgaggtgcgaggcgaactcgggaccgtgtcgcaccagacggtctacggcgtcctccaggcgctcgtcgaggcaggactcgcccgccgcatcgagccggcagggagtccgggccgctacgagctgcgcgtcggcgacaatcatcaccacatcgtgtgccgaagctgcggtgcgacggtggacgtcgactgcgtggtcggcgagcggccctgcctcacgccctccgagacgcacggctacctcctcgacgaggcggaggtcacgttctgggggctgtgtccggcatgtcgcgatggcgagcgcgcaaggcactccgagagggtcgatgcggacatcgacactggcatccgtggaggtacgcaatggatgagatgacagacgcccagggctgtccggtgctgcacaccgtcgagctcgcgaatgcggccaagcagtggtggccgaatcaggtcaacctcaaggttctcgatggacctgctccgaatcgatcgccctatggtccgagcttcgagtaccgtgcggcactcgcatcgctcgacgtggaggcgctccggcgggacctcatcgagctcatgacgacgtcccagccgtggtggccggctgactttggccactacgggccgctgttcatccgcatggcgtggcactcggccggtacctatcgcatcgccgacggacgcggtggggcgagccgcggggcgcagcgttttgccccggtggggtcctggcccgacaacgccaacctcgacaaggcgcggcggttgctctggcctatcaagcagcgctacgggcgtgcgctgtcctgggccgatctcatcgtcttcgcgggcaacgtggcgctcgaggcgatgggtcttcggacgatcggcttcgccttcgggcgtgaggacgccttcgaaccaccgctcgacacgtactgggggcccgaacggacctggctgggcgacgagcgccatgacgaggagggcgagctcgagaacccgttcggtgcggtgcagatgggtctcatctacgtcaacccggagggtccgagcggtcaccccgatcctttggctgccgcgcgcgacatccgcgagacgtttcggcgcatggcgatgaacgacgccgagaccgtggcgctcatcgtgggcgggcacaccttcggcaagttccacggtgcggcaccggcgagcttcgtcggccccgagccggacggtgctcccctcgagcagcagggcctcgggtggcgcaacacctacggcacgggtatggggaacgacacctacacgggtggcccggagggcatctggaccccgacgccgacgcagtgggacaacacgttcctcgagcagctcttcgcctacgactgggaactggagcggagcccagccggcgcgtaccagtggaccccacgcaaccccgaagcgcaaggaacggtgcccgacgcgcacgatccgacggttcgtcacgcaccgaccatgctcacgacggatctcgctcttcgcgaggatcccatctatcgcgagatcgccctgcgcttccgcgaccatcccgacgagctggccgacgcgttcgcacgtgcctggttcaagctcatccatcgagatctcggtccggtgagccgctatcagggtcctctggtcccgagcgagacgttcgtgtggcaggatccggtgccaccggtgacccatggcctcgtgggcgaggcggagatcgcagagctcaaggatctcatccgcgccagtgggctcacgactgctgagctggtacgcaccgcctgggcctccgcctcgacgtttcggacaaccgatcggcgtggtggagcgaatggtgcccggatacgcctgttgccacagcgaacctgggcggtcaacgatccggccgagctcgctcgcgtgctcgcggtcctcgaggccatcaaggttggcttcgacgagcgccatgggcctgcggtcggtgtctcgctcgccgatctgatcgtcctcggcggcgtgacggccgtggaggacgctgctcgtgcggccggcgtcgaggtgtcggtgccgttcacgcccggccggaccgatgcgaccgaagccgacaccgacgcagagagcttcgcggtcctcgagccacgggccgacggctttcgcaactgggcccgaccgggagagaaggtgccgctcgagcatctgctcgtcgagcgggcgtgccgcatggggctgaacgccccacagatggtggtgctcgtgctcggcatgcgtgcgctgggcgcgaacgctggcggctcccctcacggtgtcctgacggagcgtccaggcgtcctcagcaccgacgtcgtgcgcaacctgctcgacatgggcatcgagtggcgtccggcgaccggcgaggatcagacctacgtcggtgtcgatcgtgtctcgggtgctcccagatggacggcaagcgccgtcgacctcgtcctcggcgccaatgccgagcttcgggccatctgcgaggcctacgcgagtgacgacggtcaggcgatgttcgtgcgcgacttcgtcgaggcgtgggacgccgtcatgatggcagaccggttcgacgtgcgctgaggtcgcgtccatacgagcgcgtcggcgggaggggtgaatgcccctcccgccacgaccatcggcaccggccggacggcgaaggatccaggccgcggccaggcttgccggcgtgcgcgggctgccgagctcaggtgtcagccgtccaggccgaggacgaacgtcggcttcggtgacgtgtcggggaggcggtgctcgtcagcgagccgacgtacggcggtcccgaccgcgaggaactcggtcgcatgttcaccccagacgtggttcgcgacctcgacggagaccccgacgatcccgttggcaccagctcgggtggcctctgcctgcatcctggtcagcgcaagttcgcgtgcctggtagatggcctcggtgaaggtgaccatctcctgattccacatcgactgacggagcgagccgaacacgctctggtgggcgacgtggtacacgcaggtgccgaggacgaacgcgaccgggacgatccctgtcgcgaggagccggtagaagtcctgggcggacaggtctgacgtgaagggcccgccgtcgggagcacggtgcgcgcctgcgcccgacagagaccgcaccgcggtgccggtggcgatgaactcgagcacatcttgtccccagacgtacatctgcatcgtgaggttgacgcccacgatgccatcagcaccaagctggtcagcctcggtgcgcatccgggtcatggcgagttcacgagcctcgtacatcgcctgggtcagaacctggagttcctggctctgtccccagcgtgcgacctgcaggccgacgtggtagatcgacgagccgacgacgaacccgaggggctcgaatccagcctcctccaggaggacgtattcggagaccgacaaatcggacgtgaagacgccgtgtggatcgcgtccgagggtgtgggcgagacgctcctcagcggcgcgtggttcgtaggcacccgaggcggcaggtgctgttcccggttgcgcgtttgacgggtcggggcggaacaagggcatggtggcctcctcgaagagcgacacgctgacgctatcacctggggcgcatcggcgctgagcgcctacgctggcagtggtgacacgtgcgcagatggcgggcggtcgtggtgagcgccgcggtttcgccgacgcgcgtgctgcgcttcgtgtgaggcgcttcagtgcatggtgggtggcccagctgctctcgggcatcggatcctgggctcaggcggtggccattccgtggtacgtcctcgagcgcaccggatcggcctcggccgtcggtatcgtcacgaccctgcaattcctgccggtgctcgtgctgagcctctttggcggggcgatcgccgaccgtgtgtcacgacgtggcctcttgctcgtcacgcagctgctcttggccttctgggcagcgatgctcggcttccttgtcgcgagccatgaggccccgatttgggtcgtcgacatccttgcgctcgccatcggggcgacgaacgcgatcaacaacccgacccagcaggcattcctgccggagctcgtaccgcgtgagctgcttgctccggccatcgcgttgaacagcgtgcagttcaacgcagcacgcatgatcggaggtgcggttggcggcgcgctcatcgccgcactgggagtcgccgcggcgctgtgggtgaacgccgtcagttttctgccggtcgtggccgtcttgatcctcatcgcctcccacagcgctcgggccgttcggcgcgagcgacccgccggcagcatgctgagcgagctcggttcgggacttcggttcgtgattggggcggcgccggttcgcagcgtggtcctcgtcttcggcttcgtcggcttgttcgggttcaactggcaggtcgccgtacccctggttgctcgctttgcactgcacgagcatgcgaacgggctcgggttgctcatgggagcgctcggcgcgggagccctcgtcgcgtcgttgctggcatcagcgttgggacaggcgacgcagcggcggctcgtcgttgcggggactgctctcggactctcgctgatcggtctcggcctcgcgcgctcgatgctggttgcagggttgctgctcgtcgcgggtggcttctttggcgtgctcgcttcggtgagcgccaacacgaggctgcagatgctcgctccgccgacgctgcgtgggcgagtcatggcgatctatgtgctgctcatgggcggtacgacaccggtgggcgccttcgtgctcggcgagcttgcgagctggctggggtccgcgtgggcggtgctcgtcttcggggtcgcaaccgcggccggcgtcgtcgctgcgagcctgtggggacgacaacgttcgggatcgagcggccagcgtgctgcgacggcccccatcgactagataatcgtgccgtaggaggcccaactcgaagcgacgctgctccgggcgtgccgtcatggtcgggttggttcgaactccgatgatccttcgtgcggggctcgtaccggttcggtgattcggtctcgtccgtgctagccggccggattcacgattgccgacagtccctgcgaggtgaattggccgtaggtctgcacgatgacgcccacggcggggtcgacggctgactcgacgagcccgtcgccgaggtagatgccgacgtgtccagggtcggccagggttccgtcgctaccagggacgagcaccaggtcaccaggggcgatctcgctcggggggacttgtacaccttcgttcatctgcgacacggtgtagtggtcgagtgccactccggcctgggcccaggcctccatcgtgagcccggagcagtcgaacacattgggtccggcaccgccccagacgtaggcgtctcccagcttcgagagggcgtagttcagcaccacctgctcttggggggtggtgcccgaagggatcgtatagccggccggaagcccatactcaccggcgggcaggttgccaccaagcccccctgtggctggaggcgcggccgcctgctgtgccgcctgctgtgccgcctgttgggcggctgcttgctgtgccgcctgctcagctgctgcttgctgggccgcctgctcagctgctgcttgctgtgccgcctgttgggcggctgcttgctcggcggcggcgcgcgcggctgcagcttgctgtgccgcctgcgcagctgctgcttgctgggccgcagcctgttgggcttcttgctgggcgacgagcgtttgaatctgggagttcacgcccgcgagctcgttggctgctgcttgctcagcgttcttggcggtggtctgctgggaggcgagctgggccaccagcgtgcgttgccgttgttgctgggcagcgagcgttgcctgctcttgctggagttgctgcttggcagcgacgtaggcgctgagtgcctgctcctggatggacgaagcgacgttgacatccgtctggacgagtgctgactgattcgggttcgccgagaggaccgacacgacggtcgagccagtgcctccgcgtgagaagatcgtgatcgcctcgtcgacgacctccgcatgcagctggtgcagccgcgtgagttggtgggcaatggcctggcggaccgtgctctcctcgcgcaccgtggctgcaaggcccgcttgcgcagccgtcatctgggacgtggcttggttgtactcgctctcgagtgcattgagcttctgagcgatggccgcggcttgggcgcgcatcgacgacaccgagtcgacgagacgtggaggtgggctgtcgacgtaggagaggccgatcaggccgacgagcgcaagtgttgcgacgaggtggcctggtcgggggcgacaggcgcgccagcgcgtcactgcgctcgtgcgggcggcctcgcgctgtcttgctccccaaggagcgtggagaccacctgatcgctgccgatgcgcgtccgtggcgccaacctcctcgtgacccgtcgcgtgttcttggtccttggatcggcacgcagcctatcactcctgaagggtgtcggagggtcgcgctagatctcgcctcggcggacgggctccgcggcgcccgccgtccgatgccagatggcgacttgctctcggcgcgtggagcctcgcgacatcgctcggagcgttgggtccggggatgtccaaccatacgaggagccacccatgcctgctgcgctcgatcgatcccgtctgctcgaggagctcaccgatggcgttctcgcgctcacgcagtcggagccctggcggcgctacctcgacgtgcagcgccgcttccatcgctacagtccacagaacgtcctgctcatcgaccgtcagcggccatcggcgacgctggtcgctggctttcgtcagtggcagcgccttggccggagcgttcgtcgtggtgagcacggaatctggatcgtcgccccgatgcgagtgcgacggacgacctcggacgatctcgacgaggaggtgctggctggctttcggtgggtctgcgtcttcgacgtggcgcagaccgaaggcgctgcgcttcccgaggtagcgacccgcctcgtcggagaggatccggctggggtcctcgccaagctcggcggcgtcgctcacgcactcggctttgccgtcgaggatcaccgcttcgagggggcgaccaacggcgactgttcgcacgagcagcgacgcatccgcctctccagcgaggtctcgccgcgccagcgcgtcaagacgctggcccacgagctcgcgcacgcgctcatgcacgagcgactcgagtcgcgtccgcaggcggagctcgaagccgagtcggtggcctacatcgtgtgtcgtgcgctcgggatcgacgcctcgaacttttcgttcgggtacgtcgcgagctgggctggaggaggcgcggcggctgtgcgtggcatcaaggcctcgtgtgtacgcatccagcgagcgtccgcgcagatcctcgagctcgctggcttcggcgtcccctcgggagcgggctcctagtcggtgcgtgagaactgccagatggctacgccgagcagactcaccgcagcgagtgcgacgagacccacctcgagcagggtcgggaggcgatagctaccccaggtgatcccagccccgaggatgcgagcgaggggtgccggtaccgacacgtactcgaagaccgcacggcgaagcggatcgaccgcgtacgacagcggatcgaaccgcgtgagcaccttcagccacgtcggcaagtcgcccgtggggaacaccgcccccgacaggaagaacatgggcagcacgatgaactgcgtcaccatctggaagctctccacctgagcgatccggctggcgacgaggacgccgaaggacgtcagcgcgaacgccgtcaggcccatctcaccaagcatcgtcaggaggaggagtggacgatagggcaccccgaccgcgccagcgagcaccaacatgatcgcgccctggatcgtcgcaacggtggccccgccgagtgccttgcccagcacgagcgaccatcgactgaccggtgcgaccagcatctcacgcaggaagccaaactcgcggtcccagacgatcgagatcgccgagaagatggaggtgaacaggatcgtcatcgcgatgacgccggggaacatgaacgtacggaagttgaagtgcgcggagctgacgacgatgccggagagtccggttccgagcacgaagaggaagagcaccggctgcacgagtgaggtgatgatgcgcaagcgattgcgcgcgaagcgaatcagttcacgcttccacacgatgcgcaccgctcgaagtgggcttccccccatttgcttgacagtctgaatttaggccacggccacctcccggcaggcccaggagagctcgtactcgacgggcggtaggtacccgaggcttgagtgcaggcggaccgtgttgtaacggtgaatccagctagcgatggcagagcgagcccctgagaggttcgcgaagcggtagcgagccaccagctcgcgcttcaagctcccgaagaaggactcggccacggcgttgtcgtagcaggtcgcgaccctccccaccgactggcgaatgccaagggtcgcgagcaggctccgtaccttccgggagaggtactggctgccgcgatcgctgtgaaagatcgccccagccaggctgccccgagtcccgagtgcttcgcggatcgcctcgaccaccaggtcatcgggcatgtgacgcccaagtgaccagcccacgatgcgcctcgagccaagatctgccaccgtggcgagatagcagaacccctcatcggtgcggacgtaggtgatgtcgctcacatacctgcgcttcggctcaccaggagcgaagtcctgacggacgaggtccgggagcgctgcgtcctctccccgcctcgtcgtgactacgaagcgccggcgtgggcccgctgccatctcgagctcgcgcatcaggcgttccacccgcttgtggttcacgcagaacccgcgccgtcgcagctcgtgggtgatgcgggggctgccgtaggtgccgtcgctctcgtgccagatggcgcgaagctcgctcgcgagcaccaggtgctcgggatcctcgcctcggtcccgacggtgtcgccaggcgtagtaggcctggcgagagaccccgatgactcgtgctgctgccgctacagagaagcccttggcctcctggcgggagatccagtggtagcggctcactgtcccccctccttcacccagaaggccatcgctcgcttgagcagctcgcgttccacggtgagctgcttgacctggcggcgcagccgtgtcagctcctcgcgctcggcgctcgtcaggccctctcgctcacctcggtcgatgcgttcctgacggacccagttaccaagggtctgctcgttgatgccaagctcacgggcgacgtcagcgatggtgcggcgctggtcgagaaccaacgctgccgcgtccttgcggaactggctcgggtagcggccgcgtcgtcgtccagcggggccgtcgcccggtggtgggttcggtgtctggctcatcccttcctcctatagcaggtgtcaacctggaggggggaaggccaaaggtcgtccgacacacgaccttctgcctgggcgtagccctcccgataggcgttgtcgaacacggctgcttcggtggtcatgatcgcatcctcgctcgcatgaagggattggcacggaggccctcgagactcgagcgttcggcgtcgcggatcgtgcgacccgtgtaggtcatgaagacgtcgtccagggtaggtcgtgcaacccggaccgacgtgatggcaacctgcagttcggcgaagagtctcggaacgaactcctccccgttggcgacctggaggaggattccgtcgtcgctgtggcgggcctcgatgccgaagtgctcgccgatggcttcgatcgcgcgctcgtcgtcggcggtgcgcaactcgatgcggtcggtgcccacgctcgccttcagggcctcgggtgtgccaccggccacgatctccccgtggtccatgatggcgatgcgatcgcagaactcggcctcgtccatgtagtgcgtcgtcatgaaaatggtgatctgctcgcgctgctggagctctcggatgtaggaccagatgcctgcgcgcgtctgcgggtcgaggccgaccgtgggttcgtcgaggaagagcacccgtggagcgtggagcagaccgcgtgcgatctcgagcctgcgcttcatgccgccggagaacgtcttgacgctgctgcgtcagcgatcgccgagccccaccatgtccaggacgaagtcgatgcgctcggccacccgctcgcggtccacgccgtagagctcggcgtgaaaccgcaagttctcctctgcggtgaggtagtcgtcgagtgtgctgtcttggaagacgaggccgatattgcgccgtactcgtgcgcgctcgcgcgcgacgtcatggccaccgaccgtcgcactgcccgccgtcggggtcaggagcgtgcagagcatcgagatggtcgtggacttgccggcgccattggggccgaggaagccgaagatctcgcctgcacccacgcggaagctcacgcctcgaaccgcttcgacctcaccgaagcgcttggcgaggcctcgcacctccagtgcatacggcggtggcggctccgcatcgacgaggctcggtgtcgtggtcgtggccggctccgtactcatcgatcacctccatgcgccgaaagcttggcgcatgcaaccaccctaagggctccgggtggacgccgctacgcgtggagaacgcgcgcctagcgcaggcgcattcccgagatcgctcgagcgatgatcaggcgctggatctcgcttgttccctcgaagatggtgtagatcttggcgtcgcgatgccagcgctcgaccgggttctctcgtacgtacccgtagcccccaaggatttggatggcctcctcggtgacgcgaacggcgacctcgccggcgtggagtttggccatggagccctcggcgtgctcgaaccgctgtccctgggccgccatccaggctgcgcggtgcacgagaagacgcgcggtgtcgacggcgagcgccatgtcggccagcttgaaggcgatgccctggttctcgatgatcggtcggccgaactggacgcgttccttggcgtagtcgagagcccattcgtaagcggcacgagcgataccgaccgcttgtgcgccgacgagcgggcgggaggcctcgaaggtcgccatcgcggcttgggattgggcgcgcttgccctctcgggcacgggccagccgctcgtcgagccgttccttgccgccgagcagcgccgacccgggcagtcgcacgtcctcgaggatgacctcggccgtgtgcgaggcgcggatacccatcttcttgaacttctgccccatgcgcaggccaggggtgttgggagcgatgacgaagctggcctggccacgggcgcccagttccggctcgacgctcgccacgacgacatggatgtcggcgatcccgccgttggtgatccaggtcttcgtgccgttcagggtccacgtatcggtggccgggtcgtagaccgcgcgagtgcgcagcgaggagacgtcgctgcctgcgtcgggctcgctcacgcagaacgcggcgaggttggggtggtcggcagtcccgaagcactgcggcacccactcggcgatctgctcgggggtgccgttggccacgatgcccgagacggcgagcgtcgagccgaagatcgcgagcgtgatacccgcgtcgccccagcagagctcctcgagcacgagcggcatcgtgagaccggtcttgtcggcgaacgcgttcagcatgaagtcgtaggagtacaggccgatgcgggccgcttcctcgatgatgggccgtggcgtctcttcacgttcatcccattcgtgagcggcgggacgaatggtctcagcggcaaaggtgtgagcccactcgcgcagctgttgctgttcgtcggtgagtgcgagggaaaagggttccacggggacctcctttcgcgcgaagcgcgaacgttaccgagtggtaaccatagcgctggcttcgaggccgcgcaaggcatcaagccggcaggatctcgggcccgttaggggtgtcacgtacctggtaaccgagggcggcgatctcggcgcggagcgcatcggcgcgcgcgaagtcgcgatcgcgcttggcgtggtcgcgttcggcgaccagcgcagtgacctccgatggaatcgaggcacgcgggggcacggggagcccgagcgtctccagcatcgcagcgagcgctgcgcgtcggcggttagcgagagcgctctcgcccgcgagcgccgccgagcgcgcagcacgggcggcttcggccatgacggcgagtgcggcgggcgtgtcgaggtcgtcggcgagggcagcgtcgaactcctcgagatccgctggttcggccgcacgggcgtcgcctgcgccggcttggctgtcgaggcgggcgagctgcgcggccgcttgctcaagtgtggtggtggtcagctctactgggctgcggtagtgggcgcgaagatacgccagtcggaccacccgtccgccggcgctcgcgatcgcatcgtggaggccgaaggtgttgcccagcgacttcgacatcttctcgccttcgagctccacgaaggcgttgtggacccagtgctgtgcgaaccccatgtcgaggagggaggcctgggcgcgctcgttctcgtggtgcgggaatacaaggtccatgccaccgccgtggaggtcgaacgtcgatccgaggagttcggtcgacatcgcgacgcactcggtgtgccagccggggcggccgtagccgaggctggtcgcgaagccgtaggcgtcgctctccacggtcttccagagcgcgaagtccagcggggagcgcttcgcgtcgtcgacctcgacgcgcgccccagcgcgtagctcctcgagggcttggtgcttcaggaggccatagtcggggacgtgatcgacgctcagatagacgccgttcttcgtcatgtaggcgtggccgcggtcgacgaggcgctcgatgagggcgaccatggcatcgagccattcgctcgcgtgcggtgcgaccgtcggtcgacggacgccgagcgcatcgatcgcgtcccaccagcgggactcgtagcgctcggcgatcgctggcggggtcaccccttcacgagctgcacgatcgacgatcttgtcgtcgatgtcggtgatgttcgagacgaagcgtaccggagccacgagccgctcgagggtccgccggagggtgtcgaacacgacggcgagccgtccgtggccgaggtgcgggtcgtcgtagacggtggggccgcagacgtagacggtgacctgctcaggggtcccaggggtaagctgaatgagctcgcggcgggcagtgtcgtagagcctgagcatccaccgaagtctaggcggggtcccctcgccccttcggaggcgataccgtcggttgcgacccgggacctgcgtccacgaggcacccatggctgatcgggtgacccgtgcggacgagggggtgaggccggggcgaagtccagatgaggaggcgtggtgcggatcccggacaaggtcgagctcgaggggctcgagcgcaagtggggcgcgttctgggaggagcacgggctatatcgcttcgacgacacagctcccgccgcgcaggtctacgccatcgacacaccgcctccgaccgtctccgggacgctgcacatcggtcatgtgttctcctacacccatgccgacatcatcgcccgctaccagcggatgcagggcaaggaggtgttctacccgatcggatgggacgacaacggcgtcccgaccgagcggcgagtgcagaactactatggcgtgcggtgcgacccgtcgttgccctatcgcgggaccgacgaagagctgcctcgggaaggggcacggcaggtcccggtgtcgaggcgacgcttcatcgagttgtgcaccgagctcacggcgaaggacgagcaggcgttcgagcagctgtggcgtgcgatcgggttgtcggtggactggtcgctcgtctacaccacggtcggtgagcgtgcccgtcgcgtgtcacaggcggacttcctcgatctcctcgagcgggaccaggcctacctcgccgaggccccgacgctgtgggacgtcgatttccagaccacggtctcccaagccgagctggaggatcgcaccgtcgagggtcgctaccaccgcatcgtcttcgaccttgagggtggtggcgaactcgagatcatgagttcacggcccgagctgatccccgcctgcgtcgcgatcgtcgtgcatcccgaagacgatcgttaccgcgaggtggtcgggcgccgcgccatcaccccgctgtttcgcgtgccagtaccggtgatcgcgcacccgctcgccgagccggagcgcgggaccggtgcggccatggtctgtacgttcggggacctcaccgacgtcgtgtggtggcgcgaggcatccctgccgacccgggtcgtgatcgaccgggccggccgactggtgccacgcgtggacttcgccgccttcggttccctcgatcccgatggcgcggctgacgcctacggacgcctcgcgggcttgcgtgcgagcgacgcacgtgccgaggtcgcggaggcgctcgcggccgcgggggtgcttcgtgggatcgagcaggtccgtcacgccgtgaagtactacgagaagggggagcatccgctcgaggtccttgcaacccgtcaatggttcatccgcgtcctcccgctgcgcgatcgtctgctcgagcgcgcggccgagctcgactggttgccaccacacatgcaggttcgcctcgaggactggatccgcggactcaaccaggattggaacgtctcgaggcagcgcttcttcggcatcccgattcctctgtggtatccggtgcgcgaggacggctcggtggactacgaccatcccctgcggcctgcgaaggaggacctgccggtcgatccgcagagcgaggctccccgcggctacgccgacgagcagcgaggtgtaccgggtggcttcgtcggcgaccccgacgtgctcgacacctgggccacgtcgtcgttgaccccacagctcgcggggggctggggtgagcgtccagacctctttgccaaggtcttcccgatggaactgcggccccagggccaagagatcatccgaacgtggctgttctacacggtcgtgcgagcggagctggccttcggtcggctcccgtggcggcgggcgttgatctcgggctgggtgctcgaccccgatcgcaagaagatgtcgaagtccaagggcaacgtcgtcacacccatgccgctcgtcgagcgcttcggcgcggacgccgtgcgccactgggcggcgaacggtcggcccgggaccgataccgcggccgacgaggcgcagatgcgcgtcggtcgtcgtctcgccatcaaggtcgccaacgccagtcgcttcgcgctcagccgtgtggcgagccgctccagccacaagcccgcgtgggtgccgatcgacgcagcggaactcgaggccctcgacgccacgatcgcacgggccaccgagttgctcgaggcgcacgactacacgagcgcgctcgcggccatcgaggagcacttctgggccttctgcgatgattacctggaactcgtgaaggtgcgcgcctacggcgacgactcgccggagcacgcctccgcgctggctgcgctcgagatcggcgtcgagctgttcatccgggcgttcgcaccgtacctccccttcgtcaccgaagaggtgtggtcctggttccgcgagggatcggtgcaccgaagtgcctggccgcagccgggcgaggccatgcgccgctacgtcgagctcgtcggtgaaggccatggcgtcgtcgacccggccgttcgggcggcggtgtcgtggtcgctcgcccaggtgcggcgggcgaagacgtcggagcagcgctcgctgcgtacgccggtcgaacgcctcgtcgtgtgggcgccccgggcgtggctggaggcactcgccgctgccgaggatgacctcagggcggccggcggcgtgctcgcgctcgagcgccacgaggccgacgagccccgtgccgtggtcgagctcgctccgccagagcagcactgaatgaggtctgcgacctgaggaccccgtggctcgggtcgcagacggtcgcgcggtccgtaggcttgacggtgtggacagcctcaccccagaggagcttcccggcgaactcgcggtgacacccgaggtcgcgggggggttcgtccgacgccgatggctgttgatggggctgctcgcggtgtgggggcccgggctcgtcgtgatgttggccgacaccgacgtcggcagtctcgtgaccgcagcgcagtcgggtgcgcagttcggctaccgcatggtgctcccgcaggtggtgctgatccccatcctctacatggtgcaagagatcacggttcgcctcgggatcgtgacgggcaagggccacggcgcgctcattcgcgagcgcttcggcccgtggtgggccggcgtctcggcactcaccttgttcgccacggcggtcggggcgttgctgaccgagttcgccggcgtggcaggagtcggtgagctcttcggcgtctcgccggacgtcacggtgccgctcgcaaccgggttcctcgtcgccgtcgccctcacgggcagctaccggcgagccgagcgcgtcggcatcctgctcggtctcgtcgagctcgcgttcgtgccggcgatgatccttgcgcaccccgatgtcggtgcgctcgcgcgcggcgctctcagcctgccactcgccgaccatggcttcgtgatcctgctcgctgcgaacgtgggggccgtgatcatgccgtggatgatcttctaccagcagggcgcggtcatcgacaaaggccttggcggcgccaacttgcgtgcggagcggcgtgacaccgtggtgggagccgtgctgacgcaggcgatcatgctcgtggtcgtgatcgcgttcgcggcaacgatcggcacccatcatcctggggtcgcgctcaacacggtgggccagttgagccgagccttggctccgttcctcggtccggtggcggccaaggtcctcctcgggctcaccatgctcggcgcgggtctggtcgccgcgctcgttgcgtccctcgccggggcgtggggcgtctccgaggtcttcggttggcgccacagtctcaacgatcgaccgtctcgggcgtcggcgcgcttctacgtgacctacaccttggcccacgtgctgggtgcggccatcgtgctcctcagcttcgatctcgtctcgctggtgatcgacgtcgaggtcatgaacgcgctgctgctgcccatcgtcctcggtttcctcctcgcgctggaggccaaggcgctcccggaggcctaccgcatgcgcggggcgtatcgagcggtcgtgacggcgacctcactgctcgtgatcggtttcggcttgctcatggtgccgacgaccctggggtggtggtaaccggcgtcggctgcgctacgacgcggcccagtggtcgggccagccatctggctgaggaatgatcgcgcctttgcgacgaagctcggctcggaagatctctcgcagcacggagagtgcgtcgaggatctccgggtagcgcaaccggtaccacacgttcgacccctcgcgctgggcctcgatgatgccacggtcacgaaggacggcaaggtgctgggacacgttggcttggggcgcgccgatcagactcacgagctcgctcaccgtatgcggagcctcgcccaagatcaacaagatcaggatgcgcttggggtcgttgagcgccttgcacatcatcgggacgaactcctcgagttcggtgatgctcaccccggtcgtggcagcctcggtctcccccatggccccgagcctagctgtcggttcggcgagcggtgtgtgcagctccgagtcggttggtcaggaactcgtcgaggagcacggtgccgagctctccgtcgccggggtagtaggccttgccgtggttgatggcgaccacctgctcgacgaagcgtcgtagcccgcgatcgcgagcgaggacgaagacgctgatctcgatgcgctcgcgggtggcacggactacctcggcgagggtgcgacggagggtctctggggtcgggggataggcaaagtgcaccgagccctcgtcgtcggcgtgggcggtgggttcgccgtcggtgacgaggagaacttggcggcgtccgcgaactcggcgcaggcgctggcgggccagggccagggcgtgctgaatgttggtcccgtagacgtagtcccactgcgcctcaggcagcgcggtgatcgggacctctcgcgcggtctccgagaagaccaccaccgagaagtcgtcggcagggaaccgtgcccgcaccagggaggcgagcgcgagggcgacgcgcttggccggcaagaaggtgtcgttgagcggcatcgagagcgacaggtccagcgcaaggacggtgccttggcgcgcctggtcgtcgacctgttcgatcatgaagtcgtcgggatcgagccggagcggtatccccggcccgttccgagcgagcgaacctcgaagggtgtcagcgagggcgaggcggaacggatcgccaaagcgccactcgcgcacttcgccgttgggctcggtgccgaccccagtgcgtcgcacggcgtgctgcccgaggggcccgagcacgccttgacgcgcgaggtcacgaaggagcaggtcaccgaggcgccacacggcgcgcggtgagagctcgacgcgacccccggtgcgattcatgaggccggctgcctcgagcgcttcggtcgtgcgcgagaggcgctccagcgctgcctgggcgtccgcgccgaggaggtcgcgcacctcgtcgagctcgatcgcaccgaggcgatcgggggtcgtggcttgacggagtgcggcttcgagcgtgtcgaggcgcccgagttcgcgcatcaccgggccgagctcgccgagaccgagcggttcggagcccctgaaccccatcgcgtcggcgtcgaaccccgcgatggtgccgagtgcctccccgaggcgccgcatggcttcggcgatcgcgggggatccagcgagtgcgtcctggaggcgctcgagggcacgtcgcgtgtcgtcgtccacggatgccaggaggcgttcgaggtccatgcgactcgccgcgaggcgggcgaggaagtcttcgaacgattcccccggggcgatgatccctgggtagcgttcctggaacgcctcaaggtcgtcgctgatgtcctcgccacgcgcaaagcgctcgatcagcgacgcgaggtcgctgagcatcgccgcgtacgcatcggcgtcgcccgcctcgatcgccgacgccagctgctcgaacgactgcgccagcagcgaggagcgaaggctcgcgagcaggtcgtcgaagcgctcgtgggctgcctcgtcgaagaagtcgtagtgctcgagcgccgtgaggcgttcggcgatgtcgtaggggagcgcatcgagctccatctgtgcgaggaggtgctcgggcgcttgggtgcgctcgtgtgcagcttcgcggctggctcgctccttcgacacgatggcgtcgagttcctcgcgcacgcgactgagcgtcgcgttggggtcgtagcgcgcgagcagctggtcgcgacgttcgcgtagccgtgtgaggagctcggcaagcccaggcatgtcgtccaagcctcgctgcagcaggtcggcgagtgcgctcgcaaggttgccgtggtaggccaggtcgtcgctgagggcggcgaggacgtcgtcggcctccgggccgaggggctcgggatcgacgcctccatagcgcacggtcgacatggctcagctcccgtagctcactcggttgccaaggacgcgcttgccgagtctgcgtgtcgccacgagtccctcgagacacagttcggcgagtaccaggcgctccgacggcggggcgtggtcgcccatggcagccagcgccggtcgatcggcgaggatctgctcccatgtggccgtggggccatcgagatcgacggcgagcgggcgatcgttggtctcggcgatgacgtccgacgggtcgagatggccgagccgctcggtgaagactcgagcggtcgcttgagcgagcaaggtggccacgatctcgcgctccgaggtgtcgtgggcatcgacctcgatcttgcccgcgaaggccgcgatggtcgcctcggtatcgccaaggcgtgcgcgaggcgggtgctcgccgaggcgaacggcccgaacgagtgccgcggcagcgatcgcctctcgggctgcgatcgaccctcgaacggagacgcctgagtagcgagagaccgcagggtgccgccgtgcgaggtgggccgtgtgggcgacgagttcgtcgaggacctccggtatctcgacggttgggtcgcacagctgagcctcttgtcgcatgatggcgacttcttctgcgatcgtcgacgggtagtgcgttcgtagctgcgtgccgaagcggtccttcagcggtgtgatgaggcgcccacgcgcggtgtagtcctccgggttggccgacgcgaggaacacgatgtccaaggggagccgaatggtgaagccgcggacctggacgtcacgctcctcaagcgcgttcagcagaccgacctggattcgttcgggcaggtcggggagttcgttgatggcgaagaggccgcggttcgcccgtggaacgaggccgaacgtgagtgcttcggggtcctcgagcgtgcgacccgccgcaaccttgatcgggtcgacctctccgatcagatcagcgatggtcgtgtcgggagtcgcgagtttctcgctgtagcgctcgtcgcgggcgatccagcggatgggcgtcgcatcgccttgggcggcgagtcgggccttggtcgaggcgaggacgggcgcgagcgggtcctcgttgagcgccgagccctcgacggcggggacgaaggggtccagcagcgcgacgagggaacgcaggatccgcgtcttgccctggccgcgctcgccaaggagaatcacgtcatgcccgctcaccaaggcgcgcgtcagttctgggagcacggtgtcgtcgtagccgaccatgccctcgacgacggggcggcctgcgcggatgcgctcgaggacgttggcgcgaatctcttcgcgaaccgggcgcgggtgccaaccgatgcgcgcgaggtcgccgagcgtggttgggtggtcgcctgaagcctgggtcacatcgtcgagcctaggtcgaatgtccgtcgtcgattcgtgacgacgccggcgagcgagtaagactatgggggtgaacgttcaccatcacagctacgacgtcgtcatcgtgggcgcaggcggagccggcctgcgcgcggcgatcgagacggccgggaccgtgcgcaccgcggtgatcacgaagctctatccgaccaggtcgcacaccggggcggcccaaggtggcatgtgcgcggcgcttgccaacgtcgaggaggactcgtgggagtggcacgccttcgacacggtgaaggggtctgactacctcggtgaccaagatgccatcgagatcatgtgccgagaggcgatcgacgcggtcatcgatctcgagcacttcgggctgccgttctcgcgcaccccggacggcaagatcgaccagcgccgctttggtggccatacgcgcaaccatggcgaggctccggtacgtcgcgcgtgctacgcggccgatcgcaccggtcacatgatcttgcagacgctgttccaacagtgcgtcgctcgtggtgtccaattcttcaacgagttccaggtgttcgacgtcctcttcgaaggcgaagggaacgatcggcgtgctgcgggcgtcgtggcctacgagctcgcgacgggagatctccacgtcttcgccgcgaaggcggtgatgttcgcgaccgggggattcggccgtgtctttcagatctcctcgaacgcacacacgctcactggagatggtcccgcagtgctcctgcggcgcggggtgccgctcgaggacatggagttctaccagttccacccaaccggcatctacgggatcggcatcttgctcaccgagggtgcccgtggcgagggtggcatcttgcgcaacggactcggcgagcgcttcatggagcgcgtcgcgccgacggtgaaggacctcgccccgcgcgacatggtcgcgcgagcgattcacgccgagatccgtgagggtcgcggggccgggcctgacaaggactatgtctatctcgacctcacgcatctaccgccggagcagatcgacgcgaagctccccgacatctcggggttcgtgcggacctatctcggcctcgagcccaagcgggatccgatccccattcagccgacggcacactacgccatgggcggtatcccgaccaacgtgcatgccgaggtcgtcgtcgacccggcggggacggtgctgccagggctctacgcggccggggagtgtgcctgcgtgtccgtccacggggccaaccggttggggaccaattccctgctcgacatcaacgtcttcgggcgtcgcggtgggcgagcgatggtcgagtacgtcgctggcgtcgatcaccccgacatcgcccgaggcgccgaggagcccgttcgtgagcacattgagcatcttcggagccacaaggggtccgagcgtgtcggcgcgttgcggacgacgctgcaggctgccatgatgcgcgatgcgtcggtcgtgcgcactggggagtcgctcgccgaggcccatcgtgtgatccgcgagctgaaggagcgctaccacgacgtcgccatcgacgacaagggatcggtcttcaacttcgatctcacggaggcgctcgaactcgggaacctgctcgacctcgccgaggtgctcgtgatcggtgcggaggctcgcaccgagagccgtggcgcccactggcgtgacgactaccccactcgtgacgacgtgaactggatgaagcacacgcttgcctaccgcgagccggacggatcgatccggctcgactacaagccagtggtgttgggcaagtacgaacctatggagcgcaagtactgatgacgacgactcagtcaccggcgtcgaccgacgccaccatgcaggaggtggacgttcacctcgtgatccgtcgcttcgatccggaggccgactcgcgcccgcggtgggagagctacacggtgcgacagaagccgacggacaccgttctcgcggcgctccacaccgtgaagtggacgctcgacggatcattgagctttcgtcgctcgtgtgcgcacggggtctgcgggtcggacgccatgctgatcaacggcgagaaccgcttgagctgtgtcaccctcatcaaggatgtcgggaccgagctgcgcatcgagccggtgcggggtctgcccgtcgtcaaggatctcgtcgtcgacatggagccgttcttcgcccagtatcgccaggtcatgccgtggctcgtcaacgacgacgaccctggctttcgagagcgtcgacaatcgcccgaggagcgtgcacgtttcgacgacaccacgaagtgcatcttgtgcggtgcctgctcgacgagttgcccggtgtactgggctgggggcgattacctggggcctgccgcgatcgttgccgcgcaccgcttcatcttcgactcccgcgaccgtgcggccgccgagcggctggacatcttgaaccagcgaggcggcgtttggcgctgccgaacctcgttcaactgtacgcaggcctgtccgcgaggcatcgccgtcacggaggccatcgaagaggtgaagcgtgccatcgtctccgaccgggcgtgacgttctgacgctcgtcgttcgcgagcgtgacggggtgcgacgccagggccttcgcctcgtcgacggggtgctcgagcctgctgcgatcaccgaggaggatgcccaggtcgtcgtcgaggtcgacgactggggtgctgagctcggagcggccctgcgtgcgggtggtgtgcgcatcgtgcgaggtgcgaccgacctcgcccggaacgctaaggtgctgaggggcgcgacgggggtccgctcgagggggtgagccgtgcttcgcagtcgtcgcccgactcgtccgccacagcgaccgggctggtatccagacggctcgggatggttgcgctacttcgacggccacggatggaccgagctcgttcgtgagcggctcgtcctcgctgagttccgaccgcagccgccggtcgcggagcgcccgccgcatcccgcgtcgacgagccgccccaggcagggcgtgcgcatcgccagcatcgtcctcgcgtgcgtgctgctcggaggtgttgtgcttcagctcgtggcgttgacgctgtcgccgcggtcgcagggctcatccgttatctccgaccgcgaagtgctggtgctcgcgagacatgcatgtgaagacagtcccgtcggccaggctgcgatcgtggcgagctccaaggcggctcgatcggcggcggcgtcgcgcgcggcccgcttgacgcagcttgcttccgaggcacacctcgaagccctcgacgacctcgcggccgcgtggtcgaacgtcgcggtcgcgttggtgcaggcggccccgcgatcggcctcgctgcgtgcggccatcgacgcggtgaacaccgcggcgagcggtgcgcacgtggcgtcctgtcgagcgtgagcgtgcgccggtttactcgccctggcgagcgccgtgtgctatcctccaggcatcctgcccaaggaggagtcatgagcgaaccgttcatcgacgatcatctgttggtgcgctatcgcgagctgctcgatgccgaggatcaggcgttctcggagatggagcacgacttcgaggagggcgatgcgcaacgcttcgcactcgaccgcgaggcctggcttgcggcgatccgccaccgcgtgagttttctcgacgcgtgtgggttggtacgcctcgatgtcgtcgtgagctaggtcgcccccggcgccgacccttgacgctggtgatcgttcaggtcgcggcgctacactaagcccagcactgccgggggagtagtgctcggcgcacacggggggaacgatgggcgcgagtcacacagctgtcggggcgtcggaccagtcgtcggcaggcgacgctcggcgtggtccgctgcgagcgtgggacggtcaaggaacggcgccatgtctcagaacgctccgcttcgacgcggacgatgctggactgaggagccgggcgctgtcgggcgaatggcagcgtgaagcgagatgtcgaggcgtcgatccacggacgttcttccccgagcgtggcggatcggcgacgtcggcccggcgcatctgcgctggatgcggcgtgcgcctcgagtgcttggagttcgcactcgtgaccgacgagcgctttggcatctggggtggcctgagcgaacttgaacgacggagtctgcgcgcccggcgcttcgtcgtgtgagcgagacgctgtgtgagcgagacgctgtgtgagccgaagcatcggcgagcgtggctcaggccacgggacggctcgactggagcgcgaaggacgcccttgctaggcttgcccgcgtgcttcgtccctacagagtggttgtcgccaagcccggactcgacggccacgaccgtggagcgaaggtcgtcgctcgagcgctgcgcgacgctggcttcgaggtcatctacaccggtctgcaccaaacggtcgagcagatcgtcgagaccgtgctccaagaggatgcggacgcgctcggcgtgtcgctgctgtccggcgcgcacctgaccctcgtcccacggctcgtcgacgcgctcgctgcgcagggccttggacacgtgctgatcgtcgtcggcggcatcattcccgagcacgatatcgatgccctgctcgggctcggcgtgggccgtgtgttcacgccagggtcgtcgctgaccgagatcacgtcgtggctcgaggcgcaactcgatgagcgggagcgcactggagccgggcagggaggataggcgtggatctgaaggagtaccaaggcaaggacctgttccgccgtttcggggtgccgacctcggagggacgggtctgcgtcacggtcgaggaggcggttgccgcggccgagacgctggggtatccggtcgtcgtgaaggcccaggtgttggtcggcgggcgcggcaaggctggtggcgtccgtgtggccgccaccgaggaggcgctccgcgaggcagcgggtgccatcttgggcatggacctgaagggccatcgggtgaaggaggtctggatcgagccggcttccgacattcgccgcgagtactacgccagcttcacgctcgatcggacggcgcgtcagtacctgctcatgctctcggcgatgggtggcgtggacatcgaggaggtggctcggacgcaccctgaggcgattgcgcgggtgcacatcgatcccatcgacggtctgaccccggccctcgccgaacaggccgttgcgaccgcagggatcgacgagggtcgcgaggagctgccggcgatgttgggtgcgctctatcgcgccttcgtcgaaggcgatgccgacctcgtcgaggtgaacccgttgatcgtccgatccgacggcaagctctgggcgctcgatgccaaggtgacgctcgacgacagtgccgcgttccgccatcccgagtgggaggcgtatcgggccgacgaggagctcgactcgcgcgaggcgatcgctcgtgctcggggcttgaactacatcggtctcgagggatccgtcggcatcatcgccaatggcgccggactcgccatgtccaccttggacgtggtccagcaggtcggtgggcgagcggcgaacttcctcgatctgggaggaggcgccggcgccgacacgatgacggcggcgctcgaggtgatcgcgacggatccgcaggtccgggcgctcctcgtgaacatcttcggcggcatcacccgctgcgacgaggttgctcgaggcatcgtcgccgcgctcgagcgcgtgcgccttccgttccccatggtcgtccggctcgacggcacgaacgccgccgagggcagggccattctctcgtcggttgtgtcggacagcatcatcgtcgagccgacgatgatcaaggcggccgagcgcgccgtcgcggaagcttcgaaggcggtcgcatgagcatctttgtcgacgagcacacgcgggtcatcgtccagggcctgaccggccgccagggcatgttccacggactgcgcaaccgggcctacggcacgcaggtcgtcgctggggtgacgcccggcaagggaggcacggacgtcgaagggatccctgtcttcgatacggtgaaggaggcggcagccgcgaccaacgcgaacgcgtcgttcatcgtcgtgccgccgcgcttcgctcccgaggccatcctcgaggcagctgcggccgggatcccgctcatcgtgtgcatcacggagttcatccccgccaaggatgaggccatggtggctgcggtgttgcgacgtgactaccccggcacgcgtctgatcggaccgaactgcccgggcatcatctcgccggggcgctgcaacatcgggatcaccgcgggggagattgcgcgtccgggtggaccggtcggcatcgtctcacgctcggggacgctcacctaccaggcgctctatgagctcagtcagcaaggtgtcggccagacgacctgcgtcgggatcggaggcgatccggttcccggcacgaccttcatcgactgtctggcggccttcgaggcagatcccgagacacgggcggtgctcatgatcggcgagatcggtggacaggacgaggaactcgccgcagcgttcatcgcagagcacatgaccaagccggtcgttgcctatatcgcgggcgttacggcgccgccggggcggcgcatgggtcatgccggcgcgatcgtgtctggctcgtcgggaaccgcacaggccaagatcgaggccctccgagcggcgggtgccatcgtggcgcagaatcccaccgaggctggcgagcgaatggtggaggtcgtctcgcgtctcgcctagccctgcggccctaggcttggcgggcgtgcgtgtcgcggtgctggcatctggcgtagggacgatcctcgagtcgctcgtcgatcacggggtcgtgccggcgctggtggtcgcggatcggccggcgttggccctcgagcgagcacgtgacgccggcctggtctcgacgctggtggatcgtcgttcgtatggatggcgagactcgttcgaccgcgaggcgttctccgacgccgtcgccgacgtgctcgaggcggccaaggtcgagctcgtggtgctggctggattcatgaccatcctcgccggttccatgctcgcgcgctttccggctcgcgtcgtcaatacgcatccgtcgctgctcccgagctttcctggtcacgacgccgtggcccaagcgctgtcggcgggggtgcgcgtcagcggcaccacggtgcacgtggtcgtggagcaggtcgacgccggcccgatcctcgagcaagagccggttcgggttcggcggggcgactcgatcgagaccttgcacgagcgcatcaagcacgcggagcgtgagctctatccgagggtcgtgcgagcgatcgttcgggcgggggtcggcggcgatcggtggtgggaggatgctcgtgtgcaacgagcgatcgacgaggaggttcgtccgtggcgcgagcgctgatctcgctgtatgacaaggccggtctcgagcgggtcgcgcgaccgctgcacgccgccggctggcggatcgtggcttcgggtggcaccggtgaggccctccgcggcctcggtgtccccttcgagcccgtagaggaactgacgggctttgcgtccatgctcgacgggcgtgtgaagacgctccatcctgcggtgttcggcccgatcctcgccgacctcgagcgtcctcaccatgcgacgacgctcgaagaggccggctgggagccgatcgacctcgtcgtcgtcgggctctacccgttcgcgtcggatccgtcggtcgatctcatcgacatcggtggtccctcgttggtgcgcgctgcagccaagagcgccgaccgcgtgaccgtgctcgtcgaccctgccgacttcgggctcgtcgacgaggtcatcgctggcaacgtcgaccggccgttgcgccggcgactggcggccaaggcctttgcgaccacgagcgcctacgacgctgcggtcgcgacctggctgggcggtggagagggctcgttgcccgatccgctggtcctccctctcgagcgcgtcgccgtgacccgctacggcgagaacccccaccagcgtggcgccctctatgcaccgatcggcacccgccgtggcttcgccgaggcccgttggcacggcggcctcgagcccagctggctcaacatcgctgatgccgacgccgcggcgcgtctcgtcgctcggctgggaccggagcctgctgcggtcgtggtcaagcacgccggaccgtgtggtgcggccgtcgcaccgacgcttgccgaggcctacgagctcgccttcgctggggaccccgtctcggcgttcgggggcgtcgtcgcgctcgggggggtgctcgatgtggcagtcgccgaggcgctcctcgcacaccccaaggcagacgtgatcgtcgccacggcgatcgacgacgatgctgcccaggcgctgctcgcccgccgtccgaagacgcgactcgtcgagctcgcgatcgatcgcgacgagccgtggtgggtgcgcagcgtcgcgggcggggtcctcgtgcaagagcccgatcagctcgaggagccgacggatctcgaactcgtcacgagtcgcgttcccaccgacgaggagcgccgtgacgcctggatcgcgcacgtcgtgtgcgcgtcgacccagtcgaacgccgtggtgatcgcgaggcagggggctgtggtcggtgtcggccagggccagccgtcgcgggtcgatgcggcccggctcgctgtcgggcgagccggtgcgcgcgcccagggtggtgccgccgcgtccgatgcgttcttcccgttcccggacgggctcgagaccctcatcgacgcgggcgtgacgtgcgtcgttgcgccggcgggatccgtgcgtgacgacgagattcgtgcagtggccgagggtcgtggcgtgagcctgctcgtcgctccgagacgccactttcgtcactaggaggtctggtgggagccaagctgctcgatggggagcgcgtcgccgccgaggtgcgcgccgaggtgcgcgatcgggtcgagcgcctgcgtgcggcgggcgtgcgcgtggggctcggggcgatcctcgtcggggacgatccggcgagtgcgcggtacgtcgagatgaaggcgcgcgactgcgcgagcgtggagatcgcgtctcgcgtggtgcgcctcggcccggatgcctcacaggcggacgtcctcgcggcggtcgagtcgttgaacgcggacccggaggtgagcgcgttcatcgtccaactcccgctccctcggcacctcgacccagatgccgtgctctgggcgatcgacccggccaaggacgccgacggattgcatccggtgaacctgggcgagctcgcgctcggacgcccgcgcgtcgtggcgtgcaccccggcgggcatcgtggagctgctccaccgtcacgggatcgtcctcgacggtgcgcatctcgtcgtggtgggccggggcctgacgatcgggcgtccgctctcgatcctcgcgtcgctgccccgagcgggtctcaacgcagccgtcaccgtcgttcactcgcgggtgcgcgacctcgccagcatcgttcgcagtgccgacatcgtcgtggcagccgctggcagccccggcctcgtgaccggcgccatggtgcgccctggcgccgtggtggtcggtgccggcaccagcttcgaaggacggcgcctgctctcggacctcgccgacgacgttgcggacgtcgctgcgtgggtgacgccacgcatcggtggggtcggaccgatgacgagggccatgctcctcgtcaacaccgtcgaggcggccgagcggcgagccggtcggagcgagccgtgagcgacgtgctcgatcgctacggcgagcgagtctgttcggtcgagctgtggccagcgcgcacgagcgatcaggagcaccgtctcacggccacgttggacgtgcttcgttccctgccgccagcattcgtgtcggtgacctacggcgctttcggctcgagccgccacgagagcctcgcgctcatcgaacgggtgctcgccgatggccatcgggtgctggcgcacctcgcggtggccggtcacagcccagaacaactcgtcgcgctcctcacgcacgtcgagcgtctcggcgctgacggcgtgctcgccctgcggggcgacccgccgctcgacgaccccgacgatcgtgcgcgcttcgtcggtcgtcacgcactcgagctggtcgaactcgctcggcagcacacccagctcagcgtcggcgtcgcgctgcacccctcgggccaccccgaggcgcgctccctcgaggacgacctcgatcaccaggctgccaagctcgcgcgtgccgacttcggcatcacgcagttctacttcgaggccgccgcgctcacccgactgcgaggcgcgcttcgcggtcggggggtgacccgaccggtgatccccgggctcctcgtgccacgctcgccccgccagctcctgcgcatgggggagatggccgcggttcgcgtcccgcgggagttggtcgaggcactcgagggtcccgacgggccggctcgagcgaggacggtcgtcggcgagctcgccagcgccgccctcgaggaggggagtcccggggtgcacctgttctcgatgaaccaacccgagacgacggcgtggctgctggagcgccttgatcggcgccatcgtcgcgtcagttgaggtgtttgccgaacgttcaccgtctggtcagcgtgaggcaaactcagcgcaaccgacccgtcgccgaactccgcaagactgaacccgtcagcgaatggcgctggtatcgcgagtcactcgaggaaggagtgatccatgagtgatcgatccgtcgacgcggccctcgacgaggcgccgctgagtcggttccacacgaggtcgatcttcgtcgcaggcatggggttcttcaccgatgcctacgacttgttcatcatcggcacggcgacgaccttgatcgcgaagcagtgggggctctcgtcgaccgagaccggcctcatcaattcgatcacgttgctctcggccttcttcggagcggtgatcctcgggcggctcgcggatgtcctcggccgcaagcgcacctacggtctcgaggccgggctcatggtgctcggagcggtcgcctcggcgttctccccgagcctcatttggctgctcgtcttccggttcatcctcggtctcggcgtcgggggcgactacccgatgtcggccgtgctcatgaccgagtacgccaacgtgcgctcgcgcggtcggctcgtcgggctcgtcttctcgatgcaggcactcggtaccgtcgctgggtacgtggtcgcgctcgcgctcttgtcggcgggcgtcaatcatgacctcgcttggcgcctgatgctcggcctcggtgcggttcccgcggcggcggtcatctacctgcgccgcaagatgcctgagtcgcctcgctaccgcgctcgcgtggagggcgacgctgcgaccgcagcgcgcgacctcaaggcgtactcgggcggtgtcgtggatgcggccgcggtcgccgagccgaccttgcgcctgcgcctcggtcagttcctctcgaaccgcacctacctcctgtatctgctgggtacggcgggcagctggttcgtgttcgactacgcctactacggcaactcggtctcggctcctctgatcgtcaagagcgtgctcggtaagcacggggcgcacgtgctcacggaggcgatcgcgctgcagctcatcgtcttcacggtggcggcggttccgggctactacctcgcctcgttcttcatggatcggatcggtcacaagcgcctgcagctgatcggcttcacgttcatgggcctcgcttttctcctcatcggggtgatccccggggtgacccacgacgtgctgccgttcctggtgctcttcggcgtgagctacttcttcgcggagttcggtccgaacctcacgacgttcgtgctcgctgctgaggtgtacccgacgagcgcccgctcgactggccacggtctctcggcggggatcgcgaagttcggtgcgttcctcggtgtcttcatcttcccgatcgtcaagagcgcgttcggcgtgggtggagccctggagttctccttcggcatggcggtcctcggcctcctcgtgaccctggtgcttcctgagcctgcgcagcgttccctcgacgacgtcaccggcgagctcaagctcgcagaggcggcccaggagtacctgcgccgggcttcgaaccagcagcggatggccggacaagactgagcgacctcctcatcggaggtgatcgacgaaccccgaccggaaggtcggggttcgtcggctttgctcgcgggtggtgccgtgcggctcgtgtgaacgtcgaggccgccgccgtgaccggagatccgcggtggtgccgtcaccgtcgtcggggagccgcaaagctcgcgtgggcgcggtcggcgccggcctgcgtcctgcgacggctccctctgggcgaggtggctcgagccgtgcgccgcgagacgccgacggtgtgtccgcgtggctgacgtgggtcggatgcgcgtgctactgtgcgaggaacggactcggtgcgatcgcagacggtccgatcgtggtgccgacgagcgtcgtgcgggttggctcaagtctcgggaggctcaggacgatgaggccagtgtgagcgagccgtccttctgggaaacgctggagcgtgtcgccgcgctcgtcgacgggccaccggttgttcgtccccagctcgtgaccctcgtcgggggtgatggtgccgtggacgatgtggcctcggcggcgtcgcgaggagggctcgtcccttcgcccgtagagcatggcgacgccaccgtgccgagcgatgacggcgcgccgaggggagctggcgaggcagacgtcgccgatgccgtggctgcatcggcggtggcgccgccgtcacctgccgaggatcaggctggcgcacggccaggcacaccggtcgctcgcgctgacgccgtcttccaggttctcgagcagacccagcgtgcagaggtcgtcgccgagttcggccgacgggacgctggggcggctccggccgagctcaccacggcgtctacgacgcccgccacctgggacgacgtcgacgagggcgtcgtcgccgcgccgagcggtttcctcgctggcctcgcggccaagcatcgcatcttcgccgagaccggtgagatcgacgtggatctcgaccgcgtggatcggcgcaagcgtcgtcgacgcggtcgatctgcctagcgcaccagagcggtgcgtgctggcagcggcgaggagccggcgccggtcggcgtgaccgtacgaccacgacggtgggctctgtgcgccgacgacatcgtggacgccgggtcgctccacgtgcagcgacggtcccgcacgagctgtgtcggcgatgccggtggctgggtcagcgactaaggagcttcgtcgccgaggtcccacgtgagggcgatgccctcacgttcggcgtcgcgttcgacccgcgcttggttgcggcggaactgtgggtcgtgcgctgggagcatgaggagccgcgcgttcgtcctctgcgcgaactcttcgcccactcggcgatcgccgctcgtcgtcacgatctcccagtgaggagcgaccgggcccaggtagcggatgcgtgcatgcgccctgatgggtaccggtgcttcgtcctcgggcatcgcccctcctctgctcggtgcgccagcctatcgtgactgaggctcgagagggtgcgtccgcttgcgcagaaagttactctatggtagcttctcgcatcgcagagccacgtgggccgtcacctgcagagggagggagcatggcgacagagcgaggttcagcgcccgaggcaggtgcgctcgtgagcgagccctggatggcgtttggatcgtgccgtggtatggatcccgagttcttcttcccgaccgacggtgctggtgtcgtccaggctcgccgggtgtgcgctcagtgcaacgtccgcgagcagtgcctgcagttcgccctcgatcatcggatcgatcacggcgtgtggggtggcgcctccgaacgtgcgcgtcgtcgcctcctctcacagcagctctcgtcggtgcgagcgcctcttcgcgacgtctagcctcgccgtgtgctcgagtgcgtgatcaatctcgccgaagggcgagagacacgtgcggttgaggcgatcgtccaggcagcagcccccgcgctcctcgacgtccacgtcgacgccgaccacaatcgcagcgtgttcaccctcgctggtcccatggtcgaggatgcggcgtggtcgatagcggaggccgccgctcacctcctcgacattcggcaccacgtcggtgtccacccctggctcggtgcgatcgacgtcgttccgttcgtcccgctcggtaccgcgtcgttggatgcggcgatcgaggctcgcaatcgaatgggtgcgcggcttgcgagcgaactctcggtaccggtcttcttctatggtccggagcgcggcctgccggaggtgcgccgtcgagcgtttcgcgatctcgcccccgatctccggccgactcggccgaatccgcgcctcggtgcctcctgcgtcggtgcccggggcccgctcgtcgcctacaacgtcgtggtcgatgcgagcctcgaggtggctcgcgaggtcgctcgggagcttcggggacctgcggtgcgtgcgctcgcgttccaggccggtcgtcgagtgcaggtgtcgatgaacctgatcgaccctcgggtcgtggggcctgcccaagtcgtggatcgcatcgcttcccgagtgtccgtgcgcgtgtgcgagctcgtcgggttggtgcctcgctgggtgctcgacgacatccctgccgagcgttgggcggagctcgatcttggaccagaccgaactatcgaggtgagactcctggctcggggcctgccgctcccagcgtgagcggtgccgacgactcggtggtggcgacatcgctgcgaccgaggtgtcgcaaccccgcccacgccagagcggcggtgcgctcggcgtagcgcgccgccagtgaggcctcgaacggccgattcggctcgtcgtcgtcgacgtcgtcgatgtaggcggcggccgcgccgttggcgaggccgatgagtgcccgtgcggtcagcagccgatcggactcgctgggtgctcctgtgatcgactcggcaacgagatcggcgatcgccagctcgataccaacgacgatcgactgaaactcgacgtcgcggtagacacctggcccgaagagcacgaggtaggccgcgcggtgcgcgtgcacgaaggcgaagaacgcgcggatgccagaccacagccgcacgcgggggctctcgacgccgcgcgtcgcctcggcgatcgcgcgcgccagctcggccccggcaccgtcgatgacctcacgaaagagggcgcgcttcgaggcaaagtgctggtagatgacgggcttcgtcacccgcgcatggcgtgctacctcgtccatcgacgccgactcgaacccacgctgcgcaaagaccgttcgcgccgcgtccaggatgagcgctcgccgacgctcggctgggagtcggtgagcccgtgtgtcggcctgcatgtgctcccctctgcgaacgcaacgcctcctcggtggccctcgacactagccaggttggcacgccgcgtctcgtcgtgcgcgtgcgctgtcgtccttctgccgcgccctgagcccagagtgcccggacctctgcgcgcctaggctcggggtccgtgaagacagcactcgtcaccgggatcactggacaggacggctcgtacctcgccgagctcttgctcgccgaaggctatcgcgtcgtcggtatgcaccggcgttcgtcgacgctgaacttcgagcgcatcgcgcacatccaagacgacgtcatcctcgagcccggggacttgctcgacgaggcgagcctgctcgccgtcttgcgtcgctacgagccagaggaggtctacaacctcgctgcgcagtcgttcgtgcagacgtcgttcggtcagcctgtgctgaccggcgagaccactgcccttggtgtcacgaggctgctcgacgcgatccgggtggtcaaccccgagatcaggttctaccaggcgtcgacgtcggagatgttcggcaaggtcgtcgagacgccccagcgcgagaccacgcccttctatccgcgcagtccgtacggtgtcgccaaggtctatggccactggatcaccgtcaactaccgcgagagctacggcatgcacgcgagctctgggatcttgttcaaccatgagtctccacgccgcggcctcgagttcgtgacgcgaaaggtgacgttcggggtcgcacggatcgcccatggcctggcccacgagctgcgactcggcaacctcgacgcgcagcgcgactggggttttgcgggcgactatgtccgtgcgatgtggttgatgctccagcagcccgagccagacgactacgtcatcgcgacgggatcgacccattcggttcgagaactctgcgagcgcgcgttcgccgtcgccgatctcgattgggagcgctacgtcacggtggacgagcggttcatgcgtccggccgaggtcgatctgttggtcggcgatgcgagccacgcgcgacgccggttgggttgggagcccaccgtgagtttcgacgcgctgatcgagatgatggtccgggcggacctcgagctcgtcggctcgacgctgaagtaggcgccatggcccgcagggtcgttcggctgcggggtgtgaccgtcctgctcggtcggttccctgcactggctcgtgccgacttcgacgccttcgaaggcgaagtcgtcgtgctcgaagggccgaacggatccggcaagacgacgctgctgcggctcctcgtggggctggttggcgcgtccgagggcgaggtggccgtgttcggcctcgaccctgccaaggacgtcgcgagcgtgcgtcgcgcggcgacctacctcgggcaccaggccatgctgtacgaggatctgagcgccgaggagaacatcgctttcctcggacggctcggcgtcatcgatgccgaacgcgcccggggcctctgcgaccagcttgcggtcggccgacgcgagcgagggcggcgcatgcgacagctctcggccggccagcggcgcaaggtcgcgctcgccgcgacgctggctcgacctgctgagttgctcctgctcgacgagccgcacgctgccctcgatcccgagggcaaggaactgctcgatgcgctcctcgcagacgctggcgcccaaggtcgcaccgtgatcctcgcgagccacgaggcggagcgggttcgttcggtcgcgacgcgtcgctaccgcttgagcgggggtcatcccaaggagctaccctcgtgctgaaggtcgcggtcgcggtgtggcgcaaggaccttgggatcgagtggcgaactcgcgtcctgctcaaccaggtggtgccggtcacgctggtcatcgtggtgctttttgggttcgggctcggcgccgacgacccgctccttcgagccgccctccccgggctgtactgggtcagcgtcttcttcggtatgaccctcgccgttgcgcgcggtgcggcgatcgaggcagaggcgggtgcgggcgagctgtggcgtctcatggatgtgccccgcgctggcgtgtacctcggcaaggtgcttgccgtcgcgacctggggcgtcgtgatcgaggtcgtcaccgccgccgcggccgccattctcttcagcgccccgctcggtcaccctctcctgcttgcggcggctgcgctgctcgccgatctcggggtcgcggcggtcggggtcgtgctcgcccagctcgcgaccggggagcgtgcagccgagagcctgctgccgctgctcacgctgccggtggtgagccccgtgctgctggctgctgcgaccgtgtggagcgagggactcgctcaccacgcttccctggcaactccctgggtcgaggtcctcgtcgcgttttcatgtatctacctgatcgttggcatgcttgtatacggtgtcgtcctggaggggtgagtcgtgagacaacgcgcatcgatggtgcgacgagtggtgggtcttggcgcgctggctggtgtggcgctcaccgcctggctcggcctcgtggccacgccgcccgcggagttcttcggcaacctggttcggttgctctacgtgcacccgtcgatggcgtgggtcgccttcttggcctttggcgtgacgacgctcgcgagtgcgctctatctgtggccgaggacccgtcggcctgagtgggacctgctcgccgctgcctcggccgaggccggcgtcgtcttcaccgggctcacgctcgtgaccggctccatctggggtcgaccgacctggggcgtgtggtggacgtgggatgccctgttgaccgcgaccgccgtgctgttcctgctgtatctcgggtatctcgcgctgcgtcgaattccgatggacgaagagcgtcgtgcgaagcgctcggcgatctgggcgttgatcgccttcatcgacgtgcccatcgtgaaccagtcggtgtactggtggcacacgctccatcagcgtcccaccttgaccgttggaccgacgaacgcagtcgaggtccacgggatcatggccgtggcgctggccgtaagtttcgtgtcgttcacgttggtatggatctggatggtgtgggcacggttcgacctcgcgcggcgccagcgcgtgctcgaggaggccgaggtcgagcaggccctcgccgagcgcctcgaggccgtggaggcgggctcgtgaacggctacgtggaggccgggtatctcgcggtcgcgctcggtctgggtggctacgcggtgtggatcgccgccttgacgacgcgcgtacggcgtcgtgaacgcgaactctccgtgacgaggcaacgccgtggctagtgcgccgagcacgctcgacggtcgcgacgagtggaagacggtcccgagcgctcgtcggacgcgtcggcggatgctccagtcgttggtcctgttcgcagcgatcctcgtcgcgctcgtggtcgtgctggccatgggcgccaagagcgcgctcgagtactacctcacggtcccgcaggcgctcgccaagcgcgccacgctggccggccagaccttccgcatggagggcatcgttgtgcccggctccatccagtcgacacccgagggggtcgattttgccctccgctacgaccgtgcggtcgctcgggtcgtcgagatcgggaacccgccccagctgttccagccctccatcccggtggtggtccaaggtcacttcgagggttcgacgttcgtctcgaacctgatcatggtcaagcacacctcgtcgtacgtggccgcgcaccccaaccgcatcgctgatgccggagggacctacaagccgtgacgcaggcggtccttggtacggcgggactcgtcgttgccttcgtgttcgaggtcgcagggacggttgcgctcgccgttgcactctggcggcggaggcgactctggcgcgacgtgggccttcggctgctcgtggtcggggtggcggctgtggtggcatcggtcgcggcgctcgaagatgccctggtcacacacgactttgcgctgagttacgtggtccagaacaactcgagggagacccccctcatcttctcgatctcggggatgtggtcggcgctccaaggttcgctgttgctctgggctctggtcgggggggtgtatctcctcgggctcgcctgggtgctccgtcatgaggacgactgggtggtcggcgcgaccgcgctggcgatcctgggtgtgatcgaagcgttcttcgtcggggtgatcctgttcgccgcgagtccgttcgcactcgtgagcggggtcattccggtcgatgggcagggcccgaacccactgttgcagcagtatccgctcgtgctcatccacccaccgatgctctacgcgggtctcgtgggcatgagcgtcccgttcgcgctcgcgacggcttcgctctggcatcgccacctggacgacgcgtggctccggcgcatccgcaactggtcgttgatctcctgggtcgcgctcggcatcggcattaccttgggggcgtggtggtcctaccaggtgctcgggtggggcgggtactgggcgtgggatcccgtcgagaacgctgcgctcttgccctggctgatcatggccgcctacctccacgtcgccgtcggcgaacggcgtcgtcgccgcttgagtgctgctgggtatggtctcgtcgccgccgccgccgcgatgacgatcttcaccacctacatcacgcgttcgggcgtcctcgagagtgtgcacgccttctcggactcgagcctcgggacggtactgctcgtgttctttggcctcgtggtcgtcggcgcggtggtggtcgcgctcgcgcgcgccgatgtgctcacgcagccaggagcgcgaccgaacggggcacgcgggacgctgctcggcatcaacgcggcgctccttgcgctggtcgcggtggtggtcctcgcgggcaccatcttcccgctcatcgactaccaggtgagccatgcgagcgtgaacgtcggtgcgcctttcttcgatcgcttcgtggtgcccttgtcgctcgtcgcgttggccctgatggcgctcgccccctggtcgaggtggcagggcgcccatctcgacgaactcggttcgcgcaccctcgccccggctgccctcgcggtggtggtgctggtcgtcgccgtcgcagccggggttcgatcgctcgcaacgcttggcgcgtggtcgctcgccgccttcgtgctcgtcagcaccgttgccgcagtggcacgacagttggcggcgcgcccccgcggtcgtcggcttcgcgcggtcgcgtctcggcaggtggccgggatgatcgtccacatcggcgtcgcgatcgtcgcggtcggcatggcatcggcgacgaccttcggccaccagggcgaggtgcgcatcgcacgcggccacaccgtgagcgtctacggccagcgtctgacctacgagggcgtgcgcacggtggtgaccccgcagaagacttcgttcgaggccgaggtcgtcgtcgacggccaggggcgctactacccggctatcacgcagttcgggacctacacgacaccggtgggaacgcccgccgtcgcggtctctccgctgcgcgacgtctatctgaccatcgacgcgcccccgagcacctcgtcctcaccgatcacgctcggcgtcgtggtccagccgctcatcttctggctgtggctcggggctgcgaccatcgcgttcggtggtgtgctcgcggtggtggggatccggctcgaaccgtccggacgacgtccttcggagcgcccggaggcgccggtgccgagtgtggtgggtgcggatgcgtaggcgtcggccagtggtcgcgttcgggatcggggccctcgcgctcgtcggcggcttcacctggctcgctgcccgcgcggctccggccagcgagatccaggcaccctccccgctgctctacaagccggctccccgattggcaggcccctcgctgtggggctcggggtcggtgtcgctcgctgcgatgcgcggtcgctacgtcctcgtgaactacttcgcgagctggtgctccacctgtgccaccgaagagcgccagctcgtcgacctcgctcggggctcgggagtacgtgtgctcggcgtggacttcgacgacacgaacggttcggcccgttcgttcctcgcgcacttcgacgcgcacttcccggtcatcgtggacgcgagcgggcagcgcgcactgcgatggggagtgtcggcgccaccggagagcttcctcgtctcaccgagtggcgaggtcatcgctcgcatcgtcgggccgctcaaggcgatcgaagtggaggcgctcgtgcgcctcgccgaggcgaaggggtacggggcgtgacgcggacccgtcgcatcgcggtggcctggttcctgctcgccgcggtggccctcggggccgtgctcgtcgcgctcgtcgagcagccgtcggcggcgtcgcctgctgctcggatcgcctccttggagcgggaggtccggtgcctgagctgcggagagctcgacgttgcccagtcgaagagcgccgaggcctactccatggcggcattcattcgccacgaggttgcggccggcgcatcgaaccagcagattctcgatcaactcgtcgcgacctacggtgacgcggtgctgatggcgccaccggccaacgggctcggcctctacttgtggttgctgcccgtggcggtcggggctggcatcgcatgggagctggtgcgcggggcgcgccgtcatcgcgatccggaggagctctctggcggccgtctcggcaccgacgcggacgagccggcaccgcagccatcgaggcgtaccggcggcggggtcgggttggcgctctcgccgacggccgtggccgcggctccgtccggtgaggatgagcgccgcgctcggccgcgtcggttggcggtgccgaagtgggcggccctcgtcgggggcggactcatgctggtcgcagccggggttggtgtcggggtcgccatcggcgggtcgggcggcacggctcacacgacagcgaccctcggtgaggatctgcgcctcggggagacgttggcggccgtgggggcatctgctcaggccgagcgagccttcgaggctgcgctcgagctcgcgccgacgaatccgacggcgctcgcctacgagggctggctgcgcttcaacacggcgcactcgagtagggcgcgtgcggcggcgctcgcgatgctcgatgaggcggcgcagctcgggccgcacgtcgccgtcgcgcagctgttcgatgggttcggactgttctacggccgtcacgagaccgccggagcccttgcgcgtcttcgtgcgtacctggcggatgcaccgagctcgaagctctcgctcgaggcctcgccgctcgcggtgccgatctactcggcggcgcacctcgccgtaccggcgccgttccgaagccgaggttgatcgccgcatctgcgtgcgggccgatgtggtggtcgggctggctcgccggggctccgcttcctccctgggaagcccggtggccgcctcgtggttgctacggtacggctgctgtcaggaggttcgagtggggttcttcgatcgcaagcgcaccgagctcatcgagcggggcatcgacccgagtcgtctgccgccagggcagtacatgaccgaccgcttcccggtcctgcacgcaggcgaggttccggtctatcacgaccttggtgcgtggaacctgcgagtgttcggccgcgttgggacccctgtgacgctgtcgtacgatgagctcctcgcgctcggtaccgaggacgtcacgaccgacatccactgcgtcacgaagtggtcgaagttcgacacgcggtggcgcggtgtgccgttctcgcgcatcgtcgagctcgtacgaccgagcgaggacgctgcctacctcatcgtgcacgcggagcacggcttcacgaccaatcttcccctggccgatctcctcggggatcacgttgccatgctcgcgacccactacgacggcgtgccactcgagccggagcacggcttcccggtgcgcttcctcgtcccgcacctctacttctggaagtctgcgaagtgggttcgcggactcgagttcaccgagtccgaccgacccggcttctgggagcgcaacggctaccacaactatggtgacccgtggcgcgaacagcgctactgggacgagtagttcggaccatcgcacagagccgagcgctcgcatcgcgccgtgaggccggcacacgagggtcgaggccgcgtgattcctcaccgctctctggcgcgtgcgccccgcgagatcgtgccgtgaccgcgtactagggtgctgccatggcgggtgcggcgtcgtcgcctggtccgctggacgaccccggcgacgaggtgggtttgacgactcttgctccgggcgtcgcggtgcatccggatcatgcgagcctcctgcgcgaactcgatacggcaccgctcggtctcgagcacgtcgtctcgtggtggatcgcctcgggcgggacgctcgccgatggcttgtccgtggccatcatcggcatggcgctgccactcgccgaacatcagctgcacctcggtaccgtagaggtcgcgctgctcggagctggcctggtcgctggcgctgcggtgggggcgagcgtcggtggacatctcgccgatcgtgtggggcgaaccgcggtgatgctcgccgacatgctgctcctcatcgtggcggccgtggcgagctcggtcgcgtggagcgcgccgttgctggtcgtcgctcagtgtggggtcggtatcgccgtgggtatcgattttcccgccgggtcgagctacgtcgcagagacgatgcctcaggcttcgcgtgcgcacttcctggtggcgacgatcgcgaaccaggcggtcgggatggtgctcggtgctgcactcgtcctcggactcgtccacgaggtgcagaccccgagcgtgtggcgcttcttcttcggcgtcgaggcgctcgtggcagccttctttctgctcgcgcgcctgcacctcgtcgagagcccacgctggctgatggcccgcggtcgcaaccgggaggcgttgcgcgcgatggaggtcttcgtgccgagtcgagcacgcgcgttcgaggggatcgctgcgcggctcggcgatcggccgctgcacgtcgcacggatcccgcacgatgacaaggcggcgcggtttcgctccatcttcgcccccgcctatcgtcgtcgtacgctcctgacgaccgtgccgtggctcttgatggacatcgcgacctacggtgtcggactcttcacgccggtcctcctcgatacgctgggggtgcgatcccactcgtcgaacctgccagcgcgcacggcgagcctcgccctcgggacgggcttcgtcgacctcttcctcctcgcgggctttgccgtgggcgtcgtcgtcgtcgcccgcttcgggcgtcttcgcatgcagatcctcggcttcgtcgggatggcgatcggcatgggtgtgcttctggcgagcacgcaggtgacgatctcggttctccgggtcgcgttcgtgctcgtcggtttcgtggctttcaacttcctcatgaatgtggggccgaacagcacgacctacgtcctgcccgcggaactgttcccgacgcagctgcgcagcaccgggtcgggcttcgccgcgtcgatggccaaggtcggagcgacgatcggcgtgttcctcgtccccgtcgtgtcggctcattgggggaccgccgcggtcgtcggtgcgatggtcgtcgtcagccttctcggtgcgaccaccacggtgctctggcgagtcgacgatcgtgagcagacgctcgaggagcatcaggcgtcagagcccgtcgatacgctgtgacctcgtgggcggcgagatcgacacatcgggcgggacgctgcgcgggcgtgtgctgatgcgcgtctcgaatcagacgtcgccgagtcacgtgcgtcgtggacggcgtctggccggctgcggtggctgcgagagcaccgtcgtccctcgccagtgcttcgccgcgcgcgtgaccatcactcgatccagccacgctcgcgtgcgaccgcgacggcttcgtggcgattggcgacgccgagcgtgtggatgatcccagacaggatgttgcgcgtggtgccgggggcaaagtggacgcggagggctacctggccgatcggagcaccgtcgctcgcggcgcggagcacgcggagttcccgttcgctgagcgggccgtggccccgccgcaaatcgggggcgatgtggggatcgatgacgcagctgcctgcccacgctgcggcgagtgaggctgcgagcgcgtcgatcggcatgctcttcgagaggactccgcggacgccagcggcaaggagctcgagggtcagtgtgctcgttgcaaaggcgctcagcacgaccacgcgagagccggcttgggtgagttcgcgaatggcctcgactcctccgccgggaacgtcgaggtcaaccacccagagcgctgcggtcgtcaccgtgtcgtcgtgagggccaggcatggtgaccgaggtcgtgacaatggtgaactggccagtgccctcgaggagcgacgcgagtgcgctggtgagcagttcgtggtcgtcgatgaggatcagagggatcgtgggactatctcctcgctcgactgcgtccgctccaggcgaagccatgtaccgggcggttctgaaccgaggctccagcgtgctccgatggcggctgcgtgcgcctcgacggcgcgcaggcccgcaccaggcgcaccgtgcagccccacgccgtcgtcgtgcacggagagggtgagtcgagtgctctcggggtcgtagcggatcgagatcgccgcggtcgtggcgccggagtggcggatcacgttggcaaccgcctctcggaggatccatgcgagatgctcgtcggtggccgggtcgagggcatggatgccgtgggtgtcgaaggtcgtcgcgatcgacgccgtcgcgagccgctcgcgggctcgtgcaagctcgtcgaggaggcggctgggaggtggcggttcgtcgatccgtcgcagcgattcgagcgcatcggcgagttctcggtggacggaggtgagctggtgctgtgggtcggagtactcgagggaccgaagagcgatggcgacgtgctgtgcggcggtctcgtgcagctcgcgggcgaggcgcagccgctcgtcggctctcgcccgggcgacatcggcgtcgcggagacgctcgacggtgtgcagtgctccgaccaggtccgtcatggccgttgcgcccacaccggcgagcaggacgttcacggccaggttgatgccaaggccaggactgtgcgtccagccgatcgcgagcgtcacggcggcgagcaagccagcggcgagatagctgcgccatcggcctcggagcgtgatcgccgtggcgatcacgacgatcatcagggacgtctgtgctgcggggtcggacgcgacgcccatgagcgaagccgcactcgccacggtgagagttgtccacacgagcgtcgggcgagcggcccgaagcgtcgcgacgagcagcccgatcagggccgcgacgaggatccacgcgacggccgatgctcgtgtgcggttcagcatcgccatcgcaaaggcgaggttcgcgccctcgagaaggagccaggtgagggtgaggttccgcgttgcccgtggtgctggactggtcatcctgctcgttctcctcgagcgcgatggtagccgatgaaggtcgcgatcgcgaaggcgagctcccacgcgccaaggacgacgacagcatggccgatggccttcgcgccgtagaacggggtgagagccatcgagacgatggcggcggcaggggtgtcgacgccgatctggcgtaccagctccggcaatgtggaaagcgggacgaacactccacctgcgaactcgaggacgaaagccgcgacgctcgccagctgcgacgccgtggtcgggctcccgatcgcaccgatcgcgagcgcgccctgggcaaacacggcaccgccgagcagggcgaccccatccacgcagagccagtccgcgagcgggagctgagctccgagccagagcgcgatgccgtcgaggacgagcaggccagcggcgccaagcacgagagcgccgagggcgcgagcgagaaagtaccagcgactcggcgcgacgccaaccgtgctgagggtccggagccatccacggtggcgatcctccgcgaccgcgatcccggcgccggtcatcgcggtgatgccgacgtaggctgcgaggtgagccgtgacgagggcgacgatgttgcccgagccgacgacggtgtggcggtatgcagcgtggtcggcgaagaccacgagcagcaccacggggaccacggcgatgagcagagcactccgccgcgccagcgtctggtgccgaacgacgagttcgatggtggctcgcgcccgagcgagactcgggcgaggggagcggtggccgattgcggtcatgggtgttcctccgtcgtcggatcgcgctgtaggttcagcagtcggcggatcgcctcgtcgagtccgacgggggcgatctcgagcgcagtcgcgccgaggtggagcagttcgtgcgccagcccatcggcatccgtagctgtgaaggtggttcggtcgcgctcgatctcgagcacggcggctccgtagcgatcgagggtgtcggcatcgggttgctcccggagcgtggcgctgacccgcgcgaacccggagcgccctcggatctcgcgaggcgtggcgtcggcgatgagacgtccgtgcgagagcacgatcactcgatcggcgagtgtgctcgcctcggcaaggtcgtgcgtcgcgaggaggagcgcgccgccacggctgcgatgatcctcgaggacggtcgccagggtcgcgcgggcctcgaggtcgagtgccgtcgatggctcgtcggcgatgatcagctcgggcgtgcccgcgagcgcgatcgcgaggcgtacgcgctggcgctgtccgagtgacagcgtctcgaagcgagtgcgagcgagctgcgtgaggccgaatcgtcgtgccatcggggcggtgtcgacgccgcgcatacgtccgagcgcgtcgaggagtgcaccgaccggtgcagatggggggaaacctgcatcggcgaggaggacgccgacggcgtgcgcttggcgagtgagtcgagggggctcgccgaagaggcgcaccgatcccgcttgtggcgtggcaaggccgagcaggcactcgatcgtcgtcgtcttgcctgcgccgttcgggccgacgagcgcgaccgactcctccgactcgatgctgaaggtcacgccgtcgagtgcggtgaagctgccgtatcggcggacgacgttgtggagctcgaccgcggccgttcgggacgtcatgctgggcaacgtaggtcctgggggccgagtgtcggtgacgacggacgtcacgagatcgcgtgacaccggtcacgcgccgcgacccgctcgacctcactgatggccgacgatccgcactctctgagctcggtcgatgcgtcgtcgatcgagcggcgcctcgctggttgggtgggcctccgcctccgcgcagtcgcgcaggccacacgtcctctcacggaccaggttcgaggagtggcccggcgtcgttcgatctcgcgggagccgtgccctctggcgagagctcgaagcgcctcacagagaacgacaaccgaccgtgctccatcgagcgagccttcgttgacccactgaggacaacccaccccgggtgggtgggtcgccgtcgttgcgctgctcggcgatccatgcaagctcgctcccgccacgcggtcgtcacggtgcgagtggtctcggtgtcaggggctagccagcctgggctcgtaccgagggagcacgtggtaagaggtcgatccattgcaagaaggcgctcgcggcaggcagaggggcgctctcggcccgaggctcacttggaccgacggtccgtcgcgaggccctcaggcggtctgggcgcgctcgccgtcggccgtcacggtgcccctgctcgcgcgatggggaggggccatcatccgtacctcgcacgagcccgccgtgccgcggatcgggcgggcgtcgagtgtgccatcacccagcccatcgaggaggccgtcgaggatgcctcgctcggtcgcacagagggcggggtagtgctcggtgaggaggccgaacgggcagccgtgctggcggatcgtctccgtgccgtcggcttcggcggcgaaaccacttcggcgaagcgcggtcgcgacggcccgcatgaccccagaggcgctctcactgacggccgtcgacgcgagcgccgcgccgtgggcgcgtcccacctcgtaggcgatcctcgccgctcggtcggctgggacctcggcaagcaggcctccgacgagagcggcgaggagttcgacctggctctcgaggccctcgaacggtgctcgcgatccctccgcccgatagcgcttggatggtcgaccaacctggtggcgagcaccctggctgacgacggcgaggtagccggcctcgacgagacgatcgaggtggtgtcgtgcgacgttcggatggaggttgaagtgtgccgccactgacgacgcggtcacgtcgtgctgctcgcgcgcccagaggtagatcgcgcgtcgcgtgccgtcaccgagggctcgcgtgaggtcatcgagcgtctgggtgagccacacgcccgttccgcgctccacgacgcctcctcgcactcgctggccgagacggctgttctcgtaccgagggccaacggcgactagtttatcgctgagcgacgtggtgggagggactgtggcacgtgtgacgaccgaggaggtgctcgagcgactcggggagctcgccgacccggacctcgaccagccactcgtcgaccttggactcgtcgatgtcgacatcatcgcacgaaccccgcgcgtcaccgtgcgctacgtgccgggctcggagcaggtgacggaccagctgcgcagcagtgcaaggcagcgtctcgaaccgctcggcgtccagctgatgctcgaacctctcgatgaggagggcctgagctccctcgcggctcgtctcgagtcgacgagtgctcgcgaagcacgtgaggcgcgcaaggcgccgttcgcgagtcccgagagccccacgcgcgtgctcggcatctcgtcgggcaagggtggcgtcggcaagtcgtcggtgtcggtcaatctcgccctggcgctcagtgccttgggccaccgcactgcgatcttggacgcggacgtctacggcttctcggtgccgaagatgctcggcgaagagcgtccgccgcgggtggtggggcagctgatcgtgccgccgaggatccgtggcgtgcgagtcatctcgctcggtttcttcgtcgacgatgcgacgcccgtgatctggcgtggtccgatgctgcactcgacgttgcagcagttcctcgtcgatgtgtactggggcgagctcgactatctcgtggtggacatgccgccagggaccggcgatgtagcgctgagcctgcaggagttcttgccgagggccgagatctacgtggtgacgactccccagcccgccgcccagcgcgtggcacagcgctcggcgatcgccgcccgcaagctgaagctccccgtgcgcggcgtcgtcgagaacatgacggacttcgtggccgacgacggcacgcactacccgatcttcgggtccggcggtggtgacgcgctggcggcggccctcgaggtccccgtccttggacggatcccgttgacgatgggtctgcgtgccggtggcgacgaggggatgccggtggtcgcggtgcgtcctgatgaccccgcggcggcagccattaccgagcttgcggcgcgtatcgtgtcgctcggtgctgctcggcgctaccgcgccgatctgcgcgtgcagacgcgctgaggaagagtggccggtcggccacgatgcgaggaggatacgtgcaggtacggatcgggatcgctcagagtccgcgtgagctcgagctggagttggccgaggagagcgaccaggctgcggtggcccaggccgtcgatgccgccatcgaggccggaacgggagttctctggctcgaggatcggcggggtcgacgtatcggagtgcctgtagaacggatcgccttcgtcgagctcggaccggatcggaaccagcggtcggttggattccgggcctagccgatcatccgcatgggctttgacctgctccgccgccggctgctgatcatcgccggcaaggggggagtgggcaagacgacgctggccgcctcgctcggcctgcttgcggcgtcgcgtggtcagcgcacgctgctcgtcgaggtggatgcgaagggagatctcgcggcccaggtcggcgtcgcgaacgcggggttcgagcccgtcgaggcccggcgcaacctgttcgtcatggagatggacacgcaggctgctctcgaggagtacctgcgtatctgggtgaagctcccgttcatgggtcgactccctggactcgggcgcatcttcgacttcgtcgccacggcggcaccgggtgttcgcgagctgctcgtcgtcgggaagatctgctacgagattcgtgaggaccactacgacctcgtcatcgtcgatcctccggccagcgggcatgtggtgtcgcagctcggggtgacgaccggggtcggcgagctgatcgggcggggactggtgcaggggcagacgtcctggatgctcgagatcctctcggacccggcgcgctcgctggcggtcctcgtggccacgcccgaggagacgccggtcgaggaggccctcgagctcgccgatcgcctgcgcgacgagacgccggtgcacctcggcggagccttcctcaaccgcgtcgtgccggtgacgctcagcgaggaggagctcgaggcgctcgagcgcaccgcgggccgcggtccttcggcactcggcgcggtgctcggtgccgctcgtctctcccagggcattgctcggcagcatgctcgcaaccgcgcagtgttcgccgatgcgctcggccccgacgttccgcttcgggagctcccagagctttttgcgacggtgccaccatcgcgcctcgccgacgaactcgctgaggcgctcgaggtgctcacgtggtgagcgaggccgttcgtgcggtgacggcgttcgagcgcttgttcgtcgtcggggctggtggcgtgggcaagaccacggttggcgcgggccttgcgatcgcgaccgctgtcgagctcgacgtgagcgtcctcgtcatcaccgtggatccggccaagcgtcttcagagcgcactcggtctcgaccatctcgatttgcgtcccgtgcgggtgccgctcgagggactcggcgccaaggggcggctcgaagcggcgagcatcgacatgaagcggacgtgggatgggatcatccggcgctgggccccgactgacgaagtgcgcgatcgcctgctcgcgagccccatctacgaacacctgtcgtcgcgcttcatcgggtcctacgattacgcggcggtcgaggtcctcgccgaggtcctggagggcggttcctgggatctcgtcatcgtcgacaccccgccgtcgcgcaacgcgctcgacatcctcgatgcgcctcgccggctgatcgagttctttcgctcggcgctcctgaagctcctgacgttgccgcggcgtgcgcgagcgttctcgctcgcggcacgcccgttcttcgtggtcgccgaggcggtgctcggctcggccttcctcgaggacgtgacggagttcttcgccgattttgcgacccttgccgagccgctcaccgagcgctctcggcgactcgaacaggtcctcgtcgctcccgagaccggcttcgctatcgtgtcgacgccgctcggtccctccacgagagaggcagaccggctcgaggccgccctgctcgatcgcggactgcgtgtcgccgttcggatcgtgaatcggtgctggccgcccgaggacttctccccggcggccgagcaagccctcgggtggttgcgcagccccgagggcatcgaggtgctgggccgcgaactcggagacgacggggcggccgcacgcgtcgctgccgagctcgccggcctctatgcggagctcgagggtgcctgggctgcccgggctcccgagggagcgggcagcctcgagttgccgctgaccgatgcagcgttgacctctccagaggccctgtggtcgctcatcgcaaccgcgaggatccgaggggtcacctccgagcacgagtagcatgggcggcggtgatcgactaccacctgcacctgtggccccatggtgagcgcgatcgcgacgtcgtcatcgaggagcttgctgcgttctgtgaacgcgcacagggtcgcggtgtcgacgagatcgcgatcacggagcacttctaccgatttcgccaggctggctcggcggtcggtggcttcttccggcgctacccggattcgccggtgcgcgccgagatggagcgctactgggaggagaactcccgggcggatctcgacgcctacgtcgagacggtgcttgcggccaagcgcgagggcttgccggtcgtccttggtctggaggtcgactactacgagggcgccatggaccgtgtcgcggcgctccttgccggctaccccttcgacgtgctgctggggtcggtgcactgggtcggtgcctgggccttcgaccacctctccgaccccatcatgatggccgagtgggagcgcgtcggcgtcgagcccgcctgggcggcctacacccgaagcctcgaggagctggctgcgagcggcgcggtcgacgtgctcgctcacccggacctcatcaaggtcgccggtcaccgaccggaggtgcccgacgagtacgaggcgcgtatggccgaggcggcgcgtgcgtccggcatggttgccgaggtgtcctcggccggtgcgcgcaagcccgtcggcgagatctacccgtcgccgtcgctcctcgctcggttcgtggcggcgggcgtgccattgacgacggcgtcggatgcccatgggctcggagacgtggccgatcgatcgagccagctgcgagccacgctcgaggcggcaggcgtgagcgagctcgcagccttccgggcgcggcggcgtcagtcggcactcctctaggctcgatgaccgaactcaccgccgtgggtcggctcgaccaggccgagcggacggcgctgcgtgagatcttgcggttctggggattcctggccgacctcgcgttctcggacctgttcatcgccctgcccgacggggacgacttcgtcgtcgtggcccaggtccgtccggcgaccacccagaccattcacccgggcgacctgatcgagactcgcctcggtcccgacgaggcgcgacacctcgccgaggcgatggaggcgagggtcatggcgaccgtggatcgctccgacgggactcgcctcatccgctccgccgcgttgccgctcgccatcgaggggcatctgccctacggggtgctggtgcgagagcgcctcgtcgagcactatcgcaccaccggcgaactcgaggcaacctacaaggcgctctacgagcgcttcagccggatgatggtccagggccgttttccgtatccccagagcgacgtcgaagaggcgccgcgcgtcggcgacggtgtgctcgtgctcgatcgcgctggccgcatcacgttcttgtcgccgaacgcgacgagtgcgctccatcgcctcggcgccacggaggtgacctcgggggcggcgctcgccgacgtcggcatcgacgtgctcgcaccggcccgggctgcggcgctcggcgcgcccgtgctcgaggaggtggagcatgcgggcggtgccacggtgaccttctactgcctgccgctttacgacgcgggcgagctcaccgggcacctcgtgctcgtgcgcgacgtcaccgacattcgccagcgcgagcgggtcatcgcctcgaaggacgccacgatccgcgaggtgcaccaccgggtcaagaacaacctccagaccatctcgtcgctgctgcggctccaggcgaggcgcctcgccgaccaggaggcggtcgcggcgctcgccgaggcggagcgacgcatccgctcgatcgcactcgtccacgagttcctctcgcgggacgtgtcggaacaggtggaggtggatgaggtgctggcggccatcggtcgcttggccgaggagtccaagctgccaggacgcacgctcgagctggcgatcgagggctcggcgggcaaggtcgaggcgacctgcgtgacgccgcttgccatcgccctcgcagagctgatccagaactccctcgagcacggctacggcactgagagaacgcacctgcgcgtcgaggtggctctcgagcgacacggtcccgagctctgggtggtcgtggcggacgacggcgtcgggtacccgagcgacctggatgcgcggagcgctcgctccctggggcttgcgatcgttcgagatctcgtggcctcgcagctcggcggcactattcagcttgcgcgaacgcccggcggcggcgcgctcacgcggcttcgagtccccgtcgagcgtcacgagcgctgacgtggacggccccgagggctctggtacgctgggcccgaagcccgctgacggtggcggcatgcggaggaggcgtctcgcgtgaagatcgcggtgtgcacgaagcagatccccgaccctcaaggtcctcagcgtctcggcgacgacctgcggctcgatcgctccggcaaggtgcttctcgacgacgcggactcctacggcgtcgagctcggactccagctcgccgaggcgagcggtggcgaggtggtggtcgtgtcgatggtgcccgaccacgagaccgctggggtccgccaggcgctcgcgatgggcgcggccagcgcggtcgtcgtctctgacgatgcgctccgtggggcagatgccctcaccacggcgacggtgctcgcctcggtggctcgacgggtcggggccgacatggtgctcacagcgacggagtccacggacggctacacgggcaccgtggccgcccagatcgcgggtcttctgggatggcccgccgtgaccttcgccaagggcgtcacgctcgagggaacgcacgttcgggccaaccgtcaggccgaagacggcgtgtgggtcgtcgagtcggagcttccgtgcgtggtgagcgtgaccgcaggtgtcgtcgagccacgctacccctcgttcaagggcatcatgagcgcgaagtcgaagccggtcgagcagctttcgctcgccgatctcgggctcgaggcgcgcgcgacgcagcgcgtcgtcgcggtccaggaggcggcccagcgtgaagcgggaaccgtcatcgaggacgacggatccgccgaagcggctgtcgtcgcgttcctcgagtcgatcaaggtcttgtgaaggaggcgacgtggcaactgcttgggtgatcgcagagcagcgtgatggtgcgctggcgccggtgacggctgagctggtgaccgtcgcgcgcgacgtcgccgatgaggtgcgcgtggtggtcgcgggtgacggtgccggagcggcgtcgtcgctggctgcctacggcgtctcggagatcatcgatctcgggcccctcgacagcgtgctccctgggccggtgcttggggcaagcgttgcacggctggtgggggaggagccctcggtcgtcatcggcgcgcagacctacaccgggcgcgacgcactcgggcgtgcatcggccctgctcggcgctccggtcctgaccaacgccgtcgccgtgcggcgcgagggagaccaggtcctcacggagcaccagatcttcggcggcaccatggtggcgaccgccgcagcggagctgcgcggacacgtgctggtgggcgtgcgacccaagagcgtcgccgccgtggccgcggctgcgccgacggctccctccgtgcgggttgtcgagccggcactcgatgtgcctggggtcgtcgtcacggtggtcgatcgccagcgcgaggagcgcgaggggccgagtctcgacgaggcggccatcgtggtctccggcgggcgcgggcttggcaagcctgaggcctaccagatgatcgaggagctcgccgcactgctcggcggtgcaccgggtgcatcgcgggccatcgtggatgcgggatgggtgccctacgcctaccaggtcggccagaccggtacgacggtcaagccggacctctacatcgccgtcggcatctcgggggcgacgcagcacctcgtgggcatgaagggtgccaagcacatcgtggccatcaacaaggacaaggatgcgccgatcttccaggtcgccgatcttgggatcgtcgcggatgccagctcactgctgccgcgagtcatcgaggctgttcgcgcccgacaagccgcctcctgaccggtcatcgccggccaggtgcgaggcgcgccagtagccgcaccgggccgtgcctgtgctctgtgcgaccacgcacgatgaaagccgccaccaggaggtggcggctttcgcagcggacagtggaggactacgccttcttggtctcccagaagatgtcggcgatctcgttgatcttcgccagcagctggtcggcgatcgccacgtcgttggcacgcttggcctggctggtcagcttcttcgtcgaccagaagagctcgtggagctgcgggtacttctcgaggtgcgctggctggaagtactgataccagagcacatcgaggtgatggttgcactcctcggcgcgctgctccttgatgagcgtcgcgcgatcgcggaaataggggtcgtcggaggcgttgaacttctccatgatggccttgatcgattcggcttcaacgcgggcctgcgcgggatcgtacacaccacacggcaggtcacagtgtgccgagaccgggcgcggtgcgcggaggcgatcgagggcgttgaacatgcgtgcaagcagcatggccttcctttctcctgttggcgacggtgccaaggcacacgccgtagtgcagtccatggccgccgagcccatgatgggacgagaacgcgtgccacgctcagcttagcgagagccatgctcgtgtgtccgtcgaggcctcgggcgtgcacgatgttgggtcctcatcgagccgaggcgggcggggcgtgcgtgttgacgcgtcgtccgcccatcggcgacccaagggcatcgcacagggagtgaggccgagcaccgcgctcccaagctcctgctcgcgggtgggccagtcgggatcgcgggtcaagggaatgctgctctctgactgatgcaccacgacgaggctcatgctccggccgtggcaccgtcgcccggtcgaggtcgagcgcgatacgctgctcgccgagcagccgactgcgcgaccagcgacttcaatgcggagtactggcaatcaccgcacgctcgactgtcggtgaggagacctgcgcctgcggttggacgtactgggtcgtccgaggccagagtcgcgccagcggcggcgttcgatagctccttcaccacttgaagagaggtacacgagcgctagaggtggtgacctgtcgccgcgaggtcgacgaggatgccgacgatggcgccggccaggacgagggccacgaccacctcgacgatgcagccgagcgttcgaagaggatggaggaccacgtgggcaaccaggatcaccgccagcacgatcacgacgatctccacggcgcctcccttcggcagcgacgctagccgttcgacgtcggcaacgagccgagttctcgagcgcgagctgcggtgcgcgacagtgcttcggcgatggcgctccgtaccttcgcgtcctcgagtgcacggatgccctgggctgtcgtgcctccaggagaggtgaccgcgagacgcaacgaccgaggctccgtgccgcgcgcctccgcgagcgcgatcgtgccggcgacggtcttgagggcgaggtcgagcgcgagctgcgcggggatgccgagggcgatcgccgcctcctggagagcctcgacgacgagcaggacgaacgccggtccggagcccgacagcgccgtgcccgcatcgaggagggactcgtcgaggcgataggccgctccgagtctgctgaacagcgcgaccgcttcctccgcgagggcggcgtccgcctgtggcgacgtggcgacgagtgtcacgccgcggcgcaccgcgagcggtaggttgggcatcactctcacgacagctgcggcacgagggaggagctcgcgtaggcgagcggtcggcacgccggctgcgatggagatgaccctcgatccgggagcgaggctctcggcgacgcccgcgatggccccgggcttgacggcgaggatcgtggtcgttgcctccgccgaggcagatgcggcctcgatgcgcccgtcggagcttgtgagggcggcgatgcggtcgcggtcgacgtcggcgacgccgatgcgtgggggctcgccacgcatcgtggcctcggtgccgtcatcgaaggaggcgagcaagccctggacgatggacgaacccatcgctccagcgccaacgacgaggatatcgagcacggctggagcttaggcgcagctcgcgcaggcgtcgagaggtgtggccgacagatcggcgagcgaggtgaggaagtcgttcgcggtgtgggcccaggtgcgtccgcgcgcgcgtcgcgcgccacgctcgcccatgcgcctcgccacgaccgggtcacggagcacgagggccatgcgatcggcgaaggcgcgaggcgtacgttcgtcgaccaaggctccggtacgaccgtcatcgacgatctcggcaagtccgccggtccgcgtcgcgacgaccggcgtcgcgcacgcaagcgactcgagcgcgacgagcccgaacgtctcgctctcggaagggacgagcgtgaggttggcggcgcggtagtaggtgcccagctcgatctgggggcgtggtccgacgaggtgaagccggtcagacgcacccgcgtcctcggcgagcctacgaacctccgcgaactcgcggtctccgtcgtccccggatgggccgccaacgacgacgaggtggctccgcgggtcgtcgagttcgagccacgacgcgaccgcaagggctgtgcccttgagcgactggatgcgcccgacccacaagatgaccgatgcatcgggggggaccccgatggcacgcctcgcaggccctcgtgagagggtcggggagaagacggcaggatcgatccccggttccacgacgacgagctggccgcgaggcggaccatagagcgttcgcagccacgtcgcctcggcccggctcgaactcacgatgagatcggcgcagccgagcacgcgttgctcttgatagacgcgggcctcggtgaggtgactcggaggttggccgagacggagcttggcacgctcgagggtgtggaacgtgacggcaagcgggagcccgagctcgtgcttggcgctgtgggccacgacggctgagagccaatagttcgcgtgcaccgcgtcgatgctcgtactgcggtcgagcgcctcgagcacacgttcggcgaagtggtcgacacggcgggtgaggtcgcgctcgcggtcatcgtcgctgagtgcatgcagccagagccctggttcgatgcgatgccgaccgggcacgtcgtgtgcgccggtgaagatgtccacctcgtggccggagcgagcgagctgggtcgcgaggttgcgaacgtacacgctcatgccgccgttcgctcccgctcccggtgtggcaaacggggaggcgtgataggcgatcatggcgatgtgcaccagatggctccctcctgcggccagcgtaccgagccaacccgccgatgcggcgtcctattcctcctcgctgcctggcggcggcggaagctcgaccccttcgatgctgccaactgcgatcggttcgccgtcggcgacgattcggtcgatgagtgcggcgctcaccgcatcgagggcgctgtggaggcgccggcgaagctcggagagggtctgctctgcctggcgctgacgagcttcccaggcagggcgctcggtggcactcacttcggtcgcgacgcgtgggccggcgaggtcgttgatggcctcctcggcgagcgcgatgtcctcttctgacagcgagagctcgacgtgacgacgggcgagtggcggcgagggcaggttggagagcgcgagctgacgggcgaactcctctccgcgggctgggccgagcgcaagcgcatcgagtcgcgtctgaagctcgcgtcgcgcgaacgagacgacgttctcgagacgcaaaccacgaccacggagcgcgacgagggacgctcgatcgcgtccgtcaaggtgtgcggacgcctcgatgacctcctcgaccgcgcgttcaagctcggtcactgccaccccccttcgatgggcagcgtcagcctagctcgggcccgccggcgcggcgcgggttgtgcggggaggtgcatgtggctcgctcgcgaactcgaccacgagaccggaagagcccgtcgcctcgatcgtggtctcgcccctgcgacgctccaccgtcacggtcgtcgtgtggtcgccgatctgaagattggtgagcgtgatcctgtccagccaggcgggcagcgctgggcgaacggtgagggtgcctgccgccgcgttcggtgcgagcccgagcagcgcagcaacgatcagcgcgaaagctccggcggcccatgcctggggggcgttggcgagtcgatagggacgagggtaggcgccagcgtcgcggtcgacgccggtgaacagctcggggaggcgaccgcccgcaaagagggtgccggcatcgagcagtgccgtcgcgagcgcgtgggcatggtcggcgagcccgtaggccgcgagtcctgcgatggcgatggcgttgtcgtggggccacaccgagccgcgctggtagctcagggggttgtaggcaggatggtttgaggagagcgtcctcagcccccagcccgagaagaggtcgggtgcgaggaggcgatccgccacggcgcgagcccgctccgggctcggcacctgcgcccagaggaggtgcgaggggttcgacgccaccgagtcgatgggtcgcttggcgccgtcgagtccgagatagtaggtcgactcctcgggccaccagaagcgttcctcgatggcctcgaccagtcgactcgcctcctcgcgcaacgtcgcggcgcgctcgaggtcgccgaatgcctcctcgagtacgttggcccaggctcgcttggcggcaacgacgtaaccctgcagctcgaccagggcgatcggtccatcgacgacgctgccgtccccctggaggatgccgtcttcggcgtctcgccatccctggtgccgatacccagtcgccgagcggggcgcatactcctgcaggccatcgccatcgcgatcgccatagcggtcgatccacgcgatcgcagcctcgacgctcgggccgagccgcgcgaggagcgctcgatcgcccgtccagcgccagagctcgccggccgcgatgacgaacagcgaggtggcgtcgtgcgtcccgtagtacggagtgtgcgggatgagctggagttcggcgagttcgccttggcgcagctcgtgcgggatcttgcctggttcggcgtcgcgtgtcgggtcgtccgtggtcgcctgaacgctggcgagggcaaagagcgctgcctggaggaactgcgtcccgagcatgacggtctcgagtcccgtccagatcgagtcgcgtccgaacagcgcgacgaaccatggcaccccggccgcagggatccagggcaagatgtccgggtgcgcgccgaggccagcgccctcggcactcatgcggagcgcgagcaggtcgtcgaccgagcggcgcatgatccgctcgagcctggtgttggaggtcgtgacggtggtgaggagccgacggtcctggtggagcttctcgagcggcgcgaccagctgctcgcacgcgtaggtcgggctcctcagcgtcgtgaggcgcgcgtgcaggcgcaggcagatggacgtctcggctcgcggctcgagggcgatgcgtacgatcagccgaccgttcgcgtactcgggctgtgcgggagcctcggcgacctcgacgacgagcgcacgtgcgaacgcgccgttgcgataggtcgtctcgaggcggcgggtcccaggatcccacgtggtctggacggagccacggcgcgcacgccgaccgctgcgcacgtcgaagatgtccgcgaagtcgctctcgatgccgagctcgaggtcgacgctgatcggcgagagcgaaaagttctcgatgagcaggtcgtcgtggatgcccggaccgatgacacggtcgaggcgaatgcggagatctccttcgtcgagccggtggttcaccagggtgagggttgggttcgtgaactcgaggcgagctgcgcgaggtccgagcgctgcgccctcgacgaggatgagcggtgcggtgccgagcgtcagactccaaccggagagcaggcgggtgtccttgacgaagtagccgcgctcgcgttcacgatcgatggatccattgcgtgcggtgaccaggatctcgtcgtcgtcggcgagcgtgatggtttccgagccgagccagtcgacggtgggaaggagctctctcacgcgccggctcccgtgacgcgcacaggtgcgatcgggcgctcggcgatgatcgatcgatagagccggaggtgggcctgcaccattgcctcggccgagaagtgttcggcgacccagcgtcgaacggccctgcgatccaaggtggcggcgcgctggagccggtccgcaaggtcctcgacgcccgtcgccagaaagccggcgacgccgtccgcgacgacttccggagccgacccgatggccgttgcgacgaccggcgttcccgcagccatcgcctcgatcatgaccatgccgaacggctcgggccaggcgatcggattgaccagcgcgatcgctccgcccagcaacgccagcttgtcgctgccgccgacctcgccgacgtattcgacgtcagcaccgaggagcggtcgaacggcggtctcgaagtaggcatgctcatcgggttcgcgcatcttggctgcgatgcgcagggggatcccggcacgtcgtgcgatctcgactgctgcgacgacgcccttgtcgggactcatgcgaccgaggaacagggcgtagccaccgtcaccgcgtcccatcggtaccgcatcgatctcgatgccgtggtggatgacggcggcgatccgcacgccgagggcgagttgggcctgtgcatgggaaatggcgatgacggggacggtggcgctcacgtgccggtagtaggtcgccatggcaccgaggaacggtgcgtggttggtggtgacgatgggagcgctcgcaaggcgcggcccgacgaggggaccgacgagcgtgtggtcgtggatgatgtcgacctcgcccagctgggagtaggcctcgaggacgtggaccgactcgttgatcggcgttgcctggtcggtcccgagcgcccatggcgtggcgcgtaccgtcggcacggggcaggtggcatccccggtcgtcgcaagcacgacgtcgtgtcccgctgcgtggaggccgcgcgcgagcacgtcgagcaccgcctcggtgccgccgtagcgcggtggtgggaccggcacccaacatggggcgacgatcgcgatgcgaaggcgtctcgggacgtcgtcaggtgccggccgagcggcgagggcgctcgcgtcgtcgggcgacacggtcacgcggtgcccggcgtgactctcaggagtgatccccacgggactcgcgttcctcctcggttcatgctgcacgcacgtggaccgacggacgactacgtcggcacagcgctgtgaccgactctgtggtgtccagcctactggcgcgcggaagctgacacgagcgacggcgtgctggtcgagcggccgagggcggtgcggacgcggctgccgaggtcgccggcgcgccgcaggctcgtctcgaccgagggtgggagcagattggccatgaccgagacgaccggggccatagtggcccggttgcgcatcgcgagccagacgcccggtgccatgacgcgagggtcgctgatgaggcggacgaaccgtcggccgagggcgtagtaggtgccgtagtggccaccgagcagcgccgggtagcgcgtgagtggatggtcactgtcggtgcggcgagcctcggcgatgagggttgcggcgaggcgcccggtctcgagagcgtaggagatgccttcgccgttgaaggggttgatcgtcgcggcagtatcaccgacgaggaggtagttcgacccctggactggcttgatcgtggtgcccatcgggagcttgccgccgacgggcttggcaaggagcgggtgctcgacgtcgagcccccaacgatcgcgcacgcgatcgacgaagcgtgcgagctccgtcgtggtgttgacgtggcgccacgcaccttggttggtgagcagtccgaagccgatgttgacgctgccatctcccatggggaacacccacccatagccgggcatcacgcgaccgctctcgtcgcgcacgtcgagcgctgactcgatccacggttcgtcggatcgcgacgaggggagataggtgcggatcgcgagcccgaggggctggctggtgtcgcggatcgcgccgagcgaccgagcgaggcgcgcattggacccttcggcgagcaccacccagcgcgcacgcacgcggacgacggcgccatcgttcgtccgacgtgcgaggaccgcgctgatgccgttgccacgtcgttcgagttcgatgccctcgtggccgaagagcacggtcgcgccccgatcggccgcggcgccgacgacaagcgcatcgagctcgcgccgacgcgcgacgaagccgtaggacggcaggagcgggtggttcggccacgggatgtcgagcgttcggccgaacgcgacggctcggagcccctcgtatcgatggaagcgggcttcgagctccgctccgaggcccagcgcttcgagctgcacgaccgagcgaggggtcaggccgtcgccacagaccttgtcgcgggggaactgcttgcgctcgaggacgacgacgtcgatgccgcgcatcgcgagccaatgggcacagctcgcaccggaaggtccgccgccgacgacgacgacggtggtggagacctcttcgtcaactgcctggaccacgatctcaccctagtggcggcccaacgggttctccggggtgacgccgatcaccctgacgctcccccacgtgcgcatgggtcggggccgtatactgcccacgaagaggccggatttgcagcatgcgtcctccgtgtccatcatggaggcgcagctgcgtgagcgatatcgagttggagcgaggtgcgatggcccagtacctgccgatcgggatcttgctgatcatcggcgtgctctttggagcaggatcgtttctcgcctccgggttgcttggaccacggcgtccgcaccgagccaaggcagcgccgtacgagtgcgggatcgtgccccgtgtcgaccctcccgaacgcttcccggtgcggttctacctggttgcgatgatcttcatcatcttcgacatcgagatcgtcttcctctatccgtatgcggcagcagcgggctcgctcggcaccttcggcgtgatcgaggttgccggcttcgcggtcgtggtgttcgtcgcctttgcctacctggtctccaacggcgcgctcgactgggtgcctcggcgtcgggtgcgggcccatccgccagaagtccagcgatcgctggaggcaccggctcgcgcggggagtcggtgagatggcgctcgacgacctgagctacaacttcctgacggcgcgcctcgaggacctcgtcaactgggctcgcaagtcgagcgtgtggccggccaccttcgggcttgcctgctgcgctatcgagatgatggcggcaggggctgccgacttcgacctggctcgattcggaatggaggtctttcgtgcctcgccgcgccaggcagacctcatgatcgtcgcggggagggtgtcgcagaagatggccccagtgctccgccaggtctatgaccagatgcccgagccgaaatgggtgatctccatgggcgtgtgtgcctcctcgggtgggatgttcaacaactacgcgatcgtccagggcgtcgatgagatcgtccccgtggatgtctacgcgccgggttgtccgcctggccccgagacgctgatccgtgcgatcttgaccctgcacgagaagatccgccacacccccatcctgcggcggcgtggccaggacgagcccgtcgcggagttgctcgcccggccccgtttcggcacgggggaggcgttcgcgtgagcggcgtcgtccggcacgtcgcacgtgaggactggctcgagacggcggaaggcttgcgtgcggacgggttcgtgatgctcgccgatctgacgtgcgtcgactatctcgagggggttcgagaggacctccccgaggaggtcgtgcgggagcgtttcgaagtcgtcgccgtgctgcggcggatggacccacctgccatggtgcgccttcgggcacaggttcccgacgacgatcccgtgatcgactcgctgtggtcggtctatcccggggtcgaggcgttcgagcgcgaggtcttcgacttgttcgggatccactttcgcgggcatcccgacctgagtcggatcctgatgcccgaggactgggaaggtcatcccctgcgcaaggactatggcgtcggccgcgtggcggtgcagttcaaggaggtgcgtcgacaccgatgacgtcgtccatctacaccgtggtgcggcccgacgaggaggcagaggccctcggcttggtcgcggagacgtacgaaggctcccaggagctgacccttcgcggtgccacgtcggccgcggagctcgagcgagagcagggcgcggtgctccgggttcccgagagcgaggtcgatctcgaggggtttcgaagccgacgaccggatgatcatcaacatgggcccccagcacccgtcgacccatggggtgctgcgcatcatgctcgagatcgagggcgagacggtgctgcgttcgaagcctgtcatcggctatctccacaccgggatggagaagacggcagagacgctgacctacctccagggcacgaccaacgtgacccgtatggactatctgtcaccgctcaacaacgagctggtgtactgcctcgcggtggaggacctgctcggtctcgagctgccggagcgggcgatctggatccgcatgctaatgtccgagctcaatcgcatcgcctcgcacgtcatgtggatggcgaccaacggcatggacctcgggtcgacgtcgatgatgatcttcgggttccgtgaccgcgagatggtgctcgccttcttcgagaaggtgaccggcctgcggatgaacaacaactacatgcgacccggtggggtcgcggccgaccttcccgacgggtgggaagacgacgtctcggcgatcgttgacaccatcgagcggcgcgtggaggagtaccacgagctgttgaccggtcagccgatctttcgcaagcgcgtggtcggggtcgggatcatcaagcccgaggaggcgatcgcgctctcggctaccggtccgatcctgcgctcgactggagtcgcgtgggatctgcgtcggtcgatgccgtatctcgcctacgaccaggtggacttcgacgtggtcgtcggcacggtgggcgacacctgggatcgctacatggtgcgcatcaacgagatcttgcagtcgatccggatcgtgcgccaagtcgtcgagcgcatgccatcgggaccgtatcgagcgcaagatccgaaggtcacgccgccgccgcgtgcgcgtatcgatgagtcgatggaggcgttgatccaccacttcaagctctacacggagggcattcgggtccccgcaggcgagacgtacgcggcgatcgagtctcctcgtggagagatcggttgctatctcgtctcggacgggtcggcgcgtccctatcggatgcacatccgagggccgtcgttcgcgaacctccagagtcttccggtcatgctgcgtggcgcactgatcgccgacgcgatcgcgatcacgagttctgtcgacccggtcatgggggaggtagaccgctaagtgggacggttcgagggcgagttcgcggcacgtgccgaggaactcgtcgggttgtatcctgagcgtcgctccgcggtgctgccgctgtgtcatctggcgcaagagcaggacggttggttgacgcccgaggcgattcgtcacatcgccgagctggtcgggcagaccccggccgaagtgcaaggtgcggcgtcgttctacgacatgttgcacctcgagccggtcggtcgttacgtggtcgggatctgcaccaacatcgcgtgtctgctgcgcgatggggaccgcctgctcgaggccgccgaggagctgctcggcgtgggcgtgggcggcacaacacccgacgggctgatcacgctcgaagaggtcgagtgcgtcgcgcactgcgacaaggcgccggccgtgcaggtgaactaccgctacttcggtccggtgacgccgacgagcttcgaggagctcgtcgggcagctgcgccgtggtgaactcgatggggaggtgcccccgcacggggtcctctcgcgagtgcgccgtgcggccccgccgccgatcccactggatgagatcgacgccgagcgggcccgccaagacgcggagcgcgccgaacgcgctcggcaggcggagagcggatcatgagcgcgccgtcgatcgtgggcgcgaggctcggctacgaggactcgtacaccctcgagcgctttctggcaaccgacggcgacgccgggttgcgcagggcgctgctcgagctgactccggagcaggtgcacgccgaggtcctcgaggccaacctgctcggccgagggggcgctggattcgaagcgggccgcaagtggtccatgctgcgaaaggccccgcgtcgctacctcgtggtcaacggtgatgaatccgagccggcaaccttcaaggatcacctgctggtcgagcgtgatccacaccagctcgtcgagggggcgaccatcgccgcctatgccatcggggcctcggtcgccttcatctatctccgaggggagttcgcactcggtctcgagcgggttcagcaggccatcaacgatgcctacgcacgcggagcgctcgggcgcaacatcttcgggtcggggttctcgctcgacattgtgctccagcctggtgcgggcgcctacatctgcggcgaggagacggcgctcctcgagtcgctcgagggcaagcgaggattcccgcgcatcaagccgccgtacttcccggcggtgatcgggctctacggagcgccgaccatcgtgaacaacgtcgagacggtgtcgaacctcccgtggatcgtgcggcacggaggagccgccttccgcgccctcggtgcgggccgctcgacggggaccaggatctttgcgttgtcgggaagcgtgcgccgtccgggtgccttcgaggtcgagatgacgagcgtcacgtttcgagaactcatctacggtgacgcctacggacagggtctcgagccggatcgcgagcttcgagccttcatccctggtggggtgtcgtcgccatggctcttccccgaacacctggacctgccgctcggtcaggacgaggtggccaaggccggctcgatgctcgggtcggggtcgatcatcgtcatggacgacggcgattgcccggtgagggcggcgtggcgaatcgcacgcttcttcgcacgcgagtcctgcggtcagtgcactccctgtcgcgagggtggcacctggatcgagcaggtgctgcgtcgcctcgagctgggctacggacgcgaggaagatctcgacctgctgctggatgcgtgcgacaacatctcccctggcgttacctggccgccggcccagacgaccatctgcgtgctcggcccctccatccctccgtccgtggtcgcggcgatccgtcggttccgcgacgtcttcttgacgcatatcaaggaggagcgctgcccctatgactgagcaggccagcaccgtcaccataaccctcgacgggaagtccgtcaccgttccagctggcgtcaagctcatcgaggcactcgaggccgtcggtacctacgtgccgcggttctgctaccaccctcggatgcgtcccgtgggcgtgtgccggatgtgtctcgtcgaggtgtcgggccctcgcgggttctcgctgcaacccagctgcttcatcgacgtcgccgaccagatggaggtgcgcaccacgagcgagccggtgcgcaaggcccagcatggcgtcctcgagtttctgctcctcaaccatccactggactgcccggtctgcgacaaaggtggcgagtgccccctccaggaccaggcctttgcgcatggttcgggtgagactcgtttcatcgaggagaagcgccactatcccaaaccgataccggtgtcgccgctcatcctcctcgaccgtgaacgatgcatccagtgcgatcgctgcacccgctttgccgacgaggtggccggtgacgcgaggttggatttcgccggacggggcaacggattgcgcgtcgcgacgttcgagggcgagggcttcgagtcggtgtttgccggcaacgtcgtgcagatctgtccggtcggggcgctcacggccacgccatatcggttcaaggctcgtccgtgggacctcgccgaggcagcctcgacgtgcacgtcctgctcgatggggtgccaggtcgtgctgcagtcgtcacagaacgagttgacccgggtcctcggggtggacgcggaggcgatcaaccagggttggctctgtgatcgtggtcgcttccaggttgcggcggtgaacaatcgcgaggagcgtctgcttgctccgcgcatcggggccgatcgcgcgagttgggctgcagcgctcgatgcggtcgcaagcgcgatccaagaggccgtcagccggcagggcccggccgccgtcggcgtgatcggtggcgatcgactcagcctcgaaggccagttcgcctgggctcgcctggcccgcagttcgatcgccacgccgcgtgtggacggggtcgccggttcgttggtcgaccccaatctgtggctggatcgcctggccaccgtggacgcgatcgacgacgccgaggtcgtggtgaccattggtgtcgatcttcgcgaagagcttccggttgcctggctccgccttcgacagcgggcgctcgccggtggtgcggtcgtcgacgtggcccctggaccgacgagtcagggcgagatcgccacggcgcggatcgtcctggatcctcgtgatcccgaggcggccatccgggaggttgcacaggtcgtcggcgatcgccgtgcgctggtcatcgtcgggcagtccaatccgctgctcgactcgcggacgcgcgtggggctgtatgccgcactcctaggccggctccccgcgtcgacggtgctgccggtccatcggtccggcaacgcggccggggcactcgtggcggggctgtcgcctggctggtggcctggtctcgtggccgggccggtcgctgggtgggctgagagcgcgggccacgacgtcaccgatatcctccaggcggcgcgtgtcggcgctctgggcgtgctcatcgtgctcgaccgagacctcggcgaactcggcctctcggacgcagagatcgagacgctcgctcgcagcgtgaccctcgtcgtggcctcgagcttcgagacggcgacgacgaggcgcgctgcggtcgccctcccgatcgccgcctggggcgaggagcgaggcgtgaccatctcggccgagctgcgccttggtcgcctcgcggctcaagtggagccgatggaacaggcgtggcccgcctggtcggtggcggaggagctgcgcgcacggctcgaggtgggtccggtcgccgttgccgtcggtgaggtgttgtcggcgctgtgccatgtcggtggcgtggtgacgactcacgacgtgcatctgctcggccagcgcgccgacggtccgctgttgccgtcggcagagcgtggcgacggatcgccgccgcggctgctcgaccccatggggacgcccggcatcgcctcggtgcgtcgtcaggccccagacgtccggttgggcaacgccctcgacccggcgctcccggcaccctcagccggggtgcggcgcgcgtcgctcgccaccgctgccgccctttcgaacgacctggttggcgcgacaggctcggggttcgtgccttggatcgcgagtgcgctctatggggacacccccgacgtcgtcgcaaacccgttcctcgctccgctccggcgccaggcgcgcgcgcggctggcgccatcggatgcgtcgcgtctcgggctcgagctcgacggtgcgacggtgcagatcggcggccgcgtgagcctaccggtcgcactcgacgacgacgtcgccgaaggggtggtcgtgatcgagggcatgccgagcggttggggtgagctcgctggccccggttggagtctcgtagaggtggaggcgctgcatgggagctgacccgctcctcgtcggccacatcgggtggatcgacgtcctcatcgtcgtcatcaaggtcgtcgtggccttcgcggccatgatggtgtcggtcttgctcgcgatctgggtcgagcgcaaggtgatctccgacatgcagaaccggataggtccgaatcgtgcgggaccgttcggcctgctgcagagtctcgccgatggcatcaagctcttcttcaaggaggatctgatccccgagcggtcggatcgtttcatcttcaagcttgcgccgtacctgtcgttggtgccggccttcttgacgttcacgatcgtgccgatcggtggcgtggtcgatctgttcggtcaccggaccgaactccaggtcgccgatccgccgatcgggatcttgctccttctcgcgatgtcgtcgatctcggtctacggcgtgatgctcgcgggttggtcgtccggctcgaagtatcccctgatcggttcggtgcgtgcctcggcgcagatgatctcgtacgaggcggcgatggggctctccatcgccgcggtggtcctcgtgacgggctcgctctccacgcgcgacatggtgacgggccagctcggcacctacctcggcttcatcccgcactggaatctgatacggctcggggtgatcccgttcgtcatcttcatcgtggcgatcactgcggaggtgaaccggccaccgttcgacctcgtcgaggccgaacaggagctcgtgggtggattccacaccgagtactcctccatccgcttcgcgctcttctacttggccgagtacttgaacaccatcaccatgagtgccatcatggtgaccctgttcttcggaggcccagacggccccgatccgcacgtgttgcactggctctggccgatcgtgtggttcctcgtcaaaacgtcgatcttcttcgtgatctacgtgtggttccgtgccgcgctcccgcgcctccgctacgaccagctgatggatcttgggtggaaggtcctgatccccgtctcactgctgtggctgctcgtcgtggcgggtatgcgggcctcgcgggtgctcggtttcgtgctgctcgtgctcgggctgatcgctgcgggagtcttgctccgcgcgatcgatgtcggccgacgccgccgtggccagagcgcgcccgtgcttcccgatctcatggacgcatcgatgctggggccgagcccgatcccggccatggtcgaggaagggtcgaccacagcggaggaaggggatgacgatgggcgtgcttgacgcactcgggggcttccgcctcaccctccgacaagtgttcgagccgcgggtcaccttgcagtacccagaggagaagcgcccgaagccgccgcggttccacggacggcacgtgttgaaccggtatccggacgggatggagaagtgcatcgggtgcgagctctgtgcgggcgcctgcccggcgcgctgcatctacgtgcgcggcgccaacaacgacccggagaggccgacctcgccaggggagcgcttcggcttcgtctacgagatcaactacctgcgctgcatccactgcgacctgtgcgtcgaggcctgtccgaccgaggcgatcacagagtcgaagatgttcgagttcgccttcaccaaccgtgaggacgcgatctacaccaaggcggagctcgtcgtcgacgacgagggtcatccaaggcgccagccatgggaggactggcgcgacgaggatgaacgctggacttcggcctgggttcgggcgacggctccgggaggcgatccggccttcgagggcgtcgtcggttggtcgccagaactcggtgtcgggacgcgaccgccggagcgtggccagtccgaccttccggaagacgaggcgacgcccgtgttctcgttgcgagcgattctggcgtcgcggatcttccgtcaacacggggggagggcttggtgatcctcggtgtcgtcggggtggtgaacctcgttgtgttcgtggtcgcggtggccgtggtggccatcggtggcgttgggctggtgagcgcacgccagcccgtgcacgcggccttgttcctcgtgttgacgctcttcggcgttgcaatcctgttcattcaggagggagcgcagttcctcgcggccgtgcaggtggtcgtctatgccggcgcggtcgtcgtgctgtttctcttcgtcatcatgctgctcggtgtcgaccgtgtcgaggtgagcagcatcgtcggcagcggttggcgggtctgggcagccggcatcggcgtcgcagccgtcctcgtcgagctgggtctgctcgccatcggccatgaggtcaccggcgcctccagcctggcgggcaagctctcggcgggatcgaacctcggtgtcctcgctcggagtgtctttacgacctacgtgctgccctttgaactcacgagcgtgctgctcgtgatcgcggtgatcggcgccgtggtgctggcgcgaaggctccgccagcgatcggacgcgacgacggtgagccgaagcgaggaggtgcacccgtgattccggtgagctggtacctcatcgtcggggcgctcctgttcgggctcggggccttcggcgtcttgattcgacgcaacgtcctcgtgatgttcatgtcgatcgagctcatgttgaacgccgtcaacctcacgttcgtgtcgtatgccagggcactcaacgacgtcggcggcgaagtcgcggtgttcttcgtcctggtcgtcgccgcagccgaggtggtcgtcggcctcggcatcatcgtggcattgttccggcgacgtgcctcggtcaccatcgacgacatcgcgcggttgaagggttaggtcggcatggatctcatcaccgctgtcatcgggtttccgctccttggcttcctcgtgctccttgcgttcggcaagcgcatcggcgagccgcgcgctggttgggtcggtaccatcgcgaccacgctgtcgttcgtcgccgcgctcgcgctctggggcgtcgtgctggcacgaccggccgacgagcgggtcgcggtcgtccgcctgttcacgtggtttcgcgctggccccttggtggcgcacatctccttccgcgtcgatgaactcaccgtgttcatggtgctcttcgtgaccggtgtctcgtcactgatccacctctactcgatcggctacatgcatcgagaccccaggttccaccagttcttcgtctatctgaacctgttcgtcttctccatgaccgtgctggtgagctcgaacaacttgccactgaccttcctcgggtgggagggcgtcggcgcgtgctcctactggttgatcagcttctggttcgagcgcccctcggctgcgagcgccggcaagaaggcgttcatcgtcaatcggatcggcgatgcaggcttcatcctcggcacggcgctcatcgtggaccatctgcactcggtgagctactcggtgatcctgcccgaagcccatcggctctcgagcggcacgctcgaggcggtcgcgctgctgttcttcctggcagcggtcggcaagtctgcccagctgccgctgttcgtgtggctactggacgccatggagggcccgacaccggtgtcggcactgatccatgcggcgaccatggtgaccgcaggtgtcttcttgatggcgcgtctgtcggcgttcgtgactcccgcccatgacgccgccacggtcatcgcgtggatcggcgcgatcacggccttcgtcgcggcgatggccgcgacctcgcagcacgacatcaagaagatcgtcgcgtactcgaccgtctcgcagctcggctacatgatgctcggcatcgggaccggtgcctacgtcgcggcgctgtttctgatggtgacgcacgcgttctacaaggcgttgatcttccttgcctccggttcggtcatccactcgctcgatggcgagcaggacgtgcgtcgtatgggtgcgctccgtcgcttcatgccgatcacggccgtcaccatgatcctcgcgtggctctcgatcgcgggggtacctccgttctccggcttcttctcgaaggggtcggtcctcgaggcagcctttgcccaccagccggtgctgtgggcgatcggtgtcgtgaccgccgtgctcaccgcgtactacatgggtcgactcgtctacgtcgtgttctacaacgagccgcgctaccaggaggtcctcggcgagcggagcccacacgagtcgccccgagtcatgacggtgccactggtggtcctggcggtggccgcagtgctcggagggctcatcaacctgcccttcgggagcttggacttcctcgatcgattcctggcgccggtcttcggcccttcgctcgttgccgtgcatctgtcgggcgtcgctcgggcggcgctgcttgcgaccgatgcggtcgccggcctcctcggcgtcgggttggcgtggcagctctggggccatcggtggcgtcggcccgagctcgagccgatggtgctccagcgcggttggtacgtggatgcaacctacgaccgcgtcatcgcgcgtccgatgaccgagctcgcgctcgaggcggacgaggtcgtcgatccgaaggtgatcgatggcgcggtgatgagcgtcgcgtgggcagctcggcgaatcggtggcctgggccgacgggtacagaccgggctcgtgcgcagctacctgttgctgatggtggccgggatcgtcgtggtgatgggctacgtgctcgcagtggcgacacgttagagaggcggaagaggcatgacgctgctcgactggttggtcgctgtccccgtgatcggggcgctgatcgtaccgatgatggcgttgccgcgggagcaggcctggttggtccgtgccttcgggatcgccatgtcgatcgtggagctcggcatcgccgtcctgctcgcggtgcggttccacatcggtgctccaggcttccaagacacccaggacctgcgctggatgggtgcgctcggcgtgcactggtatctcggcgctgacggcatctcgttggtgctcgtcatcatgacggcggtgctcttcgtcatcgcgatggcggcgatcaagggcgtcaccgacgttcgggcctacgtcgggtggatgctcctgctcgaggcggcgtgcatgggctcgttcgtctcgctcgacctcctgctcttcttcgtgttcttcgaactgtcgttggtaccggcctacttcctcatcgcggacttcggcttcctcgggtcggggcgtgcggccatcaagttcttcgtctacacgttcgcggggagcgcgctgctgctcgtcgggatcattgcgctcgtcgtcatccatgaccaccagacggggaacctgacgttcgcgttgcccgccctcgagcacacgcggctggctgcgagcacgtcgctgctcctcttcttggccttcacggcagcctttgccgtgaagaccccgatctttccgttccatacctggtcaccggacacctacgcgaaggctccgatccctgccgtggtgatcgtcgctggcgtcatggccaagctcggcagctacggcatcgtgcgtttcgacctcgggttgttccccggcacgtcgagacagctcgcgtggctcatgctcaccctggcggtcgcgggcatcctctggggcgcgatcgtggcggcgggcgagcgacacctgggtcggctggtggggtactcgtcgctctcgcacatggggttcatcgtcctcgggatctttgcgttctcgaccgagggtctcgcaggttcggtcctgcagatggtcaaccacgggatctacaccgcggcgatgttcctcctactcggcatgatctacgaccgctccggcacgctcgatgcctcgcggctcggcggactccagcggcacgcgccggtgctcgcgggagccttcaccgtggtggtcatggcgcaagccggcttgcctggcctgaacggcttcgtcggcgagttcctcatcttggtcggtacgttcgtgacccatcgctggtgggcggtggtggcggtggccggcgtcgtcggttcggcggcctatctcctctgggcctaccagcgggtcttccaccgcgcaccgtccgaggaccgggtcgtacacgacctgcagtggcgcgaggtcgccctcatcgcgccgctcctggcgatcatcgtgttcctcggggtctacccgaggccggtgctgtcggccattgacccagcgacctcggcgatcgtggcacgcgcgaatcgggcgccactgccggtggcatcctccacgccgaccgctgtggtttcgacgctcaccccgggggtgcggccatgaacgtcctgttggcgagcatcgtgtcccagacgccgatcgtgctgcctcgcatcagctacctcaccatcggtccagcgctcgtgctctttggcggagctctcgtggtcctgctggtgtcggcgctcctggtgcgcgcacggcggcccgagctctatcgttggctggcgctcgtcgcggtcgcgggcgagatcgtggtggccacggcaggcctgctccacgtcgacgcacacggcgcctccctcgcggtggcgggtgcgttggcctccgatggcttcgggttcgtcgtcgccatcatcgtcggtgcagcgaccctggtcgcgctgctcatcgggccgagtttcgtgcagcgcgagcacggcggcccggagtacgctgcactcagcctgatcgcggcgagcggtgccgtggtgatgggacaggcgaacgatctgctcgtcgtcttcctcgggctcgagatcctctcgatctcgctgtacgttctcgtcggcttccgtgtgggtgacggggtggcgcgcgaggcggcgctcaagtacttcctcatgggcggctttgcctccgcggtgctgctctacggcatcgccttgatctatggtgcgacgggatcgacgaatctcgtccgcatcgaagggttcttggccgccgaccacctgatccacaacggcgtgctgctggggggcatcgcactcgtgctcgtcgggctgggcttcaaggtggccgctgcgccgttccacgcctggagccctgacgtctatcaaggggcgccgacctcggtgaccgggttcatggcagcactggccaagatcggcgcgttcgccgcgttggtgcgcgtgttcgatggcgcgctggcctcccaggcctcgctctggggcccactcgtggcggcgttggcagtggcctcactggcggtcggcgccttcttcgccctgcgccagcgcgacgtcaagcggatgttggcgtactcgtcgatcaaccatgccggcttcatcctcctcggtgtctatgccgcgagcgcggtggggattcgcgcggcgctcctctacgtgggcacctatggcatcctcgtcgtcgggagcttcggcgcgctctcgttggcgcagtgggttcgaggcctcgacgaggggctgtgctcgctcgatgatctccgtggccttgcgcgtgagcatcctgcgatcgcggtgacgctcgccatcacgctcgtggcgcaagccggagcgcccttcacgaccggcttcttggcgaagttcgccgtcgtggaggcggtgatcgctgccggggagacctggatcgcgatcgtcgccatgttgagtgccgcggtcgctgcagcgttctacctgcgtgtcgtcctcgccctctacggcagggacagggagtcgagcgtcgtaccggcgatcgccggggcgcaggtcgaggacgggcgatctgccgtgacgcagcgcccgagcccgagcgagcgcgtcgccgtggcgacggcctggggcggtgtggtgctctcggtgggcgccaccatcgtgcttggcgtggtgccgaccctcgtcctcagcctcgtcgggagagcacacatcctgtgagactcagtcggtgaggttcagtcgggttggggccagcgtcggtcctccatcacgctgttcgcaccatcgacgacgatgaccgaacccgagacgtagctcgctgctggtaggcagaggaaggcgacgacgtcggcaacctctgtcggaaggccggatcgcccgagcgggctggcgagaccggcagctcgttcgtcgggcgtctgtgaccccgtggcgatccagcctggcgcgacgacgttgatggtggctggggcgaggtcgagcgcgagtgagcgcgcgagaccgacgaggccggccttggcggcagcgtacagggcgctgtgcacggtggcgttgacgtggccagtcgtagagccgacgaggaccacccgtccgcgcgcgccgtgggtgagcagtgtcggtgcgaaggctcggacggtgagcacggcgctgaggaggttgcgatcgagttcgtgcgtgatggtgtcctctggcaggctccacagggcgccttggcgctccgggtccccgacggcggtcatgccggcgttggcgacgacgatcgcgggaggaccgaggcgcgcggtgatggagtgggcagcctctgcgacctcggccgcgacggtgaggtcggcggtggatgcgaccgcgtcgatccctcgttcgatgagttcgtcgcgtcgagtgaagatcctcggtgagcgactgatcaggccgaggcgagcaccgagctcgccgagcgtggtggcgatcgcaaacccgatgcccgttggagacccggccccggtcacgaccgcgaccgatccgtcgagtcgccagcgctcatgcatgggggtccgccaggaagcgtccgacgagcggcaggtcccagagtgactcggcgcgtgctgcggcgatcgcgatcgcggcgaggtgctcgtaggcgtcgacgacgaggtagcggggttcccagcggggctcgaacttcgcgttgaagcgccagagcgactcgatctgcatgctcgacgagagccgatcgagcacccagcgctcgactcgggcgctcaggagttcgccgccgcgttcaccggcgagcacgccccgcattgcagcgaagttgaggctgatcgccttgacgtggcgggcttggagctgcgtcatggtctcgacgatgagcaggtcgaacatgccgttcggatggttgccgaggtcgcgacgcatcaggtcgagcgagtagccctcgatgctcggcgcggggacccactgcacgaacccgacgatccggccgtcgggtcctgtgcacacgctcatgaggacgtcggtgtcgcgggggtcgaagacgcgccccagcgtcatcgagaacccgcgttctcggccgccgcggcgtgactcgctcatgacgcgaagcacgtcgcgccgctcctcttcggtgagctcgagcggagcgacgacccgcacgcggtagccgtaacggcgcatccgattgactgcctggcgcagactcttgtggcgcttgccggcaaggtcgagttgaccgagcgtgacgatcgcctcgtcaccgaggtagaggggatgcaagccgacctcgcggtaccactcgctccaggtctcgctcgccccgaggacgcacagtgccttcccggcgcgagacgtggcctcgaagagctcgaggaaggcgaggcgtgccgaggcggtcgctccgatggggtctggggagacgatgacgacggagccgaactcgccgtaggccacgaggccgccatgacgcacgaggtgctccttgtcggagcgcagcgcgaagtagtccagtgtgctctgtgggtgggctcgcaggatctgtgcgggattgcggggcgctctgagggaggcgagctgcgcgctgaggcgatcgcgcacgggtgccacgaggcgccacacgatgaggacgaggagtgcgacgccgaccagcgtgagtgcgtcttgcaactcaccgaccgcgaatggcggcggtgcttgaaccggaagaccgagcacggtgccgatgatccctccgagggccgcgaggggacggagaggtgcatggtgtacgagggcatcgccgatcgcgacgacttcggcgacgaggacgaccaagacgccggcgcccacgaccgagagtgccctccacactcgtcggcccctgggggcgggttgtcgaaaggcgcttcgccagatggccagcgcgacgagcgcgaggctgaggaggccggtcgtgatgaggtcgctgcggcggaccaggttggaggcgaccgctgctgcgaggaccaccatggcgatccgccacgcccgtcgttgaccggctcggagcccttgggcgatgccgagcagcagcgtgccggcggccgccgagatcgcgtcggcgtagcgagggatcggtccgagggtagggaagagtgtggtgacgatcgacaggtgtcgtgccaatgggggtgcgaacgccgagatcacctccacgagaccggcgacgctgaccgcaagtcccccgacacggcgcaccgtgagcgaggtctcggaggcgagcctgggcgcggggggccacgaaccgccgtcaggggcgcccgcgagcgtcacctgatgatcgaggagggcctgatcgggccagagcaggcgcgagagcgcgttcggcgggcgaacgcgacggcgcgtccggcgcaggtaggcgcgcacgaccgcgccgacctcgagctcgatccacgtcgtgtggtacatgggctcgtagcgggtggggagcagacctctgccggcaacgggcgtgagcacggccgtggtcggtcctggcgaggcgaggaaggcgtcgtcgtcgtgttggagttcggcgagctcggcctgggcggcgatgagcgaggtgtgcggtgggaggctctcgaacagatcacgcgcggcttggttggtggccagtgcgctcaccatcgactccatcggctcctcgatgaggtgggtcaccgaccgcgaagcgaggacgctggcaaggagcacgatgagggcatcgaggacgaggaaactcgcgacgagggcgatgtggcgcgatgcctggtggtggaggtgtgcgacgagcggtgcggccctgagcacgaacggcagccgggccagctcgagcaggacgagcgggacgaagacccacaacgcgagcatgcgtgcacgccgtgcgaacgaacgcgccacgacgaagtgggtcacggaggcggccggatcgagccaggcagcgccacggaagcctgggagtcgttcgagcgcttcgagcgtgcgccgtcgtgcgagatccgtgccgaccggcttcatgcggacgcgatggccgcggggccctggcccgaggaggatcagctcggcggtgtgttctacctcggcccccattgccagaggctcgtcgcgcacggaggtgatgcgtacggtgcgtgcgcgggcgctcgtgagcaggtcgacgacgtcgtggtggtgcccgagtgcggagcgtgggtcgagactcggctcgggtgcggtgacgcgcccagcgaggacgagcaggtcatcgggctcgagctccccgatgatgcgtgcgagctcgtcacgatcggggcctgggcgccgatcgtggaggtcgagattgccgaggacgacgacgcgcgcgccgggcgcgaggcgcacctcgaggggcgccgactccacctcagtctcggaagttcgtgaactgtaccgggaagtccgtgatgtgctcgcggaggtgggcgatcacgctctggaggtcgtcacgcttcttcgaggtgactcggacttgctcgccctgtatctgcgcctggacgcccttgatcccagcggccttgatcgcggccgtgacggctcgtgctcgatcttgattcaggcctgcgacgaggcggatcacctggcgctgcgtacctcgcgcggcctcttcgatcgggcctcgatcgagcgccttgagcgagacaccgcgcttgacgagccgctcctcgaggacggtcgcgagtgcccgcagccggtcgggggtctccgagttcagcgtgatggtgagctctcgatcgttgaggttgatcgacgagccggtgttcttgaagtcgaagcgagtcgtcacctcgcgcgacgcctgatcgaccgcattgcgcacctcttgcaggtcgatctccgagacgacgtcaaaggacggcatgtgctcagactactcttgtgaccgtccagggtcggtgcccgagcggccaaagggagcagactgtaaatctgccggcgtacgcctacgggggttcgaatccctcccggcccactggagtccagcgcgcctggttcgatggtgcgcggcgacgtcgtgtcgcttccgaccgctcacgaggcggctaagctggcgccagcgcgaccaacgtggaggaagctgctgtcgtgaagtcctcgctcactcgtcgggctcagctctcggctcctggtgcggtgcgtcaggcacggatcctcggggcgcggatctccgagttcgtcgactcagtggagccagtcgagaccggcttgctcggctccatcttggtcttcctcgggtcgctgcagccgaattcgccgttcacctcgaaggtcccggggtcatggtttctcggtgtctcgtcggtgccgcaccccggttcggtcctcgtcgaggtgctcgcgaaggcagcggtttacctcggcctgatcctgagcggtgtggcctgggtgcggttggtgaggcttgcccgcgccgggtcgctgccgcgcgcctggtgggtcatcttcgcgctgtgggtcgttcccctcatgatcgctggccccttgttctcacgagacgtctactcgtacgctgcccagggccagatggtcacccaagggatcagcccgtaccatggtggccccaatctgctcgggacgagccccttcctcgcgaccgtggacccgctctggggcaacgctccggcgccgtatgggccactgtttctcgcggtcgatgccggtctcgtgaccatcgccgggcattcaccgctcatctcggtggtgctgttgcggctcttggcgctggcatcggtcgcggtgtccggggtcgccgtcagccgtatcgcacgtcggctcggtgcgaacgaggcgctcgccctcgcgctgacggcgctcaatccggtctttctctacacgctggcctccgcgggccacaacgacgcgttcatggtcgcgctcatgctgctcggtattgaccagttcctcgctggccggcgcttcgtgggcatcgtgatcgtcgcgctcggggcggcggtgaagatcccggcgatcatcgccgtgggtttcctcggctatcactggagcagcgaacgtacgtcgatcggggagcgcattcgcacgacgatcgtcgcgctcgtgatcgcggcggcgctgttgtgggcactcggcgtcgtgaccgggctcggcatggggtggctcccggcactgagcacgccgggttccgtctacagcttcgaggatccgatcgtcgccgttggctacggcgtcggttggttggcgcacgccgtcgggctcggcatcggtccttcgggtgtgatcagcgtgttgcgcgatctcggcgacgccgtgttgctggcggtcgctgcgatcgtgttgctcggttcgcgtcgcgagaccctgctgcggggtctggggatcgtgctcctcgcgaccgtcgcgctcggtccggtgatctggccgtggtatctcacgtgggccatcgtcgtgctcgcgatcggtgcgggagagctgacctcgggctttctggtgctcgtcacggtctcggcgctgccgatcgatctgctcggcctaccgaccgtgctggcgtgggtcggctacatcggcctcggggtggtcgtgcgtcgacactggggccatgtgatgggcttctggagcgagaccctggatggcgccaaggctcgggtcgaggagctcgtcgggcggacgccgctggctcgtctgctcccgtggagctgacgagcctcgtcgacgcggcccaccgcctgagcgaacgcgacccgctgatggcgcgcttcctcgaggcctacggcgtaccggtcgtggggcgccggggcttcgatccggggcgtctcgaggcgccgggtgaggttggcctcttcgggttcgtcgtcgaggtcgtgacctatcagcagatcagcgccgctgcggcgaggcgcctcgtggctcggctggaggcgatgggggcgctcgatgccgatgtgatggtcgcgctgaccgatgccgaggtggccgcgaccgggttgtcgggatcgaagcggcggtggctccgagcgctcgcgcgcgacgtggtgacgggcaccatcgacctcgagggactccgggcactctcgccggacgaggcacatcgtgcgctacgcgcgatccgcgggatcggcccgtggagcgccgacatggtggcgatcttcgcgctcggtcacctggatgtgtggccgatcggcgaccttgcgttgcgccgggcgctcgcgcgacgtcatcccggtgccgaggatcggggcgtcgccgagcggctcgccgagccctgggcgccgtggcgctcggtcgctgcgctgtggtggtggcaggatgacgcgtgcggggccgcgtcggtactagagcagccgctgcatgaccgcgaggtcaatccagcgagagaacttgcggccgatctcgcgttggatgccgacgagctcgaaccccgctctcgcatgcaacgaccgtgagacgtggtgatcggccacgatatgggcgatgcaggcgtggaagccgaggtcggcggccgtgtcgacgagtgaggtgaggagccgtgtgccgatgccacgcccctgggccgtggggtcgaggtagatcgagtcctcgaccgtcgaggcgtagcctgcgcgcggtcggtagggcgagatcgaggcgaagccgaccacgtccccgttgagctcggcgaccaagcagacgtagatgccgaggtggtcgtcgacccagcgctcgtgttcgctgggtgtgcgcggctcgatgtcgagggtggcggtcgtggtcaggacggcatggttgtagatgcgacgagtcgcctcggcgtcacttggaacgagaggacgaaggatcagcgcatcgtcgggcacgggtctacggtagaggctgtccggccccgaggctcgctcgctatcatggttggaactcgcccccttagctcagtcggcagagcacagccatggtaaggctggtgtcgtcggttcgattccgacagggggctccgtggcggcgtagctcagttggttagagcacacggctcataatcgtggggtcgtcggttcgagtccgaccgccgctactacggaccgtccagcgctggtaggaggatcgatggcgaagaacgaacggcgggtgcaggtgacgctggcgtgcgaggagtgcaagcgtcgcaactacatcacgtcgaagaacaagcagaacgaccgcgaccggatcgagatgcgcaagtactgccggtgggatcgccgccacacgctccatcgcgagaccaggtaggtcccgcgctgactcgggttcgtgctcgggccgctgagctccgtccgggcctcgaagagtccctcgccaaggtccgtgcgcgggctggggacctacgcccgtcgttcgacgaggtcgtgcatcgcacccttgcgatgagcacccgtgtcgcgtcccgcatcgtcggcgatgccgaggcggtgtcggacgtgctccaggacgcgtacctgaacgtgtaccggtcgctcgagcgctttcgcggcgcctcgcgctacgagacgtgggtctaccggatcgtcgtcaacgcggccaggtcgcacctgcgtcggatgcgacggatgcgggcgcgcgagacggtgctggacgaagcggagatcgtcccggctcgttcgggcgaggttctcgaggccgccgatctcgtggcacagcacatcgacgtcgtggcgctccttgcccgactcggggaggccgatcgcgagttgctcacgttgcgctacctcgctggcctgagtgtggcgcaggtggccgccgagctcggtgcgagcgagaatgcgatcaaggtccgcctccaccgagcacggcgtcgcctgttggcccttctggctgccgatgaggagttcgacgacgagggagccgtcagagcctcggtggggtctcccaagcgcggggactggtaagctcgttcggcggcgaagggtagtagctcaattggtagagcaccggtctccaaaaccggcggttgggggttcgagtccctcctgccctgcacgtgctgggtggtggttcacgcggcgcgagacggatcgttgagggtggagctgtgaatcgggagacgaggcgcctcatggcgcgccagcagggcgccacgcgcgaccgccaggagctggctcgacggatggcgcagggctccggggagccacgcaagggccgtatccggcggtacctgcagggggtgcggacggagcttcgtgccgtcgagtggcccactcggcgccaactgcggagctatgcaaccgtggtcttcgtgaccctcgtcctcgtggtagcgctcatcttcttgctgaacgtcgtgttcgccaagggtgtgtcgctgctctacggctagcgcaggtcgcgatcccgtgacgatcgacaacgatggaggcaaggtgagccccgaggagatggaatcgacgcaccagcccgcgctggtccacgatgacgaccgagctgcggagagccgcgaggtcgcatccgctgacgcgccagctgtgcagagccgcgacgatggtgaggcgacggaccccaagggcagcggtgatgacgacgtgagcgctgccgaggattctccgtacgatcgtccgggcgagtggtacgtcgtccactgctactccggctacgagaaccgggttcgccagaacctcgcgacgaggatccgctcgctcggcctcgaggatcgcatcttcgaggtggagatcccgatggaggacgtcaccgagctcaagaacgggcgacgagtgaaggtgcagcgcaaggtctttcctgggtatgtgctcgtacgggccgagatggacgacgaggtctggtccgccatacgcaacacccccggcatcacctcgttcgtcggatcgggatcgaagccggtgccgctgagccgcaaggaagtcgaggcgatgttctcgttcgccacgccggaggagctgcgcccgcagccacaacggcgctcgacgcaagagttcgagatcggcgaaacggtgcgcgtcaaggagggcccgctcgcggacttcgtcggcgaggtggccgaggtgaacgccgatcagctcaagctgaaggtgctcttcaacatcttcggtcgagagacgccggtggaactcgacttcacgcaggtgtcgaaggcctaggcccggtcgagtggcaggggccgactggtagagttgtcggttcgtgtcccgtgtggggcgtcatgggttcgtgacgccaggtgcgcggcggttgtgacgaaacggtagtgacgaaggagtcgttcggtggcgagaaagcgcgtaaccgcggtggtgaagatcaacctgccggccggtgctgcgacgccagcgccgcctgtgggtacggcgctcggcccgcacgggatccagacgatggagttcgtcaagcagtacaacgctgccacggaggcccagcggggacaggtgatcccggtcgaggtgaccatctacgaggatcgctcgttcagcttcgtgctcaagacacccccgaccaccgagctgctcaagcaggctgccggcgtcgacaagggatcaccccagaatcgccgtcaaggtgtcggtacggtgacgcgtgctcaggtcgccgagatcgcgcaggtcaagatgccagacctgaacgcctacgacctcgaggccgcgatgcgccaggtcgagggcacagcgcgatccatggggatcgccgtggtcgagggctagcgagagaagaggacgaggtcgcgagatgaagcactcgaagacgtaccgtgagcaggcagcactgctcgatcgcaatcggctgtactcgcccgtcgaggcgctcgcgctcgtgcgccagctggctcgcgctcgtttcgacgagaccgtcgagctcgccgttcgcctcggcgtcgatccgcgcagggcggaccagatcgtcaggggcaccgtcgccctgccccacggcactgggcgtcgcgtccgcgtcgccgtgttcgcggcgggcgaggccgcccaggaggcgcgtgaggccggagccgacatcgtcggcgccgacgatctcgtcgagcgggttcaaggcggcgcgttggacttcgacgtggccatcgcgacgccggatctcatgggacaggtcggccgtctcggccggatcctcggtccacggggtctgatgccgaacccgaggaccggaaccgtgacccacgacgtggggcgcgcggttcgcgagttcaaggcgggtcgcgtggagttccgcaccgaccgcgtgggcaacgtgcacgtcccgatcggcaaggtgagcttctccaccgtcgcgctgctcgagaacttccgagcggtgatcgacgagctccagcgcgccaagccggcagcggccaaggggcgctacttccgctctgtgcacgtgtcgacgacgatgtcgccgtcggtagcgatcgatccgaatcgactgcgcatcgccgacgaggaactcgaggaactcggagccgcgtaggcggctgcgccaggtaggattgtcccgccatcacctcggtccgctgtagaggtccggtgcccgcaagggctcaaatcccacggtgcgtgggagcctgatgaggcggtctctccggatcgagcaggcactgccaaggagagtgagatcgatggagcatcccaggccgagcaaggtcgccctcgtcgaggcgattcgcgagcggctcgcgacggcagacgcggtgttcgtaaccgagtaccgcggcctgaaggtcgctgagctcgcgtcgctccgacaggagcttcgcgccgtggacgcggagttcaaggttgcgaagaacacgctcgcacgcatcgcggcgcgcgaggcttcgctcgaggcactcgaggcgttcctcgagggccccagcgggctggtgttcgcccgtggtgacgctgcggcgacggccaagcgactgcgcgacttcggccgagcgaatccggcactcatcatcaagggtgggctgctcggtcgcgccgcgatcgacgcagcatcggtgctgcggcttgcggatctcccaagtcgtgaggtgctccttgcgcagttggcaggggcgttcaccgcacccatggcgaacctcgccggggtgctgtcggcgctgcctcgcaacctcgcctacggcctcaaggcactcgccgaccagcgagcggcgtaggcgcgagtcgaccacggagaacaggaggagacagtggcggacatccaggggattttggaccagatctcggagctgacggtcgtcgagctctcggagctggtgaaggcgttcgaggagcgcttcggtgtcacggccgcggcgccggtcgcggtggcggcggtcgccggtgccgctggtggcggcgaggctgcccccgccgaggaggagcagcaggagttcgacgttgtgctcgtctccgcgggtgacaagaagatccaggtcatcaaggaggtgcgcgcactgacgaacctcggcctcaaggaggcgaaggatctcgtcgacgcggcgccgaagccggtgctcgagaaggtctcgaaggaagacgccgagaaggcgaaggctcagctcgagggcgccggcgcgacggtcgagctcaagtagcgagccgtcgacgcaggcggtcgtgcggtctccctgtatgcttaggggagccgtgcgtcgtcccgcaaccacttcgtcttgacgctcacgggcctttgcgcgcccgtgagcgtcttcgtgtctgccgccaccgtgcacgctcggacacgagtggtgcgagcgtcggtcgggcacctgctgtgggtgtgtgcagtccgtcgagtgcaagtcaaccgagtgcatagtcaactgagtgcaaggagtctcccttgatcacgaggcaccgtccgcctgagcgcttcagcttcgcgtccgcgcgcaatgttctgccgctgcccgatctgatcgctgtgcagcgcgactcgttccgctggttcttgaatgaggggctcgcggaggcctttcgagacatctccccgatcgaggactactccggccagctcgcactcgaactcgagtacgaccccagcgatcctgatctcgcgccggtcccgaagttctcggcggaggagtgtcgcgagaaggacatgacctatgccggcccgatcttcgtgcgggctcggttcttgaaccgccagacctacgagatcaagcagcagatcgtgttcatgggcgacttcccgctcatgaccgaccgaggtacgttcatcatcaacgggaccgagcgtgtcgtggtgagccagctcgtccgctcgcccggcgtcttgttccagcccggtcgcgatcagcacaccgtcgtgacggccaccatcaacccctaccgaggggagtggctcgagttcgacgtcgaggcccggccgggtcgcgatatcaatgcggggggccgcgtcgcgcgtaagcgccggctgagcctgttcacggtcctgcgggcggctgggcttgacgaccctgccgatcttgagcgcctggtcgcacacttcgacttcctcgaacctcagtgggccaaggaggaccactcccagacccgcgacgacgccctgatggaggtgttccgtcgggtacgcccgggcgagccgatcaacgtcgaggcggcccgcctctacttcgagaccgcgttcttccagagccggcgctatgacctcacccgcgtgggtcgctacaagatcgacaagcgactcagcgcggagatcgagcgcgtcgaggagatcctcggtcacccgctggatcgaacctcggagtcgccgctcgtgctcagccgtgcggacatcatcgcgaccgcgagctacatgctgcacctggtcgctggcgagcccgggtatcgcttcgacgatcaggaccacttctccaaccggcgggtccgcagcgtcggcgagctgatccagaaccagctcaagatcgggctctcccgcctcgagcgcctcgtccgtgagcgcatgacgacccaggacgtcgaggcgatcacgccgcagagcctcatcaacatccgtccggtggtcgctgcgatcaaggaattcttctccaccagccagctgagccagttcatggaccagaacaacccgctctctggccttgcccacaagcgccgcctgtcggcacttggtccaggtggtctgtcgagggagcgagcgggtttcgaagtacgcgacgtccactcgtcgcactacggacgcatgtgcccgatcgagacaccggaggggccgaacatcggtctcatcggggcgctcgcgagctatgcccgcctgaatcgatacgggttcatcgagaccccatatcggcgtgtggtggacggcaaggtcaccgatgaggtggtctacctgaccgccgacgaggaagaagactacgtcatcgcgcaggcgaacgcgaagctcgacgccgagggtcgcttcgtcgagccgaaggtcctggtgaggcgcggcccgcagggcgcggtcgtgcgggtcggtgccatggcggtctcctacggcgccaccagtgaggtcgagctcgccaccccggacgaggtggacctcatggacgtgagtccggcgcaggtggtctcggtgtcgacgtcgctcatcccgttcgtggagcacgacgacgccaatcgtgcgctcatgggtgccaacatgcagaagcaggcggtgccgctgctcgtccctgaagcgcccttcgtcggtaccggtgtggaagcccgagccggactggacgctggcgacgttcttgtcgccgagggcccaggtgtcgtgtcagaggtgaccggcgcctcgatcgcggtgacctacgacgattccgtgaccgacgatgccggtcggccactcggaacacgtcgctactggctgacgaagttccagcgatccaaccagaacacctgctggaaccagcgtccgacggtggccaccggggaccgggtcgagctcggtgacgtgctcgccgacggtcccgccaccatgcacggtgagctcgcgctggggaagaacctcctcgtggccttcatgccgtgggagggctacaacttcgaggacgccatcatcatctcggagcgcctcgtgcgagacgacgtgctgtcctcgctgcacatcgaggagttcgagaccgatgcgcgcgacaccaagctcggtgccgaggagatcacccgcgacatcccgaacctgtcggaggaggccctcgccgatctcgacgagcgcggcatcgtccgtatcggagccgaggtcggccccggtgacatcctcgtcggcaaggtgacgccgaagggcgagaccgagctcacgccggaggagcgactgctgcgtgcgatcttcggcgagaagtcccgcgaggtccgcgacacctcgctgcgcgtgccccacggtgagtacggcaaggtgatcgacgtcaaggtgtttacccgcgaggacgcgaccgagctgccgcccggcgtgaacgagctggttcgggtgtacgttgcgcagcaccgcaagattcaggtcggtgacaagctcgccggtcggcacgggaacaagggtgtgatctcgcggatcctccccatcgaggacatgcctcgactggaggacggtacgccggtcgacatcatcttgaacccgctcggcgttccgagccgcatgaacatcggccaggtgctcgaggcgcacctcggctatgccgcccggtgggggtgggagcccatcggcgagggcgcacgggagcatcgcaagacgcgtccggtgacggtcccggcccggtgggtggcgagtcccgccttcgacggcgcgcactgggacgagtcggaagaggccggggacctgccgaccatcaaggaactgctcgagcggctgaacccgcagagccgcgacggcgagcgcctcgtccagcccgacggcaaggcggtgctctacaacgggcgcaccggcgagcgctacgacaaccccgtcatggtgggctacgtctacatgctcaagctggcgcacatggtcgatgacaagatccatgctcgctcgacgggcccgtactcgatgatcacgcagcagcccctcggcggcaaggcccagttcggtgggcagcgcttcggtgagatggaggtgtgggccctcgaggcctacggcgccgcgtacgcgctgcaggagctgttgaccatcaagtccgacgacgtcgtaggccgtgtgaaggtctacgaggccatcgtcaagggtgacaacatcccagaaccggggattccggagagcttcaaggtgctcatcaaggagatgcagtcgctgtgtctgaacgtggaggtgctcgctccgaacggagagcgggtgcagctgcgcgagttcgaggatgaggcgtactcggcggcggaggagctcggtatcaacctgagccgccctgagcgcaacacggactacggcgacgacgagcgacgcgaggagaggggtcagtagtgctcgacctgggtcgattcgaccagatccgcatcgggcttgccacgacggaagccatccgcgcctggtcacacggcgaggtgaagaagccggagacgatcaattaccgtacgttgcgtccggaacgcgatgggctcttctgcgagcgcatcttcggccctacgcgcgactgggagtgccagtgcggcaagtacaagcgcgtgcgctttcgcgggatcgtctgcgagcgctgtggcgtcgaggtcacccgctccaaggtccgacgggagcggatgggccacatcgagctcgcagcaccggtggtgcacatttggtacctgcgcgggacgcgttcgtggctggcctacctgctcatggggacctcccccaaggaggagctcaaggccaagcagctggagaaggtgatctacttcgccgccaacttggtgacctgggtcgacgaggagcgtcggcaccaggacctgccgaacctcgaggtcgaggtgctcgaggaggttcgggcgatcgagtcggagcgtgacgtcgagctcgagcgccggtaccaggcgatggaggcggagctcgccgagctcgaggagcagggtgctcgcgaagccgaggtgcgccagcgccagcgcgcgctcgagcgggagatcacgcagctccgcgagcgctacgcggcgcgcatcgacctcgcgcgtaggaccttcgacgagttccgcgagctctacccgcgccagatcatcgaggacgagctgctgtggcgcgagctgcggtcgcggtatggctcctacttcgacggcggcatgggggccgaggcgatcgccgacctcatccgtcgtatcgacttcgatgccgagctggccaagctccgcgagctcatcgaccccgccgagggtcgccgcccgttgtcggcacagcgtcgccagaaagccatccgacgcctgcgcatcctcgccgcgttcaaccagcgcgacgaggagggtcgtcgtatcaacgacccgatggcgatgatcctcgaggtcgtcccggtgatccccccggacctgcgtccgatggtgcagctcgacggcgggcggttcgcgacgtcggacctcaacgatctgtatcggcgcgtgatcaatcgcaacaaccggctcaagcgtttgttggatctcggcgcgccggagatcatcgtcaacaacgagaagcgcatgctccaggaggcggtcgacgccctcttcgacaacggtcgccgtgggcggccggtggtcggcccgggcaaccgtcctctgaagagcctctccgacatgctcaagggcaagcagggtcgcttccgccagaacctgctcggcaagcgcgtggactactccggccggtccgtcatcgtcggcggcccgacgctgcagctccatcagtgtgggctcccgaagatcatggcgctcgagctgttcaagccgttcgtcatgcgtcgcctggtggagttgggctatgcccagaacatcaagtcggccaagcgcatggtcgagcgtcggcgtccccaagtgtgggaagtgctcgagacggtgatcaaggagcatccggtgctcctgaaccgtgcaccgaccctgcaccgactcggcatccaggcgttcgagccggtgctggtcgagggtaaggcgatccagatccatcctctggtgacgaccgcgttcaacgccgacttcgacggcgaccagatggcggtgcatctgcctctgtcgcctgaggcgcaggccgaagcccgcgtgctcatgctctcggcgaacaacacggtgtcgccagcgaccggacggccgatcacggtccccgggctcgacatggtgttcggtctcttctatctcaccatcgtgcgcgaagaggagccaggtgccggcaaggtgttccgccacgactatgaagtggtccgggcctgggaaaccggcaatctcggcttgcacgcgccgatcaccctccgtcgtcgcgatggcgatggcaacgtcgaagagctgcggacgacagccgggcgtgtgatgttcaaccaggcgctgccggccgacttccccttcgtcaacgaggtcgtcgggaagaaggcgcttcccatcggctcgatcgtcgagcgggtggtgacccagtacccccgcaacgtcatcgaggagacgctcgatcgcatcaagtcggttgggttcaccttcgcgacgcgcgctgggctcaccatctcgaccgacgacgtcacaaccccggccgccaaggccgagatcctcgatcgctacgagcgcgaggcggacaaggccgaggcgcagtaccggcgaggcatcatcaccgacgacgagcgcaagcagaaggagatcgagatctggacggcggcgaccgcggagatcggtcgggccatcgacgagatgctcgcctccaacccgctcaatccgctcgcgatgatggtcgagtcgggagcgcgaggcaaccctcagcagatccgccagatctccggcctcaagggcctcgtcgccaatccgcgcggtgagatgattccgcgcccgatcaagtcgtcgttccgtgagggcctcgaggtgctcgagtacttcttgtcgacgcacggtgcgcgcaagggcctcgccgacacggcgctgcgcaccgccgactctgggtatctcacccgtcgcctcgtcgacgtcgcccaggagctgatcgtgcgcgaagaagattgtggcacgtcgcgggggatttggatcgacgacgtcgccgaggactcggcccagcgtcgcagctacctcgagacgcgggcgttcggacgggtcctcgcagaggcggtcgatcttggcgacgggtcgcagctcccggccgggacgttgctcaccgacgagctcgtcaagcagctggcagccgatccggcagtcgagcggatccgtgtgcgcaccccgctcacctgcgagacgccccacggcgtgtgtgcgacctgttacggccaaggttttggggggagggggctcatcgagctcggcgaggccgtcggcgtcgtcgcggcccagtccatcggcgagcctgggacgcagctcaccatgcgaaccttccaccagggcggcgtcgcgggcgccgacatcacgcacggcttgccgcgcgtggtggagctgttcgaggcgcgttcgcctcgtggagccgcggtgctggcgcatgcgtccggtgtcgtgcacatcgaggaggaagagaacggtcggcgggtcaccatcacccacgacgacggctccgacgaggtctacgtgctcccgctcagggcccatctcgaggtggccgagggcgaagtgatcgaggccggcgaggccatcgtgagcggtccgaaggaccccaagcagctcctcgagatcaagggcattcgcgagacccagcgttacctggtcgaggaggtccagaaggtctatcgcgaccagggtgtgtccatccacgacaagcacatcgagctcatcgtccgtcagatgctgcgccgagtgctcgtggccgagcctggcgattcccccttcttgccgggagaacgcgtggacacccagcgctttgccgaggtgaaccgcgaactgttcgccgaggggaagcgccctgccgagggtcggccggagctcatgggtatcaccaaggcgtcgctcgcgacggagtcgtggctctcggcggcctccttccaagagaccactcgggtgctcaccgaggccgcgatcgaggggcgttcggatcacctgctcggcctcaaggagaacatcatcctcggcaagctgatcccggcaggtacgggtgcgccgcgttaccggtcggtcgcggtcaaggctccccactatcgccgactcgcgtactggtcgagcgaggaagacctcggtgggttcgacggggggcctggctatgaggcgcatggcggccctgtagactgagccatacgcgggtggtgcgtgtcgcgtgccaccactgcgaatcgggccggacgcggaggttctcggcgagccggcagaggaaccaggaatgttggagaccggcccgccccgtgtgggcgggccggtccaccgagagcggcgcgcctgcgtcgcaagaaggagtgcaaaccgtgccgacgatcgcgcagctcgtgcgcaagggccgcgaggccaagcgcacgaagaccaagaccccggcgctcaagggatcgccgcagcgccgcggggtgtgcacccgcgtgtacaccaccacaccgaagaagccgaactccgcgttgcgcaaggtcgcgcgcgtccggctcacgagtggcgtcgaggtcactgcctacatccccggtatcggtcacaacctccaggagcactcgatcgtgctcgtgcgtggcggccgcgtcaaggacctccctggtgttcgttacaagatcgtgcgcgggacgctcgatgcggcgggcgtgaagaaccgcaagcaggcgcgcagccgctacggcgcgaagagggagaagtagccgatgccacgcaagggtccagcccaggttcgtccgatcgctcctgaccaggtctaccactcggtgctggtgtcgcagctgaccaacaaggtcctgcgtaacggcaagaaggcgctcgccgagcgtaccgtctacggcgcgctcgaccagatcgctgccaaggtgaacggtgacccggtcgccgtcttggagcgtgcgatctcgaacgtacgccccatgaccgaggtgcggtcacggcgcgtcggcggtgcgacctatcaggtacccgtcgtcgtccgtgatcggcggtcgtactcgctcgccatccgctgggtcgtgaattcggcgcgcgcgcgccgtgagaagaccatggccgagcggctcgccaacgagctgctggatgcgtccaacgggctcggcacgtcggtcaagcggcgggacgacacccacaagatggccgaatccaaccgcgcgttcatgcactatcgctggtaagcaaggagctttccacatgccccccacccgtcaggtcccgctcgagcgcttgcgcaacatcggcatcatggcccacatcgatgccggcaagaccaccacgaccgagcgcattctctactacaccggcaagaactacaagatcggcgaggtccacgagggcgcggcgacgatggactggatgccgcaggagcaagagcgcggcatcaccatcacctcggctgcgacgacggcgttctggcgggatcaccgcatcaacatcatcgacacgcccggtcacgtggacttcacggtcgaggtcgagcggagcctgcgggtgctcgacggggcggtggcggtgttcgacgccgtcgctggtgtcgagccgcagaccgagacggtgtggcgccaagggaacaagtacggcgtgccgcggatctgcttcgtcaacaagatggaccgtgtcggggccaacttcgatcgctgcgtccagatgatccgggatcgcctcgacgccgtcccggcggtgatccagctcccgctcggtgtcgagagctccttccgtggtgtcatcgacgtcgtcggcaagcgcgcgatcgtgtgggacgagggcctcggggagacgttccacgacgagcccatccctgccgagctcgtcgacgctgcagagcaggcgcaccacgatctcatcgacgtgctcgccaatcacgacgaagagctgatggaacgctacctctccgacgaggagatctcggaggagatgctgcgggcctccatccgcgaggcgaccatcaacaatcacgtcgtcccggtgctctgtggctcggcgttcaagaacaagggcgtccagccgctgctcgatgcggtggtggactacctcccgagcccgttggacatcccggccgcgaccgggacgtcgccgaacggcatggacatcatcacacgcgagccgtccgacgatgcgccgtttgcggccctcgcgttcaagatcatgaccgacccttacgtcggcaagctgacgtacttccggatctactcgggcgtcttggagaagggatcgacggtcctcaactccaccaaggacaagcgcgagcggatcggtcgactgctgctcatgcacgccaaccatcgcgaggacatcgaggtcgcccacgctggtgacatcgtcgcggccgtcggcctcaagtcgacgagcaccggcgacacgctgtgcgatccccaggcgcccgtcgtcctcgagagcctcgagttccccgatccggtcattcacgtggcggtggagcccaagaccaagtcggatcaggagaagatgagtcgggcgctctacgcgctcgccgaggaagatccgacgttccgcgttcgctccgaccaggagaccggtcagacggtcatctcggggatgggcgagctgcatctcgaggtcatcgtcgatcggctgctgcgcgagttcaaggtcgaggcgaacgtcggcaagccgcaggtcgcctatcgggaggcgatccgcaagccggtgtcgaaggtcgaggagcgctacgtgcgccagaccggcggccgtggccagtacggtcacgtcgtcatcgacgtcgagccgctcgggcgcggcgaggggtacgagttcgtcgacaagatcaccggtggcgtcatccccaaggagtacatcccagcggtggacgccgggatccaagacgcgctctcgtcggggatcctcgcgggcttcccggtcgtggatctgcgcgtcacgctggtcttcgggtcgtaccacgaggtcgactcctcggagatggcgttccgtatcgccggctcactcgccatcaagaaggcggtgcgcatggcgagtccgtgcctcctcgaaccgatcatggcggtggaggtcgtcacgcccgaggagtacctcggtgacgtgatcggcgatctctcggccaggcgaggcaaggtcgagggcatggagcaggtcggcgtgaaccaggtggtgcgtgcgctcgtgccactcgcggagatgttcggctacgctactgacctgcgttcgcgtacgcaggggcgtgcgagctactcgatggtgttccgggcctaccaagaggttccggattccatcgcgcaggagatcgtcaagcggatcaagggcgagtagacttcagcactcggttatccgtcggcgggttgcgtcatccgggcgcagagggacaacaacggagcaggacaggccatgggcaagcaaaagttcgagcggacgaagccccacatcaacattgggacgatggggcacatcgaccacgggaagaccacgctcaccgcagcgatcacgaaggtcctctcggagaagaaccccaacgtcaagttcaagcccttcgatcagatcgacaatgcgccggaggagaaggctcgcggcatcaccatctcgatctcgcacgtcgagtacgagacggagaagcggcactatgcgcacgtcgacatgccggggcacgctgactacatcaagaacatgatcacgggcgctgcccaggtcgatggtgcgatcctggtggtcgccgcgaccgacggtccgatgccccagacgcgcgagcacgtgctgctcgcccggcaggtgggggtgccctacatcgtggtggcgctcaacaaggcggacatggtcgacgacgaggagctcctcgatctcgtcgagctcgaggtccgagagctgctgaaccagtacgagttcccgggtgacgacaccccgatcgtgcgggtctcggcgctcaaggcgctcgagggcgatccggtctgggaggagaagatcgtcgagctgatgaacgcggtcgacgagtacatcccagagccacagcgtccggtggatcgtccgttcctcatgccgatcgaggacgtgttcacgatctccggccggggtacggtcgtcacgggcaaggtcgagacgggcaaggtccacgtcggcgacgaggtcgagatcgtcggcctgcggcccacgcagaagacggtcgccacgggcgtcgagatgttcaacaagctgctcgacgagggccaggcaggcgacaacatcggtgtcctgctgcgcggcacgaagaagaccgacgtcgagcgcggccaggtgctctgcaagccgggctcgatcaccccgcacacgaccttcgaggccaatgtgtacgtcctgacgaaggacgaaggcggccggcacaagccgttcttcaacaactatcggccgcagttctacttccgtacgaccgacgtcacggggaccatcaccctgccggaaggtacggagatggtgatgcccggcgacaacatcgtcatgaccgtcgagctgctcaagccggtggccatggacgagggtcttcgcttcgccattcgcgagggcggccgtacggtcggcgcgggtcgcgtcgtcaagatcatcaagtagcacgtcagtgcgtcgacgagggccccggcacgtccggggcccttcggcgtcgacggacgaccggagcaccaaggagagccatgagcgacagcagtaagcagcgcatcagggtgcgtttgaagggtttcgaccacgagatcctcgaggcgtcgacccggcgcatcgtcgatacggtgacgaggacccaaggcaaggtggtcgggccggtgcccttgccgaccgacatccaccgctacaccgtcattcgctcgccccataagtacaaggattcgcgcgagcacttcgagatgcgcgtccacaagcggctgctcgacatcgtcgatcactcggccaagaccgtcgacgcgttgaagcggttggagctgccggccggcgtcgatatcgaaatcaagatccagaacgcatagcgagagatcgcagcatgatcggcccgcgcccgagtgcgcgggcagtatgctgcaagagttgtcttgcgtccggtcgtgcctcctctggagggaccttccggcggtttgagcggcgctacccgctcgtacgaggtcagctgcggcgtcgggtggacgctgcgtgaggcgaaggaaccatggcgaggaagacgtttgtcggtgagaaggtcggtatgacccaggtctggaccgagggtgaccgtgccgtcccggtgacggtgatcaaggtcgtcccgacgtgggtcgtgcggacgaagacgccggagcgagatgggtacgaagcggtgcaggtcgcggtgggtcgcgtcaagccgcagcggctgagtcgtccggttgcgggtcagttcgaggcccgaggtgtcgaggccggcgcccgcatcatggagctgcggctcgatggggcgtcgtcgttcgagcccggcgatcagatcgggatcgaggggatcgagccggggatgcgtctcgacgtcgtcggcgtgtcgaagggccacgggttctccggcggtatgaagcgccacaacttccgtgggcagggagcggcccacggtaaccacaagaagcatcgtgctccgggctcgatcggggcgtgcgccacgcccgcacgcgtgttcaaggggacgcgtatggcgggtcagtacggtaccgagcgggtcaccatccataacctcgaggtcgtgcgggctgagcccgagcgccagctcgtgctggtgaagggctcgatccctggtccgcggggcgccatcgtcgtggttcgtgattcggtgaaggggcggaagtagatggcgagcgccaaggtcatcgacgccacgggtcgtacgctgcgcgaagaggaactgccgggcgaggtcttcgcgcacgctcccaacatcgcgctgttgcatcaggttgtcgttgcggagcaggccggtgcgcgccggggaacgcattcgacgaagacgcgggcagaggtcgccggaggcggcgcgaagccctatcgccagaaggggaccggcaacgctcgccagggttcgatccgggcccctcagtacaagggtggcggtatcgttcacggccccaagccgcgcgactactcccagcgcaccccccgcaagatgctgcgcgcggcgctggcacaggcgttgtccgatcgggccagcgccggcgtgatctacgtgctcgaggacgacgtcatcacggcgccgtcgaccaaggcggcgcttgcctgtctgcgcggggctggtctcgaggatcgcaaggtgctcgcgctggtggccggtgcaaccgacgaggccgtcttcaagagcgtgcgcaacctccccacggttcgtgtccatcgggcgggcttggtgctggtaagtgcggttctcgcttccgacgccgtgctgttcacgcgcgcagcgctggcagagctcctcgggcgcgtgggagtggaggttgccaagtgagcggtcgggatccctacgcaaccgtcgtggcccccatcatttcggagaagagctacgggctccgcgaggagggcgtctacgtcttcgaggtggcgcctcgagcgaccaaggtggacgtgcgcgccgcggtcgagcggctcttcggggtgcacgtggtcaaggtcaacacgctcaaccgcaagggcaaggcccgtcggagccgccgaaccggtcgagtcagcgtggagcccacccgcaagctggcctacgtcaccttgcgcgagggcgagcgcatcgagctgttggagagctgagccatggggattcgtaagcgcaagcccacgagtgcgggtcgacggttccagtcgagttcggacttcgcggagatcacgaagcagcgtcccgagcgatcgctggttcgaccgctgtcgggctcgggaggacgcaacgccgacggtcacaagaccgcgcgccatcggggtggcggacacaagcggcagtatcgggtcgtcgacttccgtcgcaagaaggacggtgtgccggcgacggtcgcagcgatcgagtacgaccccaaccgcaatgcgcgcatcgcgctcttgcactatcacgacggcgagaagcgctacatcctcgcgcccaaggggctcacggtggggatgaaggtgagttccgggccggacgccgacatcacggtggggtcggccctcccgctgcgcaacatccccgtcggcaccaccgtccacaacgtggagctccgtcccgggcaaggcggcaagctcgccaggagcgccggtatgggcatccagctcgtcggcaaggacgaggtctacgcgacgctccggctgccctcgaccgagatgcgccgcgtcccgatcgattgtcgtgcgaccgtcggcgaggtcgggaacgccgaggccgagctgatctcgatcggcaaggcgggtcggaaccgctggcgtggcgttcggccgcagacgcgaggcgtcgcgatgaacccggtcgaccacccgctcggtggtggcgaaggcaagacgtcgggtggtcgccatccggtgtctccgtggggcaagccggagggccgcaccaggcggcgtcacctcccgagcgacaagctcatcatccgccgtcgtcgagcccgtggggcgaggaggtagtacgtgccacgcagcgtcagcaagggtccgttcgtcgatgcgcatctgttgaagaaggtcgacgagctcaacgcgtcgggtgacaagcgcgtgatcaagacctggtcgcgtcgttccaccatcattcctgacatggtgggccacaccatcgccgtgcacgacgggcgcaagcacgtgccgatctacgtcacggagtccatggtcggccacaagctcggggagttcgcgccgacgcggacgttccggttccatgccgggcaagagaagacggcgaggaggcggtagtggcagtcacagtgaccgagcgcccgcgctcgcgagcggtgctccggaactacggcgcgtctgcgtcgaaggtgcgagaggttcttggcatcattcgaggcaagccggtcgagcaggccattcgcgaactgtcgctcgtgagccgtggtccggctgaggcggtcggcaagctcctcgcgagtgccgtggccaacgcgacggtccagcacgggctgggcgtgtccgacatggtggtgcggctggcctatgcggacgaagggacgacgctgaagcggtttcggccgcgtgcgcgcggtcgtgcgacgcgcatccgcaagcggacgtgtcacatcacggttgtggtcgaggagatgacgctcgaggagcgccagcgcgccgtggcgcagaccggccgtcgtgccgtgagccgccagcggcgcgtgcagtcctctcgtcgcggacgccagcaggcgcaggcgacctcggcagaggcgacctcggcagaggtggccacttcgcagcccgagatcacgagcgaggcggcagcgtcggagcagacggtcgaggtcacggctgccgaggagcaggttgcagctctcgttgccaccggcgaggagaccggggccgagacgccgagcgccgcctcggaagaggccgccgagggcggggaggagtaggtcgtgggccagaaggtgcatccgtacggcttccgtctcggagtcacgacggactggaagtccaggtggtacgccgataaggactaccagcgttggctgatcgaggacgagcagattcgccagtggctccagcgcgagctgcgcacggcgtcggtgtctcgggtcgacatcgagcgcacccgtgaccgggtgcgcgtggacatccacacggcacgtccgggcatcgtgatcggcaagaagggtgtcgaggtcgagcggttgcggcgggagctggagcggcgctgcgcgccggctcgtgtgcagctgaacgtcgaggagatccgccaaccggatctcgacgcgaccatcgtcgcccagagcatcgccgaccagatcagccggcgcgtgagctttcgccgagcgatgaagcgtgcgatccaggtggcgatgaaggaaggcgcgcgtggcatcactgcccagtgctctggtcggctcggtggcgcggagatggctcgccgagagacccatcgcgagggtcgggtgccgcgtcacacgttgcgtgccgacatcgattttggcctgcgtgaggcgcgaacgacctacgggcagatcggcgtgaaggtctggatctacaagggtgacgtcgtcccctaccagacgctgacctcccagccgcagcggccgccggtcgcgggtggtcgtccgaccggaccgatccgcgcccagactggatcgcggcgtcggcccgtggccgaggcaccgaagccggccgcggtgggtgcggagagtcaggacgagttcgagcgcttgctcgccgaagaggaggagatcgagcgacgtacccgtgaggagggtcgcgaggctccacacttcaagaaggaggtggactagcgatgctcatgccacgcaaggtgaagcaccgcaaagtccagcggggacggctcggcggagaggccaagggtggtaccgagatcaccttcggtcgctacggtatccaggccctcgagccagcgtgggtgacggctcgccagatcgaggccgcgcgtatcgcgatgacgcggcacgtgcgtcgcggtggcaaggtctggattcgcatcttcccggacaagcccatcaccaagaagccggctgagactcggatgggttcgggcaagggcaacccggagttctgggtcgcggtggtcaagcctgggcgcattctcttcgagctcgacggcgtgggcgaggagctcgcccgtgccgccatggagcgcgcgatccagaagctgccgatgaaggcacgcttcgtggtgcgcgaggacgtggaagcgttggcgggaggcgccagatgacgagggcacgagagctgcgcgacctgagcccggaggcgctcgaggagcgactcggttcgctcaagcgagagctgctcgagttgcggttcgcgatcgcgaccggccagggaacccagacggcgcggttggggcagctccgcagagagattgcccgtgtggagacggtgcgacgcgaggcggcgtcggcgaccgagacgacccgagtgacgcgggcgaggagcaggagacggtgagcgaggagcagcagcaagagcgaccccggcgcaaggtccgcgaagggatcgtggcaagcgccaagatggacaagaccatcgtggtggagatccatcagcgggttcgtcacccgcgctaccagcgcacgatcgcgcgtcggcgtcggctgtacgcgcacgacccggcgaacgaggctcgcgagggcgaccgtgtcgagatcgccgagacgcggccgctgtcgcggctgaagcgctggcgtctcgttcgaatcgtggagcgtgcacggtgatccagcaggagactcgactgaaggtggcggacaactcgggcgcgcgcgaagtgctctgcatccgcgtgctcggtggttcgcgtcgtcgctacgcgagcattggtgacgtgttcgtcgcgacggtcaaggacgcactccccggcgcggccgtcaagaagggcgacgtggtcaagtgcgtcgtcgtgcgtactcgcaaggaggtacgtcggccggatgggtcctacatccgcttcgacgacaacgctgcagtgctgatcaacgaccagctgcagccccgtgggacgcgcatcttcgggccggtcgggcgcgagctgcgtgacaagcggttcatgcgcatcgtgtcgttggcaccggaggtgatctgagtgcgcattcgtaagggagatcgggtccgcgtgatcgcggggaagtggcgcggggccgagggcgaggtgcttcgggcgcttccggcgcgccatcgcgtggtcgtcgacggggtggcggtcgccaagcgccacaccaaggcgcgcgatgcgtcgagcccgagcgggatcctcgagaagaccctgccgatcgacgtctcgaacgtgatgatcatctgccgcgcatgtgggccgacgcgcatcgcgatgaaggtcgacgacgccggccgtcgccagcgggtctgtcgacgctgtggaggagcgctgtgatggttcagaccgatacggcccccaggccgcggctacgggtgcgcttcgacgaggaagtgcgccccgcattgttccgagatctcggtctcgagaacgtcaaccaggtgcccaggctcgccaagatcgtggtcaacatgggcgtagggcgggccagcgcacagccgagtctgctcgagggagcggtccgcgacctggagacgatcacgggccagcgcccgtcgatccgcagggctcgcaagtccatcgcgggcttcaagctgcgcgagggcatggcgatcggggcgacggtgaccctgcgcggcgaccgcatgtgggagttctacgatcggctggtcgcggtcgcgattccccgcatccgtgacttccgcgggctcaatccccggtcgttcgacgggcacggcaactacacctttggcgtcacggagcagctgatctttccggagatcgactacgactcggtcgacaccacgcgtggtatggacatcaccatcgtcacgaccgcaacgacggacgcgcatgggcgtgctctgctcgaagcgctcggttttccgtttcggagggaagggtaatggcgacgaaggcgctgatcgcgaaggcgaaccgcgtgccaaagttccgtgtgcgggcctacacccgctgcaagcggtgcgggcggccgcacgcggtctaccgcaagttcgggctgtgccgtatctgcctgcgcgagatggcgcacctcggcgaggtgcccggcgtgaccaaggccagctggtaagggggtaggcgaatggcaatgaccgaccctatcgccgacatgctcacgcggatccgcaatgcgtcccgcgcgcgccacgcctcggtgacgatgccgagctccaagctcaaggtggagatcgcgcgcatcctcaagcgcgagggtttcatccaggactatgcggagcgcgagagcgccgtggggccgcgcaaggatctcgtgatcgagctgcgctacgtcggtgatcgacgtgcgtcgtcggcgatccacggcatcgagcgcatctcgaagcccgggctgcgcgtctatcgacaggccgggtcgctcgagcgggtgctcggaggcatggggatcgcggtggtgtccacctcgcacgggctcatgacggaccgtgaggcccgagcccgacgcgttggtggcgaagtgatctgtcacgtctggtaggaggaacgatgtcgcggattgggaggcaacccatcgcggtgcctggcggcgtcgaggtggcggtggatggccagcacgtgtcggtgcgcgggccgaggggttcgctcgctcgcgacctgccgccggaggtcacggtgagcgtggtcgacagcgtggtgcacgtcgaacggagcgatgactcgaggcgcgctcgggccatgcacgggctctcacggacgctggtcgcgaacatggtgcgcggtgtggccgagggctacgagaagacactggagatcatcggaacgggctatcgcgcccaggcgcgtggcaccggcgaactcgagctcgcgctcggcttctcgcacccagtcgtggtcgaggcgcccgatggcatcgcgtttgcgacgccgacgccccagcgcgtcgtggtctcgggcatcgacaaggaactcgttggacaggtggcggccaatatccgccgcatccgcaagccagagccctacaagggcaagggtgtgcgctacctcggcgagcgggttgtccgtaaggccggcaaggccgggaagtaggtaggagacgatggcaacgctgtcacgggaggatcgtcggcgccgtcggcacgcgcgtgtgcgccgcagggtcgtcggtacgagcgaacggccccggctggcggtcttccgatcgaatcggcatatcttcgctcagatcatcgacgacacggctgggcgtacggtggccgctgcctcgacggtcgagccagagctgcgcgatgggcgcaccggctcgacggagggtgcggcgtcggtcgggcggctcgtcgcgagtcgtgcgttggcgctcggggttcgccgcgtcgtgttcgatcgaggtgggttccagtaccacggtcggatcgcggcgttggccgacgcggctcgcgaagcgggattggagttctaggtggcgacaaacgagttcgaagaccgcaccatcaaggtcaatcgggtatcgaaggtcgtcaagggcggtcgtcgattctccttcacggcgctcatggtcgtcggtgatcacgcgggccaggtggggctcggctacggcaaggccaaggaggcgagcctcgccgtgcagaagggggtcgacgaggccaagcgcaagctggtgcgcgtgccgctcgtccacgggaccatcccgcacgcggtggtcggcgtcgcgggagcggggagggtcttgctcaagcctgccgcacccggtacgggtgtgatcgccggcggtgctgcgcgcgcgatcttggagcttgccggcgtcaccgacgtgctggcgaagtccctcggttcctcgaacggcattaacgtggcctatgccacactcgcaggactcgaggcgttgctctcgccgcagcgcatcgccgaggctcgtggtcgttacgtggatcaagtcgctcctcgatggctcatcgaggagagtccggcgcgtgtcgatggagaagtcgtggaggttggggccgatggctaggcagctgcgcatcgtgcaggtccgctcggcgatcggtgccaagcccgagcaccggggcacgctgcgcgcgctcgggctcggacgcatcgggcgggagcgtgcgctcccggatcgtcccgagatccgcgggatgctggctcgcgtcgcccatctcgtcgtcgtccgtgaggaggaacaggcatgatttacctccatgatctcaagcccgccgagggttcgcaccatcgcaagcggcgcgtcggtcgtggcatcgcgggcaagggcggcaagaccgccggccgcggcacgaagggtcaaggcgctcgcgatacggttcccgtcggcttcgagggcggccagctgcccttgacgcagcgcacgccgaagctgcggggctttcgcaacccgttccgggttgcctatacggtcgtcaacctcgaccagcttgctcggcttggcgaggagggcatggccgaggtcgatccgacgtcgctggtcgcgcgcggggtggttcgtcgcggcgcgctcgtgaaggtctgtgctcgcggagagctgcatgcacccctcgtcgtgcgcgcccatgggttctcgcaggcggcgaaggcggcgatcgaggctgctggcggccgtgtcgagacggtcgcggtccccttcaagggtcctcggcctcgcgctgccggcagcgcgttgtccaaccgctgagcacgatcggcggggaggcaccgtgatcgagaatttcctgaacatcgtccgggtgagggacctgcgcaacaaggtcctgttcacgttggcgatgatcggcctgtaccagttgggttcgaacatcccggtgcccgggatcagctaccacgcgatccaacaggtcttctcggaggcctcgggccagggtgtcctcggcttcctcgacctcttctctggcggtgcgctgtcgcgcgcggcactgttcgggttgggtgtgatgccctacatcacctcgtcgatcatcatccagctgctcaccggcgtcattccgaagctctatcagtggcgggacgagggatcgtctggcgagcgcaagatcacccagacgacgcgctatctcaccatcgggctcgcgctcgtacaggccactggcctcgtgttcgtgttccactcggggctcggcctgttccttgcgaacggtcagagcgtggacctgatcccgcagttcacggtgttgcgggtgctgttcatcattctgaccctgaccgccggtacggcgctcgtgatgtggatgggcgagctgatcaccgagcgcggggtcggccaagggatgagcatcctcatcttcgccaacgtcgtgagcgtgatcccgaccgcggggcgcctgatctatgaccaggcgggcgcgctcaagctcatcgtgatcgtggtcgtggtggtcgcgctcctcgttgcgatcgtcttcgtggagctcgggcagcggcgtatccccgtcgtgttcgcgaggcgcgtcgtcgggcgtcgcatgtacgagggcgggcggacgtacatcccgctcaaggtgaaccaagctggggtggtgccgatcatcttcgccgcctccatcttgtacttcccggtgctgctctcgaacatcgtgcgctggaagccgctcgtcaccttcgtcaacgatcacctgctcaacgccacgagtggcttctacatcgtgacctacgggctcttgatcttggtcttcacgttcttctacgtgacggtgtcgttcgacccgtaccagcaagccgacatcatccgacagcaaaacggctacatcccgggcgtgcggccgggcgaggagaccaggcggtacctgtctcggatcttgaaccgcatcaccctcccgggcgccgtgttcctcgctgccgtcgccgtgatcccatcgattctgctcgctgcgtggcacgtgacgtcgttcccgtacgcgggtacgaccatcctgatcgccgtcggtgtcggtctcgagaccgtgaagcaggtgaactcacaactcaccatgcgcaactacgagggattcttgcgctagatgggggacgcggcacttcggcttgcgctgctcggtcgacagggcgcgggcaaaggcacgcaggcggtgcggatctcgcaccactttgcgatcgcgcacatcgccactggggacatcttgcgagctgcggtgcgcgccggtacgccgttcggggagaaggccaaggcctacctcgatcggggcgaactggttcccgacgcggtgatcatcggtgtcgtcgccgagcgcctctccgaggccgatgcgacgcgacggggcttcgtcctcgacggctttccacggaccgtcgagcaggcggaggcgctcgagggtctgctcgctccgcatggactcgacgtcgtgatcgatctcgaggtgcctgagtggctcgtgctggagcggctggcgtctcgccgggtgtgttcggtgtgcggtgccaactactccacgtccatgccgcctcgggtggactggacgtgtgacctgtgcggtggtgaggtggtccagcgtgcggacgataccgaggaggccatccgacgccgcctggacgcctacgagcgccagacgaccccactcatcgagtactaccgggagcgggagctcctcgaggtcgtcgacggtgtcgggggcccagaggaggtcatggagcgcatcctcgaggcacttgcccgacacggtgtggtggaggagggtcgatgaggcgttcggcgacagagcttgcgtcgatgcgcaaggcggggcgcgtcaccgcagcgatgctggaggcgacccgtgaggcggtcaagcccggcatctcgaccgcagccctggatgcgatcgcgcgctcggtgctcgagcgcgagggtgcgcggtcgaacttcctcggttacggcgggttcccggccgtgatctgcacctcgcgcaacgaggtcatcgtgcacggtatccctcgagaggacgagatcctcgaggagggggacgtgctgtcgatcgacgccggcgcgatcgtcgacggctaccacggagacgccgccatcacggtgcccgttggcgaggtctcgaaggctgcggcccgcctcatcgaggtgacccgtgaggcactgtgggcgggcatcgagaccatgcggccggggtcacatctccacgagatcggccgagccgtggaacgcgtggcgaagcggcaccactacggcgtgatccgcgactacgtggggcacgggatcggcaccgagatgcacgaagccccgaacgtgcccaactactggcccggtacgcccggccccacgctcctcgccggggaggtgttcgccgtggagcccatgttcacgctcggcacggaacgcacgagggttctgcgcgatggctggagcgtggtcaccgccgacgggacgtgggcggctcacttcgagcacaccatcgcggtgacggaggacggacccgaggtcttcaccctgggcccggatggccgttgaggcgagcgcactatactgcgtaggcaccggttttgcgcccgtcgccacgtcgtggcgtgtccgggcacgaacgatcgagagtaggaggacccactggcaaagggcaaggaggacacgatcgtcctcgagggcacggtggtcgagccgctgccgaacgcgatgttccgtgtcgagctcgagaacgggcacaaggtactcgcgcactcctcgggcaagatgcgcatgcatcgtatccgcattcttcccggagatcgtgtccaggtggagttcaccccctacgacctcacgagggggcggatcacctaccgctacaagtaggtccggagccagcgggtgcaaggtcgacggatcggttccggccagatccgtgtactgacagagaggaagccgacgtgaaggttcgtccgagcgtcaagccgatgtgtgagaagtgcaaggtgattcggcgcgagggtcgcgtgctcgtgatttgcgagaacccgcgccacaagcagaggcaggggtagacgatggcccgtatcgcaggtgtcgacatcccgcgtgagaagcgggtcgaggtcgcgctgacctacatctacggaatcggcccgacgctcgcgcgtcaggtgctcgaggccaccggggtcaatcccgatacgcgcgtgcgcaacctcaccgacgaggaggtcctcgcgctccgcagctggatcgatcagaacctgaaggtcgagggcgatctgcggcgcgaggtcgaccagaacatcaagcgcaagatccagatcgggtgctaccagggtatccgccatcgtcgcgggctgccggtccgcggacagcgaacccacaccaacgctcgtacccgcaaggggccgcgcaagacggtggcgggcaagaagaaggcacgccgctaggcgctcatgcgggcacgcgagcgtgctcgcggtgggcgaacgagtggagccagagtctctggctccgagggatgaacgagggaggttccccgtcggcgtggccggcacgggggaaccgaagaggacgcgagctgagcctcgccgagcaaggagcacacagagcgcatggcacgaccgaaggtaggagggcggcggccccggcggcgcgaacgcaagagcatcgcgcgtggggtcgctcacatccactcgtcgttcaacaacacgatcgtcaccatcaccgacccggctgggaacgtgatcgcgtgggcgagttctggcaacgtcggcttcaagggatcgcgcaagtcgaccccgttcgccgctcaggtcgcgggtgagacctgcgccaagcgagcgatggagcacggtgtgcgcgaggtggatgtctacctgaaggggccgggatcgggccgcgagacggcccacaaggcgctcgctggtgcggggatcgagattcgttcgatccgagacgtgacacccgtgccgcacaacggctgccgtccgaagaagaggagaagggtctagatggcgcgctacaccggaccggtgtgccggctgtgccggcgtgagcggacgaagttgttcctcaaggggccgaagtgcatgagcgcgaagtgccccattacccaaggccgggttcctccaggccagcatggtcgggatcggcagcgtcaaccgtccgagtacgcgatccagctgcgcgagaagcagcgcgcgcgccgaacctatggcgtcatgggcaagcagttccagcgcttctatcgtgacgcggcgcggcggtcggggatcacaggcgagaacttgctcgccttgctcgagcttcggctcgacaatgtggtcttccgtgccctgtggggctcctcacgggcgcaggcgcgtcagctcgtccgccatggccacgtcctcgtcgacggtcagcgggtggatatcccgagctatcgcctccggccggggcaggtcgtgacgctgaatcccaaggcgcgtgacctcgacatcattgcgttcaaccgagagcacctgacccgtgaggtcccggcgtggctcgaggtcaccgacggggggtctggagtacgcgtgctcagcgtgccgctgcgcgaccagatcgacaccgaggtccgcgagcagctcatcgtcgagctcttctccaagtagcacgcttctcgaagtagcgaggcagcaaccatcagtcagaaggaaccaaccatgcttgtcatgcaacgccccacggtcgagtcgctcggtgacgaggtcgacaatcgtcaacggttcgccatcggaccactcgagccagggttcggccactcgatcgggaacgcgctgcggcgtgtgctcatctcgtcggtcccgggcgcggccatcacgcaggtccgtttcgatgatgcgctgcacgagttcacgacgatccccggggtgaaggaagatgtgatcgacatcatcttgaacctcaaggacatcgtgtggcgttcgtggagtgaagagccggtcacggtgaggctcgacgttcgtggccccaaggaggtcacggcgggagacttcatgctcccctccgacgtggaggtcatcaaccgcgatctccatatcgcttcggtgtcggagcacggtcggttgggtctcgatgcggtggtcgagcaggggcgcggctacgtgtcggcggagggcaacaagcgcaccaccaccatcggcatcatcgcgatcgacgcgatcttctcccctgtgcgtcacgtcaactaccgcgtcgagccggttcgtgtcggtcagtcgacggacttcgaccaggtggtgctggaggtcgagaccgatggctccgtgacgccacgggaggccgtcgcctctgcggcccggacgctcaccagcttgttcggcctcgtcgccgagctcgcgaccgacgtcaatgcgctcgaggtcgccgcgaccgccgacgacagcgtgcgaccggccgagtacgacctccccatcgaggaactcgagctcacggagcggccgcggaactgcttgaagcgggcgagcatcaacaccatcggtgatctggtcgagcgcacccctgaggatctgttgtcgatcacgaacttcggccagaagtcgctcgacgaggtcgtcgagcgcttgacccagcgcggacttgagttgaggaagagggactgacgtggttccaggtcgaccgaagaagggtaaccgactgggcaaggacgctgcccaccagcgagccatgctggcgaaccttgcggcgtcgctcatcgaggccgagtccatccagaccaccgaggccaaggcgcgagccctgcgcccggtcgtggagaagctcgtcaccaaggcgaaggcgggcgatctgcaccgtcggcggcaggtgttggcgttcctgcgcgacgaggatgcgaccaccaagctgttctcgaccgtggggccgcgctatcagaatcgacagggtggctacgtgcgcgtcttgaagctcggcccgcgtcgtggcgatggcgcccccatggtggtcgtcgagttcgtctgaccggcgctcctcgcgcgaggcggcccctgcgtggtggtcggtctccgggaggtgtcgacgggtaggagcccaggtgggagcagtggagaccctcctgctcgtcgttggctacgacgggcgggagttcgcgggcgctgccccgcagccgggagtgcggaccgtcgtcggtgcgctgcgctccgcgctcgagctcgtgttgcaacgaccaacgtcgcttgcgatcgcaggtcggacggacgccggtgtccacgcgcgtgcgcagctcgtgagcgtacccctccagcccggggagcgggcgcggctcggggatgtggagcgtctgtgtgggcgactcggtcgactcgccggtcgggggctctgggtcaggagcgcaggcgtgctccctgggtccgtcgacgcacgcagggtcgcccgctggcgacactacctctaccggctcgatctcggccatggggaccgtcggggtcgggtgatactcgagccgacggcctgggcgtgtgggccgctcgagctcgacgtgctcgctggcgcgctcgcgacgttgcgaggcgacctcgatgcgaccggactgtgtcgtgccggcgccgcgggaggctatcgtcgcagggtgctctcgacgcgggtctgggcgcgcgcacgagatcgtgtcgacgtctccgtcatcggggtgtcgttctgccacgagttcgttcgtcgagcagtcgggaacgcggtcgcggtggcgcagggccggctcgacggggagcgctggcgcgagggtgtcgaccgaggcgagcgggcgctgctcgcgacggtggcgccaccgtggggcttgtcgctgtggcgcgtcgggctcgaggacggctgggagtggtcggaggagcgactcgcgcgcctggggtcggatgccgactggcgtacgctcgatccgcgcgaagagcccgcggtgtggggcgcagcacgaggcgcagaccggtagactgtcgcggtgcgctcacgcgggcgtctcgctgtgggccgcgcgtgagtgcggcgctcgaggctgaacgcagtgacgagcgtcgatggcgcgggcaccgacggcatggtcggtcgaggcagtggtcggtcgagcccagcggcgtctcgtggttggcgggcccggagcgggttggcgtggaaaggacttcggcggtgaggacgtacagtcccaaggcggctgagatcagccgcacctggtgggtggtggacgcggaagacgtcgtcctcggacggctcgcaaccgaggtggctcgggtgttgcgcgggaagcacaagccgacgttcacgccgcatctcgacatgggcgatcacgtcatcgtcgtgaacgcggacaagatccgggtcacctccgacaagggtgccacgaagcgctactggcgtcactcgggttatcccggcggcattcgctccgagacgctggcggaacggctcgcacgccaccccgagcgggtcgtggaggccgcggtgcggggcatgctcccgaagaatcgcctcggcagggcgatgtatcgcaagttgaaggtctacgccggccccgagcatccgcaccaggcgcagcagcctcgagtcctgtcgctcggtcagccgagcctcgtcacccaaggggagcacgcatgagccagacgctcgttcaggccacgggccgccggaagacggcggttgctcgagtccgtctcgtgccagggtcgggttctgtcatggtcaacggcaaggagctcgcatcgctcccggtgacgctggcccagcgtgcgttcatcaccgaaccgctgcgactcgccgaactcaccgagacctacgacgtcgtggcgcgcgtggacggtggtggcgtcgccggtcaggtcgcggcgctgcgccacggccttgcgcgagcgatcgcggaactccaccccgagctgcgcgtgcgcttgaagcgcgagggcatgctcacgcgcgatgctcgtgagaaggagtcgaagaagtacgggctcaagaaggctcgcaaggctccgcagtactccaagcgctaatgctgaccttcggcacggatggtatccgcggccgagccaaccaggagctcaccatggaggtgggcctctggatcggggtcgcgatcgccgaggtgctcggtggcaccacggtcgcgatcggtcgggacacccgtgcgtccggtcgctggctgtccgaggccgtgggtctggggctcgccgcttcgggcgtggatgtggtcgatgttggggtggccccgaccggggcgctctcgttcgttgcgcgcaccgagcagctcccgaccgtcgtcgtctcggcgtcgcacaatccgttctacgacaacgggatcaaggtgttcgctcccacgggagccaagatcgagcccgccgtcgaacgtgccatcgaggagcgtctcgcgacgcatcttggtggcgatcggccgacgttcggacctctcggccgctaccggtcgtcgtcgttcctggacgcctacgtcgcttggctcgccggtgccgtgtcgatcgagggtgcgccacgcgtgtgcatcgatgcggccaacggtgccgcggcggtcgtcgcctcgcgtgtgctcgaggccgctggtgccagggtcatcggtgccatcggggtcgagccggacggtgagaacatcaacgcgggcctcggagccctgcaccccgagaggcttggccatctggtgctcgcgacgggcgccgatcttgggctcgccttcgacggtgatgctgatcggctgatcgccgtcgcgccgagcggagcggtggtcgacggtgacgacgtcttggtgatcgtcgccgaggcgctggcggccgatggtcggctcgcgggccctggcgtggtcgcgaccgtcatgagccatctggggctcgagcgcaccctcggaccgcagggcatcgcggtggaacggaccggtgtgggcgatcgcgaggtcgctggagggctcgtcgagaccggctacgggctcgggggtgagcagagcgggcacatcatcttccccgcgctcgccccgaccggtgatgggctcctcacggcgctcatgctgctccaggcgctcggtaggctcggcgtccatgccgacgaggccttggcggcccgcgtgcgctacccacagatccaccgcaaggtccaggcacggcacggccgagccgtgctcgactcggagctggtggtcgaggcgctgcgcaaggccgaggagcggctcggcgaggaaggccgcttcgtcgtgcgacccagcggtaccgagccgatcgttcgcatcatggtcgaggcgacgacggagccggtcgcgatcgaggtcgccgagtcgatcgaggcagcggtgcgcctcgcgacctcgacccttggcgactgagcgcggctacgctcggtcaacgaccaggtccgcgcgtggcgcgggcagaaggaggccggtgtgtgcgggatcgtgggagcagtcggcaccggggatatcgcgggtgcggtcttcgaaggcctgcgacgactcgagtatcggggctatgactctgcgggcctcgccatcgtcgacgacgctgggatcatcgaggtcgccaaggccgcgcacgcgcgcacctcgctcgccgagctgaaggacagcgtggatgcgttcgatggtcggggggcgcgtgtcggtgtcggtcatacgcgctgggcgacccatggtgccccggtgctcgtgaacgcccatccccacctcgattgcacccatcgcgtcgcggtggtccacaacgggatcgtcgagaacttccggagcttgcgtgaggagctcctggagcggggccatcgtctcgtctccgacaccgacacggaggtgatcgcgcacctgctcgaagagcagctcgtcgatgaggcgcccgacgtggcgctcgcgtcggtgttcgcgaggctcgtcggccacatggcgatcgcggttgcgctcgccgaccatccggggctggtactggcgatccggcgaaccagtccgctcatgggtgcgcgcagcgtcgatgccgagttcgttgcgtccgacgtccccggggtcttgcaccgtgccacggagttcttcgaggtgcccgaggacgaggtggtcgccatcggtccggaggcggcgggcctgtcacgggctcggcgcctcgaggaactggtccgaccccagatcagctggacgagccaagacgtggaactcggcgggtacgcgagcttctacgagatggagctcgccgcaggcgccgaagcgctgtcacagacggtcgcgtcgttggtcgacgtggacgggtcggcgatcatggacgccctcgacgtcgatcccttcgagctcaagcgcatccgcaaggtcgtcgtcgtcggggccggcacgagctaccacgcgggcctcgtcggccgtttcgccatcgagcactacgcgcgcgtgccggtcgaggtggacgtcgcgagcgagtaccgctatcgcgatccgatcgtcgacgacgggaccttggtcatcgccgtgtcgcagtcgggggagtcgctcgacaccatcgtcgcggtccgtgaggcgatggctgcgggtgcgcgcgcgatcgccatcacgaacgtggtcggctcgcagctcgctcgggtcgctgacggcgtcctctacacgagggcagggcccgaggtctcggtcgcggcaacgaagacccacctcgcccagctcgccgccctcgagctgctcgcgctctggctcggggagctccgcggcgtcttgttccccgaggaggccatcgagcggcggcgggcactcggcgaggtggcacaggcggtcggatccgtcctcgagcagaccgaagcgctcggagcgacgttccgcgagctcgcatccagccaacggttcttcttcatcggccgcaacgtcgccctcccggtcgcgatggaaggggcgctcaagctgaaggagttgagctaccttcctgccgaggcgtacgcggccggcgaactcaagcatggaccgatcgcgatgctcgatcgggaggcggtggtggtcgccctcgttcccgccgaccgactgcggccgaaggccctcgccaacctcgaggaggtcaaggcgcgcggtgccaccctcgtcgcggtggtcgcgggtgaggacgcgcgcgtcacggagttgtccgacgtcgtggtcgaggtgccggcgacgccgccactgctgttcccgttcgtcggcgtcgtgccgctccaggtcttcgccggcacgatcgcgcgcgaacgcggactcgatctcgaccgccctcggaacctcgccaagacggtgaccgtcgagtagggcacctccccgggtccgcgaccgccgtggaccaccagcgggtggcgcctcgcgaatcggctcgactcgaacgtcggggttgcatgctccacacgacgcagcaccgctcttcggagcggtgctgcgtcgtgtgggaggctgcgtgcgtgcgcgctgcgctcagtcggcgagggcgaggccggtcactgatcggcggcgatcggcgatcgcagcgtgcagggtgcggagcgccaccatcgtccacagggcgaccagtgcgacggcgagcccgaccgcgaggtcgtggatcggggagacgtgggtcgcgatcgcgatctcgccaaccccagtcgtgaggacgccgagcgggaaggtgaagccccaccagccgatcgtgaagggataggtgccgcgccgtaggtactcgagggagagggcgccggcgacgaggagccaccagaggccgtagccagcgaggatgagcgcgccgacgacaccggcaccagcgagcgtggtcgagagcgcggacggcgtgagcacggtgagatcgtgaccgagggcggcgatggcggcggccccggtaccgagcgggccgaggatgagccaggtcgatgtggcgaggtgcggtgcggggaggtgatgggtgacgaggcgaagcgtgatgagggcgatcagcgacaacgcaagaggcaccgagaaggcccagaggagatagccgccccagacggcgtcgaccgcgagtgcgtggtcgaaccggggcgcgacgagcgcgagctgaaaggccgtgacctcggcggggacgatcgggaggagccaggttgcgttgacgtcttcgagcgtggcgagatggtgcgcgaagaggcggtagggcacgtagaggacggagacgagggtcatgacgagcgtgaggacgagccacacgcccagcccttcggtcgtcgcggcgtgggagcccagcacgttgggttcgagcttgtcgatgccgttcgagaccgacgacatcgccatcggcacacatccaaggaacagcacccgtgcagggttgtcgaggagctggcggaggcggaggcggtgccgggcaaaggtgatcacggtgatgagcgcgagtatgaggaggccgatcgcgttggcgacgacgatgatccggccgatggtcgtcagggcgggcgagatcgtcgggagcaggacaccgacgatgccggtgcccatgatgagcgagtagtactcgaagccgagtgagggcaaccgtcgagcggtgggccgagatgcggtgtggttcatcgatgctcctaccgtgggttggaagtggtttcgtgctgtgaactatcatggcggtagcgaaacgaaggtatgctaaaagtaatgaaacttactgattccatcactgagcgaatgattacggtcgacgagcgccggatcgatccgacgtacctcgtgacgctcgccgtggtggccgagacgcacaacctctcggacgcagcgaagatcctcggcatctcgcagcccggcgtttcgcagcagctcaagcacctctccgaagccgtgggccagcgcctccacgtccgctcgggtcacggggtcgagctgacggtcgcgggtctcgatcttgcgcggcgggctcgtgacgtgctgcgctcctggcgaggcgtgctcgactacgtcgagagcgtccgccagggcaacgacggcatgctgctcttggccgcgtccaacaccgtgtctgcctacgtcgtgccccgctggctggttcggttccgccagcgctatcccggcgtcgacctgcggagccgttcgctgaactcggccgaagtcgtcgagcgcgtcatcgacggcgaggccgaggtgggcgtgatcgagtcaccggtcgagtcgttgccccctgagctggtcgagatcgtggtgggcggcgatcgcctcgtctacgtggtcagtccggcagtggtcagcttcgcgaacaaccaggtcgtcggttggggcgaagtggcgaggatcccgctcgtgctgcgggaagtgggttcgggtgttcgacgcgccagtgagcaggcactgcgcgctcgtggactggccccccggctcgagctcgagctcgctggcggtgaggcggtcaaggaggcgatcctccagggggtcggcggtggcttcttgtcgtcgctcgcggtcgcgcgcgagctcgcgaccggtgagctggtcacgctcgtcattcgcgagctcgataccatcgctcgactgtttcgcatcatctgtcggcccaaggacgacctctccctgccggcgcagcgctttctcgagatcgccgaggcggtcggcgttgcggagccggtctagatgcaggtcgtgaccgggatcgacgtggtcgaggtcgaacgcttccggacggtgctgctgcgaacaccgaccctcgccgagcgcgtcttcaccgaggccgagcgcgacagcgcgaagggtcgaccggcccagctcgcggggcgcttcgccgtgaaggaggctgcgttgaaggcgctcggcgtcgggatcggtgcggtccccttgcgcgaactcgaggtggtgtccgatccgtcgggggcgccgcgactcgagctcggccccggggcgcgagccttggccgatcgacgaggctggtcgtcggtgagctgttcgatctcgcacgagcgttcggtcgcggtggcggtggtggtcgccttggtggtctgatcggaccgatgccctaggcttggcgctcggcccggaggaggccgccactgggcgatcactgggccgccactggggaggtgtgcgtgcaaccgatcgtccgacgtgctggcgtccgagccctcgacgagcgactggcccgcgagggcctcgtggacgcgacgatcgaacgggtcggccgcgccgtcgcgcgtgagctgcgtcgatccaggggagggctctacggtacccgcgtcgtcgtgatcgccggtcccggtaacaacggtcgcgacggcgtcgccaccgcgcgagcgctcgcgggctggggagcgagtgtgcgggtggagtcccttcgcgacgtggtggcgggcgcggcgaccagcgccattggcacctgcgacctcgtcgtcgacgccgcactcgggaccggtccggcgcggccgctctcgccgctcggcctcgagggcgtccccgaggtggtcgccatcgacattccgtcgggtatcgatgccgacacgggcgaggtgacgggggcggacctcggaggcgtggccgtcgtcgcccaccgcacgatcaccgtcggggcgctgaagcccggcctcctcgtgggggaggggccggagcacgccggtgccatcgtccgcgtcctcgacgacctcgtgcccgaggacgtggatgcctggctcgtcgagcgcgacgacgtcggccaggtgctgccgaggcccggacgcgatgcgcacaagtggcgcagtggcctcttcgtgctcggtggctcaccgggcatgcgcggcgccccggccttcgtcgcgcgcggggcgcgagccgtcggtgccggcatcgtgcacgtgctcaccaggagtgagcccatggagtccgtggcgctcgagatcgcgcccgaggtcgtcgcgagacgtctggtgaccggccacgtggatctcgcggtcgccgaggctgagcgcttcggcgcggcggtgatcggacctgggctcggtgacaccttggcgagcgcgaacctcgtgcgtcgcgtcgtttccggtctcggggtgcccttcgtgctcgacgccgatggcctcacgtcgctcgcgggcgagggtcgtctggcatcggtgctggcccagcgccgcgcacccggcgtcatcacgccgcacgacggggagctcgcccgggtggccccgcaccttggtggtacccgtatcgagcgcgcgaagggcgcggcggccgagttcggcgtcgtcgtcgtcgccaagggcaacccgaccgtcgtcgccgctcccagcggcgagaccatggtggtcgctgccgggacggcacggctcgcgagcgcgggcaccggcgacgtcctcgcaggcgtgatcggcggtctccttgctcaggggctcgatcccctgcgtgcggcgtgggcgggtgcgtggctccatggcaccgcgggcgcgcagcttgccatgcgcctggccgcaccgacggcgctcgcggatgcgatcggcaggctcgtcgcccagatggtgccgatccccgcccatccgggggcctccgtggaggcgcgcccgtgatcggccatcgaccgacggaggcgcggatcgatctcgagcggctgcgtgcgaatgcgcgtctgctcgccgagcgtgcagctccggctgcgctcagcgccgtcgtcaaggccgatgcgtacgggcacggcgcgagcacggtcgctcgcgccctcggcgatctcgtcgacgccttctgcgtcgccaccgtcgaggagggcctcgcgctgcgtgccgcgggggtcacggggcgcgtgctcgtcttgtccgagcctcccgagtcggccgtgtcggcgtgtgctgcgagttcgctcgagcccttcgtcgagcacgagcgcttcgtggaggcgttggcgggggcggcctcggcgctcggccgcgaagcctcggtccacatcgacgtcgacacgggcatgcatcgaagcggtgtgcacccggcccaggcggccacgctcgccgccagtgctcgtcgccacggcgtgcgcgtcgtcggggtcgcctcgcacctggttcgtgcggacgaagcgcccacgcatccgacgacgctcgaacagctctcgaggttccgcgaggtcgcggctcgtatcggggcgcctgagcgacacctgctcgcgaccgggggactgctcgcactgcccgaggggcgcttcgagcgggtgcgcgtcgggatcggcctgtacggctatggacctcgacgcgacgatgtggcgggactgcgtccggtgctgcggctcgtgagccacgtcgttcgcttggaggcccttggcgccggtgaggcggtgtcctacgggcatcgaaggccactcgacgtgcccgccgaggtggcgacgctgcccattgggtacgccgatggcgtgcctcgcgccgccttcgacgcgggcctcgccttctgggccaagggtgtccgactgccgatcgcaggcacggtgaccatggaccagaccatggtggcagcgccacgggggctgctcgccctcggcgatgaggtctcgctcatcggggacgaggtggatgcctgggagtgggcggacgtgctcggcacgatcccctatgaggtgctcgcgcggctcgggccgcggattccgagggtggtggagcatgggactgcctgagctcgaggcgctcgaggccgaggttcgcgcgtgccacgcctgtcgcttgtccgcgggtcgtcatcaggcggtgcccggcgagggcgccgcgcccgcaccactgctcgtcgtcggcgagggtccgggggcgcgcgaggacgaactcgggcgccccttcgtcgggcgctcggggcagctgctcgatgccctgttggctgatgagaccggcctcgatcggagcggcctctacatcgccaacaccgtcaagtgtcgccccccgggcaatcgcacgccgaggccggacgaggtcgaggcgtgcaggggcttccttgcgcgccagatccacctggtcgatccggtcgtgatcgtcgcgctgggccagagcgcagcggcgtggttcctcggacccggcgcccgcgtcggcgcgctccgtggccaggtgctcgagtgggaaggacgagcgctcgtcgtcacctatcacccatcggcggcgctgcgcggcggtgcggccatcgtcgccgcactgcgcagcgatctcgcccgcgccagcgtggcactcgcggagcgacgtcgatgagcgtgccagggccagcccctcgtcgcgaggagatgctcgtcgacgccgaggcgaccgagcggttgggggagcgcctcggtgtcgagatgccgcccggtgcgatcctcggtctctcgggcccgctcggagccggcaagaccacccttgcccgtggtgcgctgcgagcgctcggcgtgcgagaggcggtggtctcgccgacgttcctcggcttgcggcgctacagcacggccgattcgggcatcgtgtaccacatcgacctctaccgcagcgaggatgcgacctggctctggggcgagggcgtcgacgacgacctcgacgacggcgcgcgtgcggtcgtcgagtggatcgatcgtgaccggcggctcgcggccgacgcatgggccatcgtcgagctggacgtcgtcgagctcgacgatggccagacgggccggcgcgcgcggattcggaggcaccggtgagcgccgacgaggtgacgctgctcgcgctcgatctcgcgacgaggccgagcatcatcgcagctcgggtcgctggagtgacgcaggcggtgcgtggtgtctccacgcacccgctcgccgacctcggcgcccgcgtgcgcgacgtgctcggccaggcgaccccggaggtggtgggcgtggtgaccgggcctggttcggtgctcgggctgcgcgcaggcgccgcgttcgtgcggacctacgcgagcgcgaccggtgccacactcgtcccgttgcacaccggtgaggccgtcgcggccagtgtgcccgacgagccggtgctctgggtggtcgcgcccgtgggtcgtgggcgcgtgagcctggtggcgaccgagcgtggtcaagtcgtatcggaagcgatcgtcggtgtcgaggagctgcggatcccgcgtggcgagccggtcgcggggccgggtcttgctcgcggactgatcggggaggggcgatcgaccggcgtcgtcgagccgaccggcaatggtctcctcgccgccctggtgcggcggtggcgagcgggcgagtcggcagatccccattcgctcgcggtgcgctactcggtggacgcgggggttcgcttgccgcgacgcttcgcagagggcgggggtcggccatgatgacggtgcggccgatgcggcccgaggacctcgacgcggtgctcgcgatcgaggagtccgtgtcgcgcgtgccctggagccgacggtccttcgtggacgagctcggtgccgagggacgcctctggcgcgtcgccgacgagggcggcgtcgtgcgtgggtacgtcggcgcgctcatcgtcgtcgacgaggcacacgtcctcaacgtcgcggtggcgcgagaggcgtggggtcggctcatcgcgacgcggttgctgctcgacgcgctcgatggcctcgatgcgctcggggtgcgtgactgcacgctcgaggtgcgcgtctcgaacgcgcgtgcccaggcgctctatcggcgtctcggtttcgctccggtggggctcagacgggcctactaccccgacaatgacgaagacgccatcgtgatgtggctgcgcgatctcgccgcaccggcatccaaggagcggttggccgcggtccgcctcgacctcgaggggggtgctcgatgacgagtgcacgcagcctggaccggctcgagctcgtcgacgcgggcgtcgtgctcgcgatcgagaccagctgtgacgacaccgcggtggcggtcgtggccggtggtcgggtcgcggccaacgtggtgcgctcccaggccgcgctgcacgctccgttcggcggggtggtgcccgaggtcgcggcccgggctcacgacgccgccatggtcgaggtcgtcgaggaggcgctcgccgagtccggcatcgacgcgcacgaggtggaggccatcgcggtgaccaagggtccggggttgccgggatccctggtcgtcggcgtgggcgccgcgctcggccttgcggtggggctcgatcgaccgctcatcggtgtcgatcacatggagggccatctctacgcagccaccatcgaagggcccgtcgccctgccggcgctgagtctgctcgtctcgggcggacactccgagctcgtcgtcatcgaggcgccgtttcgctatcgcctcctcggccgcactcgcgacgacgccgcgggcgaggccttcgacaaggtcgcgcgcatcctggggctcggctttccgggaggccctgccatcgaggccgcggcgcgcgatgggcgtcccgacgcgattcgctttgcccgggcgcttcgcaaccaggggttcgatctgtcgttctcggggatcaagacggaggtcgctcgctatctcgaaggggctcgggcggccgaggtcgccgacgtggcggcctcgttccaggaggccgtcgtggacgtgctcgtggccaagctcgagcgtgcgctcgagagcgagcgggtcgagaccgtcgtgatcggcggcggggtcgcggcgaacgggccgctgcgcgagcgggtagccgagctcgcgcgagcaaggggtgtcggcgcgcacatcccggccaggagcctctgtgccgacaacgcggccatgatcgccgctgcgggtgcggcacgcctcgtcgccggcgagcacgcggtcgatggtctcgacatcgagccgacacgaagcctcgtcggaggtgacgaccattagcactcggcatgctagagtgctaatggtcgctgacccacatgccagtccactcaccgatcaaggaggcatgagcatgaacctgcagccaatggaggaccggatcgtcgttcgtccggccgagtctgaggagcggaccgcgtccggcctcgtgatccccgacaccgccaaggagaagccgcagcagggcaccgtgctcgcggtcggccccggcaagcgggccgagcagagcggcgagctgatcccgctcgacatcgccgtgggtgacacggtggtctactccaagtacggcggcaccgagatcacggtcgacggtgaggatctcctcatcctctcgagccgtgacgtcctcgccaaggtggtgaagtagcgatgccgaagatcttggagttcgacgagtccgctcgtcgtgcgctcgaggcgggcgtcaacaagctcgccgacaccgtcaaggtgacgctcggcccgaagggccgcaacgtcgtgctcgccaagagcttcggcgcgcccacgatcaccaacgacggcgtctccatcgctcgcgagatcgagctcgaggaccccttcgagaacatgggtgcccagctcgtcaaggaggtcgccaccaagaccaacgacgtggctggtgacggcaccacgaccgcgaccgtcctcgcgcaggcgatgatccgcgaggggcttcgcaacgtcgcggctggtgcgaacccgatggccctcaagcgcggcatcgagcaggcggtcgcggccgccgtcgagtccatcgccgagcaggccaagccggtcgagggccgcagtgacttcgcccaggtcgctgccatctcggcagccgatcaggcggtcggcgaggtcctcgccgaggccatcgacaaggtcggcaaggacggcacggtcaccgtcgaggagtcgaacaccttcgggctcgagctcgagttcaccgagggcatgcagttcgacaagggctacctgtcgccgtacttcgtgaccaaccaggatcgccaagaggcggtgctcgagaacccgtacatcctcttctacgcgacgaagatctcctcgatccacgagctgctgcccgtgctcgagaaggtcatgcaggccggtcggtcgttgctcatcgtcgcagaggacgtcgagggtgaggcgctcgcgacgttggtcgtgaacaagatccgcggcaccttcacctcggtggcggtcaaggcccccggcttcggcgagcgccgcaaggcgatgctgcaggacatggcgatcctcacgggtggccaggtcatctcggaagaggtcggcctcaagctcgagaacgtcacgctggatctgctgggccaggctcggcgcatcgaggtgacgaaggacgagacgaagatcatcggcggcgccggtcagaaggcggacgtcgatggtcggatcgcccagatccgtcgtgagatcgaggagaccgactccgactgggaccgtgagaagctccaggagcgcctcgccaagctcgccggtggtgtcgcggtcgtcaaggtcggcgccgcgaccgaggtcgagctcaaggagaagaagcaccgcatcgaggatgcgctctccgcgactcgtgcagccatcgaggaggggatcgttgccggcggtggcacggcgctcattcgcgctcgggcgcgcgtgaacgacgtggtcgccaagctcgagggtgacgaggcgacgggcgcgaccatcgtggctcgttcgctcgaggagccgctcaagtggatcgcctacaacgcgggcatggaaggcccggtggtggtccagacggtcgagcacgagtcgggcaacgttggcctgaacgctcgtaccggtgtgtacgaggacctcgtgaaggccggcgtgatcgacccggcgaaggtgacgcgctctgcgctgcagaacgcagcgtccatcgcggccctgctgctcacgaccgaggcactcgtggccgacaagcccgaggagccgggtcaggcggcggccggcgctggcgcagccggcggcatgggcggcatgatgtaaggcgagccacgctcgtcgcacgaggggagggtccgcaaggatcctcccctcgctgcgttcgtggcagcgtgcgatggtctcgagggcggagaccaagccgttggggcgcgcacgggcgccgccacgatgggaaccagtcgatctcggtcagccgatcgtggccgaacgatcccgggagtaccagcacgacgacgctcccgaggtggttgtgccctctggagcatgtgccgaccatgaccccaggtcgccgggcgaggtgacgaagacggcagctgcaaggtgccggtcgggcatgccggtcaggagcgcttgccggtgagggcttcttggagctcggcctctgccttcgagtccaggctcgagcgcaagacggtgccgccgtagcggctgagtgcggcgatcaccttgtcgctcggtacgtgctcgaccatcaggaagagcgcggaggtgcccggttggacgaggtcgcgtacccgttcggcgaactctcgattgacgagtgagcggtcgatcagaccggtgagcccgccgagagccgcgccgaacgcgacgccgagcaccgggacgaagaacaggaagccgaacaggagcccccacagcatgccccaggtggtcgcggcgccgacgacgtggtgattcgtctggacgcggaaccgaccgtcgctctcgcgcacgatcaccgccacggcgtccggttggatgaggagctcatcggtgagctcctcgatcgtctgagcggcttgggtggccgtgtcctcgtcggggtagccaatgaccaacagatcggacatcgcgtcctcctcgtgagggtcgttcctgtgaggaccttagccctttggaagccttctggaccattcccgccgagggcaggggtgtgcccgcggtgcggtgcgatgacccgtgcaagctcgcacgggtgcttgcgcgagcgcctctgcctcgagggcagtgacagcagaagatcatcaaagcgtgatgcggtcgggaggctcgccgtctccaagggttgaccgaggggactcaatcctcgcccgactcgagccgatatggctaccacgatccagatcgcacggattgtaacgttgcaaacacactgcgcgagcaaatggtcgctggttactgcggtatggtcaggtggcgttcgggtaggtcgcagcttccgggcattcgtggctgggcccgtcgatcgggctggtggcgggtgcggagatgctgctcagggggtagctgtgaggttgcgcgggcggttcgaggatgcagacgcatggagctggtctccgttggctgtcgtcgagagccgacgagaaggagtgaggtctgtgaggagcgtcgacatgtcgtccgccggcggtggcgacgacgaggcgagaaggagtgaggtctgtgaggagcgttgacatgggcaggagcgtgcagctgggatcggctcgggcgggcgcggtgcgagtcggactcatcgtccttgtgtcgggtgcgatggcggccctcggcggcggcgttgcgctggcgagcggcagctcgacgccgtctgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcagtcgtccccgagtgcaccgacgccagcggcgggtttccaaacgactgtgctgtcgcaggtcgtcgcgccgtcgtcgtccacgcagacggtgacggcgacggctgatggcgccaatgtgtcagtggtcgttcccgcaggtgccttcggcaacacgacggtcaatctcgtcgtgaccgagcccacactgtcggatctcacctcgacgctgtctgcgctcggcctcggcggatccaccttggcgaccggtgtcggggtcgaggtggtcgacgctgcgactggccagccgctgaccggtacctttgcgcagccgctgaccgtgacgattacctcgagcggcatcacgagtgcttccaaggtcatcgagttcccgacgagtggttcgcccttcgtcgatagttctgctgaagtggtctcgggcaaggcggtggtccaggtgtcgagtgaccctggcttcgcagtcgcgacgcccacctctgcttcggtgccggcggccacgtctccggtgaccggtaaggacttcttgccggtcggcatcgctggtggcgtcctcgtcgtcggcggtgcggccctgatcgtcgcttcggagcgacgtcggcacgcatgagtggtgtgagaacccctcgggggttcctgcgccccgcggcaggtctggttgtcctcgcgggcgtcctcgcggcctgtgggtccaccgcgtcgtcgtcctctgccccagcgagtggttcgtcgacggcacatcgcgggtcgatcccggtcgcgatcgtgccggtgagcgcgggagcgctctcgctggggccactgcaggcgaatggcgagttctccgtcctggcagggacgccgtcatcgaagggcgtcttcacctaccagctcagcactcggcgcgaggtggccagtttctcggtgtcgaatcaggcaaccgcgatcacccagttgccaaacggcgtcatcgcggtcgggcttggtacggggtctgtgggcgccgtcgatctcgagagcagcagtggccaacaactcgcctcgatccccgtcgctgctccggtgcggggcctcgccctcggaacggacgggtccacgatctacgtgttggagggcaccggatcgacacgggcggttgccgtcctcgacaccgcgacgaggagcgcagcgacgaccctgcccgtcaatgctgacaccgtggcgatcgcatcgtcgccgacccagcaggagctctacggtttggagagtactggtgcactggacgtgtactcgacggcgacaggccaacggatcggtaccttccccgtaggtcactcgggcgtcgccgtcacgccgtctcccgacgggactgccctgttcgtgttgaagggcgtcggcggggtgcgcaacgtcgcggtggtgaatctctcgacggagggggacgtgcgagccatcggcgcgccggctggcggcatcgcgatcgcccccaccctgaccggtgccgatgtcctggtgctcgcggtggggccggcgtccgcgaacgttcaggagttgcccacgtcgtgaggacctctccgctccaggcgacggccgacgatccgacgtcgccacgacacggtgtccgagtggaggctgcgacgggcacctcgacgatggcctggttgttggcgggagcggtgctgatcctgtggggccttcgtttcggggttggggtcgccgagtcggctgggttctcgctcgccgatgtggtcatgatcggggcgggggtcgccatcattgccggctcgccagccatcgcgacgcgccctcgcctgcactgggctgtgctcgcgctcgtggttgcggcgtttctggcatgggcgacacagcaagtcctgatcgcgcccgcctacgcgacggacgagctcgcgttcgaccagtacgccgcccacctcgtactccagggggtcgatccctaccgagtctcgatggcggcggcatttgcgcgctaccaggtctcgccgaatgcgtttaccctgcgcttcagcggacagccggtgacggccctctcgtaccccgcacttgcattcctcgcttacgtgccgctcctggtcgccggcatccacgcccaagccggcacgatcgtcgacgcccttgcgtgggcggtgacgatcgtcgtcacgttcgctgcggtgcctcggagctggcgaccgttggtgctcgcattgctcagcctttctgcgggcgtcgcgtatgccgtcggcggagtcacggacgctctcttcctgccgttccttgtcgcgagtgcagcgttgctgggacgcttcgtccgcggcgattcgtggggctggctcgcacccgtcgcgctcggtctggcgatggcggtcaagcagacgccgtggctcgtggcgccggcactcgcggtggtggtcgtgcggtgggcgcgcagcagtcggtcgacgtcgtgggcgctgggtcgcctcgcgtggttcgtcggcttggcgactctcgcctttctcgtgccgaacgtgccgttcatcctccaggatcctggtgcctggctccgtggggtgctcaccccgctcgatgcgtcggtcgtacctgcgggccaagggctcgtcgcgctctcgacagcctttggtatcggggccgggggcttcgtctggctctcgcttgcatccgtggtgcttctcgcgggcggcacggcactcgtgtggctgggatggccgcgttgtgcgtggtgtgcctggctcgtgccggtggtcgcgctcttcttcgcgacgcggtcgttcggctcctactacgtcaacctcgtgccgcccgcgctcgtggcgcttgcacgttggccgcgcggagccgcgcccctgccacgtgtgtggtatcgctgggcactcgtgacgggtggggtcacggtcgtgtgcgctttggcctgggtgcgaagcgcatcgccgctctccatcgagatcaccggtgtccacacctctggccagctcgcgaccgtcgcgcgcgtcacgctgcgcgtcacgaaccgctcggatgcgacgctcgcgcccgcctacgtctcctaccttgcgggctcgtactcgctcccatggcagctcgaggcaggccctcgggtggtggcgccgcacgcgagtgtcgacgtgacggtgggtgcgccgaacttcccggcccaaccctcggtggccggtgggttccagatggtggcactcgcgggccatgccatcgccccgagcgcactgtacgagcccgggctccttcacgtggcgctggtaccggacgcggtgaacatccccgtcgcgctgggtcagcaggtggtgctccacgcggagctgctcgatcgcttcgatcagccagtgcgcgaggcgggtgtgccgatcttcctcggtcagatcatctatgcgcagcgtggcctgctctactcgagcgcttcgatcaacggtgccgctccgggcgcaactccggtcgaagagctcactggtccgaatggggtcgcgacgttcgtcatcgtcgaccgagctgcagagcccgatccggtgagctttgaggcaaacctggtctcgacgagcgggtactacccctatggctactcgcagatcgtcccgatccggttcgagaggagctgagatggcgaccggggtcggggcgccagatgacgctcgtgtgcaggggcgcgggcgatccatcgcgcgggtgatgggatgcgcgactcggctgctcggctggtggcgtgacgggggtccggcgctttgggtggcctggggattcggactcgcccaattggtcgtggtgatcgtcctcgcggatcgcctcgtccgcgccggggcgctctcgatcgactacgcgatcgaaggcggcgggttctctcagatcgccgctggccacctcgacccgaccgtgtggcttttccagtacgtcaagcccttcatcgacaaccacgaggtcttcctcgactggcccctcgcgctcgtgatcgggctcgtgcacctgccggtggtttggacgctgctcattggactccaggcactcccgatcgctgcaatcggcccgctcgtcgcgtcgtatgccaacctgcgtggacgtgagctcggattctcggctcggacgcgcgcgctcgtcacgctggtgccagctgcactcgcggcactcgatgtctggcagtactggtcgacgacgttcgactaccacggcaaggcgctccaaggtctcgttctcgttgcggcgctgatcgtgctggagcgccgacggcgggcgtggtccattgtgctcgtcgcgacgctcgcactcatgggcgatactgcgtcgtacgtgctcgccgtcgtcgcagtggtgcttctcctcgagcgtcggtggcgcggcggcttggccgtgctggcgacggcggttgccgtgctcaccgtgccctctctgctcgggttccacattttgtcgctaaccgggggtctctatagcccgctgacacccctccaggcgccgacctatgacgtcgtcgttggcgtcctcaagcatccgggcttcgcgctcggccgcctcgggcgccgcctcccagacatgtgggccctcctcggtggggcggggatcctcggcgtggcctccgccatggggatcgcggcaatggccgtcatcgggccggtcgtctggctcggcattgcgcccctcgggtacgcgggcgtcttccaactcgtgccgctcaccgacgtcctgctcctcggcgcagcggtgacgctccttcgtgtcgctcgtcgtcggccgcgccgtgccctcgccatcggcgggttcgccgtggcgtgggcgtttggctggttcgtggtgttcgtcccccatctcgtggcatccatccgcgcgatcgcgcctgccgacgtacgcaccgggagcacgctcgaggcgctcgcgacctcgatcccgccgggccatgaagtggttgctccgatctcgatggtggggctcgttgcccaggaccatccgctcgtgtggagctatcggtgtcggacggggccgatctcgatcccgaccttcggagtcccgctcgacatcgtcgtggctccgggggttggcgtcgacacctgcagccccggaacgctgatggctgagctggctcgggtcgcggcgttgcccagtgcgtccctccgcgtgctgcctggtgatgtctacgtcgtggagtatgatccaggcccgggtcgagggagcctcgtcctgtccgatgcggcgccgatgacaggccgagagctcgctcccacctttaccaagggctcgacccagctgctcccgggcggagcggtcgcgctctcgcctggtccgctcgcgctccacggtgtgaccgcagagctcgccccgggtgctgctggagaggctctcgtgcgcctcgaggccgagggatccgtgagcgtgcaggtgtgggatgacgcgtcgggtcagttgctcgcccgtgaggagctgggcaccacgaccggggccgagacgctcgcgatccccttcgtcgtgccccaccggttcatccccccggctgcgttcagcgacggcgtgtggccgttcgtcacacgcttcctccccccgacgcgctcggacgccgtcgagctccgtgtgagcgtcgggccgggttcgcaggtggcggtcgccgatgcctggatcggccccgcctctcaggcatcgaccgtgttgtccttcccaggtctcgttggtcagccggcactgccgtagggtggacacatgagggggaagggccggggagcgcacagccgacagcgaggtcggggaatcgcgatcgtaggggtcgtggcgatgctcgctggtctcggcctcatcggctcgatcgtcgccttctacgtgcgctcctcccttgtgggtggcggactcatccagcaagcgcagaaggcccggacggtcgcggcgtggccgcgatcgctgctcgcgatcgtgcgtatcccctcgatcgggctcgtcgcgccggtggagcagggcaccggccagtcggtgctcgctgtggcggtgggtcatctcacgacgagcgcgctccctgggaaaccaggcacgtcggtgctcgcggcgcacaacgtcagctggttctcgggcctcggtggtctcggctcgggatctctcattgaggtcgatacaccgtacgggcagcaggtctatcgtgtggcctggcatcgcgtcgtgcacgtcggtgcgcccgtggccaacaccgccgcaccgactctggtgctcgaagcgtgctggccgctcaatgcgctctacttgacgcccgagcgctacctcgttggtgccaccttggtggcgacgacgaagatcgcggtcacgccggtcacgccgtcgtcggacagctaccagccgctcgggcttgcgccgacgctcgcgcacgagaacctctcgctcgcggccaacgacctaccgatgggggtgctcgccaccgttggctcgcctgctgcagcatggacgagttcacagcgaccctacaacttcgctggagcggaagtgacgtggaccattgcgttgttgcatgcgctcgaagctcacgacctcgtgctcgtcgaatcggtgacccacgagccagcaagcgtggtcgcaccattgctcagctgggacggaggcttcgcgagcctcgacgacctcaccgaggtcgtcgatggtgtcacggcgtcggctggctcctcgcgagtgtcgctccagaccgatcacgggccgctcgtcgttaccttgcgttttcgggtcatcgggcatggggtcgaggtagctggcgctgcggtcgggacgtcgcagggctcgtagcccgccgcagtgaccgcggcgggttcgtgcccccgggctggtggctcggttggcgagatcctcgggcgcgcgaacggcggtgtcgtcgcgctctgatggtggcgctcgttgttccagattgctcgacgggcaccgagcgcccggcgacgacctcgatggtcggtgggtcgtcgatcgcttcggacccggtcgaggcagctcgtggccggacggatcgccgtgatcagctcgggcgttcgtcgtcgaggttccgtgcgcacaccggccgacgaaggtcgggtcggctcacgtagcctgggggtcatgggtgaggtggcgtcgggcgggctgtgggatctgcaccggtttcgccagcgcatcgatgagccggagcgccgacttcgccttgtgtggccgtctcgtgcggtggacttcggaagcctcgacgaggcgagcgtacgacgagcccttgcgccggccccggcgagccgcggcggcgtcagtgcagcggtcttgattccgatcgccttcgacggcccctccggcccggaggttctcgtgacgcggcgtgcgcgttcgttgcgtcaccacgctggtgagatcgcgttcccgggaggacgggcacgcgcgggagagacgctcgtcgagactgcacgcagagaggccgaggaggaggtgggcctcgaggcgagtgctgctcgcgtgctggggtcggtcggggttggctacacccgctcgagtgcttacgcgttcgaggctctggtcgcggcggtgccgcgtgagacgatgctcacgctccaacccgatgaagtggagatggcggcgtgggtcccactggcgacactgttcgggccggagcgagctgcgagcgaactgtggtacgacgaccgagcgggttggctccgagtctggctcttcgacctcggtgatgacctcctgtggggagcgagcgctcgcgtcgtcgcggcgctggctcagtgtctcggcgcgacgtagagcgcctggagcaccgcgccgatcacaccgtcgtcatcgagcaacgtcgcgcgcgtgaggccaacaccatcggcgtcgatgaagctccgtgccgaaacggcgacgcgcgtcgtcgcgggctcgcgaacgaagtcgatgtggaggctcggcgggatgaagagccactcgtcgaaggcgaggtgggtcgagatcccgttcgcaacgtcagcaatgagcgcggcggcctcgagcggtgtcatcggctcgcctgcgacgaggtggatgcgcggcgtggcccagacggtcgcgggacctggttgggcgaaggagccgtcgacgaagcgccagtcgatcgcggcaccgtacgggaaactgtccatgatcggatcgcgatggccggcctcgggagccggcagcttgggtgttggtacgtgcgttggcgctcggccccgctcggtggcgaagaaccagcctcgtgcttcgaacgccacgcggtcgccgacgcgcgcacgcatgcgtgcgaggcggacgcgtcgtccgtcgcgagtgagttcgcgttcgatgcgcagtggggcgatcggtacggggccgatcagatccacgtcgagtgaggagagccgccagctggcctctggaacgatgcgccgcagttcgtggaccgcgagggcagccgggggtccgccgtgggtggcgttcgggtcccacggtccgacggcgtggttggtcggttcgatgaggtcgtcgtcgatcctgcgaaagaagctctcgtcgctcacgagcctcgagcctacgtcgcatcccacgccgctcttgcgggggctagtgagggtgctcagccacccagaggccgatccaggcgagtagggagcccgcgaccaccgtgccgagcatgttggcgagtgaacgcgtgagctggcggcgtctggccagggccagcgactcgaccgcgagcgtcgagaaggtcgtgtaggcgccgatgaatcccccgtcgatcaccgtcgcgaggttggctgggaggaggccgccgagcgcgagaccggtgacgagaccgagtgcgagtgagcccgacaggttgatcgtgagcgttccccatgggaaggtcgcttggggcagcacccgacccatcagtactcggtcgacggcccagcggacgatcgcgcccgcggcgccggcgatggcgacgagaacccaggtcacgagcgatgggcgatcccaaggcgccgcaacgtgctcgggaactcgatcgcgagcgcccgcacgccgtcgccgtcgagccgctcaagcagtgcctcgatgcgatcggcctggtcggcgatgacgatcgcgatgccttcgtcgtcgtcgagggacagcagcgtggagcgtcggagccgcaggtgctcgccgaagctctcgacggcccgaaaggcggttgcacccgcgaggccgagatcgagggctcggcgcatgacgtggtcgacgacggcctcgtggccgatccgatcgccctcgttcacgaacacgatgacacagcgcgcctcgtcggacgtcatagacaacctccctctatcccaggggctcgacggcgctgtgagcgggcgtcgagcagcgcggtcgtcgctgcgcggcctgcgacgaccgcgaggaggccagctgcgatcgtgagtgcaccatagagcacggcggacccccacgcaccgcgatcggcggtctgggcgatggcgagcgcgagcgacgacagcgtggtcaaaccgccgcacaggcccgtcgccacgagcagccgaagacgccgtccagaggtcggcgcgaggcgctccgcgagcgcgaggaccccgccgatcacgaaggcgccgaggacgtttgcggcgaggatcccgagtggaaacgacggggtggtgtcgaggacctgctcgagccagacccgcgtgagcgcacccacggcgcctccgatccccacgagcgccgcgcgccgcgctcgtcgcgcatggtcgccggtcatgggatcgatgcctcgaggctcgcgatgcgcgcgtcgaggcgggtcagctcctgggcgcgctgggcaggcggttcggggccgtcgagcaccagggcgcgcgcgagcgccgtcgctgcgagctcgagcctgggcgccgacggggccggcgcgatgaaggcggtggcggccgagctcaaggggtaggcggactcggtcggcgtgcgcgccgtctgggtcgcatccagaatgctcgcggcctccggcgaggtcgagttctcgaggaacgcgaggcatccgaccgtaccggcgcaggtggtcgagacccgcgctcggatctggctcgcggtgacgcccagcgtttgctggagccagatcgcgaccgtgctccctgcctcgatcggggcgatggtcaccggtaccggcgggagcgagagggacgggttgaggtgcgcgatcgtggcgtcgtcccagacgctgatgcgtccggtcacgaggtcggcgagcgcggcctcgctcagcacgagtccggtcgtcgccccgaggttgaccgaaacggtgagctcttcgggagcgtacggccagggcgcgagcccactctgggccacgatgctcgccgccggggcgaggctcgcgacgaccatctcgtcgtgcgtggtgacgagggagctagcgatctgggcgagcggcaccgtctggatgctcaccgacagggccgggtcgtcgcggcgcacggcgcgcacggcactctcgagggccgggagcgcacccggatcggcgagcaccgtgaggtgggtcgcgccgaggacgctcgcgagccgctgcgtcgccgtcgtcgaactcgacgacgggctcgtggtgccgcacgcggcgagcacgaccgctccgacgcaaggcgccaggcgcgccgccaccgttggtcgcatcaccctgtcgacgcctcccaccgcgtagactgcgagtcgcagtctacgagcgcccctgggggaaagcgtgagagacgcaatcgcacgacgtcccagcgaggagggtggttaccgtggcggagatcgagatcggactcgggaagtcgggccgacgggcctatgggttcgacgacatcgcgatcgtgccttcgaggcgaacccgcgaccctgaggacgtcgacatctcctgggagatcgacgcgttccgcttcgagctccccatgatggcctcggcgatggatggcgtcgtctcgcccgccaccgcgatcgagatcggccgcctcggcggtctcgcggtgctcaacctcgaggggctctggacgcgctacgaggatccggatgcggtctatgccgagatcgctcagctcccctccgacaaggcgaccgcgcggatgcaggagatctacgccgagccgatcaagccgtcgctcatcaccgagcgcatccgcgagatcaaggctgcgggggtcgtcgcggcggcgtcggtgacgccgcaacgcaccgaggagttcatcggtgcgatcttgaagggcgaactcgacatcctcgtcatccaggggacggtggtctcggccgagcacgtgtcgaagacccaggagccgctgaacctcaagcgtttcatccgagagctcgagatcccggtcatcgtgggaggcaccgcgtcctaccaggcgaccttgcacctcatgcggacgggtgcggtcggggtgttggtcggggtgggtcccgggcatgcgtgcaccacgcgtgcggtccttgggctcggggtgccgcaggcgacggcgatcgccgatgccgcggcggcgaggatgcgccacctggacgagacgggcgtctacgtgcacgtgatcgcggacggtgggatgtccaagggcggtgacatcgccaaggccatcgcggtcggcgcggatgcggtgatgatcggctctccgctcgcagcggcctacgaggcaccgggtcgcgggttccactggggcatggcgaccttccacccgacgctccctcgaggcacccgggtgcgtaccgagcagcgcggttcgctccaggagatcctggtcggaccggcccgggagaacgatggtcgcctgaatctcttcggggccctgcgtacctccatggccacctgcggctacgagtccatcaaggagttccagaaggccgaggtgatggtcgcgccagcgctccagaccgagggtaagtccctccagcgcgagcagcacgtcggccaggggcgctagtgcgccacgccgacgagcaggtcgtccttgtcgtcgacttcggcgcgcagtacgcgcagctgatcgcacggcgggtgcgcgaactccacgtgtactcggaggtcgtcccggctcgggacgcactggcgttcgtccgctcgcggcggccggcggcggtgatcctctcgggtggtccggcgtccgtatacgcccccggtgcgccggggctcgcgcccgaggtgctcgaggcgaacgtgcccatcctcgggatctgctacggcgctcagctgatggcccagcagcttggcggcgtcgtcgagcacggaggttcgggtgagtacggcagaacggtgatcgagcgcaccgacgagcgtgcgcacctgctcccgccgctccgtggcgaggcgcctgagacggtgtggatgagtcacgccgacgcgatcgttgccccgcccgagggcgcgcgggtggtcgcgagctcggccggggcaccggtcgcggccttcgaggatcccgcgaggcggcgcttcggtgtgcagtggcatcccgaggtctcgcacaccccaggtggcatggagctcctcggacggttcctgttcgacgtggtggggctcgagccgcgctggacgagtttttcgatcatcgagcaggcgatcgcagaggtccggagcacggtcggcgatggtcgggcgatctgtgcgctctcgggtggggtggattcgaccgtggccgcggcgctcaccgccgaggcgatcggcgaccggctcacctgcgtcttcgtcgacacgggcctcctgcgctcgggcgaggcggagcaggtcgaacatctgttccgttcccagttcgacatcgagctgatcgtggtggacgcggccgatcgcttcttcgacgccttggcgggcgtgaccgaccccgaggccaagcgcaagatcatcggcgaactcttcatccgcatcttcgaagaaacggcggcctcgaagaccaacgcgacccacctcgtccagggcacgctctatccggacatcgtcgagtccggtagcgatggctcggcgaccatcaagtcgcaccacaacgtcggcggcctcccggacgacgtcgcgttcacgatcgtcgagccactgcgacgcctgttcaaggacgaggtccgtcgcatcggcgtcgagctcggtatccccgagtcgttcgtgtggcgccaaccattccccggtccggggatcgcggttcgagtgctcggcgaggtgaccgcagagcgggtcgagacggttcgccgtgcggatcgcatcgtccaagacgagctcgacgaggctgggctctcgcgctcgctatggcaggccttcgcggtcctggcccctgggctccggtcggtcggcgtctcgggggacgcgcgtacctacgacgccccggtcatcgtgagggcggtcgagtccgaggacgccatgaccgcagattgggcacggctgccatgggaggtgctcgatcgcatctcgcggcggatcgtcaacgaggtcccgggcgtcaatcgcgtcgtctatgacgtgacctccaagccgccaggcaccatcgagtgggagtgacgaggtgctcgaggagctcctcgaggatctgaacccctcgcagcgagaggcggtcagcgctccgatcggaccggtgctcgtgctcgcaggggccggctcgggcaagacgagggtgctgacgcgccgcgtcgcctggctgctcgccgctggcgagcggccgtcgtcgatcctcgcgatcaccttcaccaacaaggcagccggggagatggccgagcgcgtccgcagtcttgttggacccaacgcggatggcttgtgggtctcgacgttccacgccgcgtgcgcgcggatgctccggctgcaccccgaactcgggggtttgcgctctggctggagcatctatgaccaagacgatgcgaggcggttgctcgagcggaccattcgacgcttggacctcgacaccaagcggttcccaccgcgggcgatcgcccagcaggtgtcgctcgccaaggctcggctcgtcgacccggagcgtttcaccgacgaggcggaggggctctacgagcgccaggtcgccatggtctatcggtcctaccaggccgcgcttgccgaggcgaacgcggccgacttcgacgatctgatcggactcgtcgtcgagggtctcgcgacgcgaccggagctcgccgagcattggcgacgtcggttccgccacgtcctcatcgacgagtaccaggatgcgaacccggcccagcacgccttcgtcgccgagctcgtcggtcgtagcgggagcgtgttcgccgtcggcgacgtcgatcagtcgatctacgccttccgcggtgcggatccctctggtgtcctcacgttcgaggagcgcttcgacggcgcgaaggtcgtcacgctcgagcagaactatcgctcgaccaacgccatcttggggctcgccaacgcggtgatcgccaagaaccgtcgtcgctacgccaagcacctgttctccgagctcggcgagggcacgccggcgcgacgctatcaggccaccgacgagcgggacgaggcccgttgggtggccgcgaccgtacgagagttcctccaacgtggcggcgtcgatcccagcgagattgcggtcatctttcgcaccaatgcgcagagtcgtccgctcgaagaagccttctcggaggcgggcatcccgttccgcgtggtcggaggcgtccgtttctacgagcgccgcgaggtgcgtgatctgctcgcctacctgagagtcctcgccaacccggacgacgacgtcgcgctggcgcggattctgaacgtgccacggcgcgggatcggccggggcaccgaggaggcgctccaggcggctgcggcactgcgcggtcggagcatgctgtcgctgctgcgtgcagagggcgtcgaggtgctcggtctgacgagccgccaggagcgggccctgcgagggttcgtcgagctcatcgatcgcctgggagcgcttgcgtcgctccatcgaccgagcgagctgatcgacgcggtcgtcgccgagacgagctacctcgagcacctcaacgaggaggatccgatcaccctcgagggtcgcctcgagaacatcgccgaactgcgtgcctcggcggcggaggctgacgatctcgagagcttcctggagcgcgccgcgctcgtgtcggcggtcgacgaggtgatgggtgcctcgggcgtcaccctcttgacggcgcacgccgccaagggtctggagttcgacgtcgtggtggtcgtgggactcgaggagggggtctttccccacgtgcgtgccatcgtcgatgccgaggcggtcgaggaggagcgtcgactgttctacgtcgccatgacccgagcacgcacgacgctcgttctcacgagcgcgaggcgccgggcgagctggggcgagccgctctacaacccacccagtcgctttctcgacgagctgccggctgatctcgtggcgacgaccgcggcgcccgtcgctgtcgggacggcgtgtgcggagtcgatccaacgtgcgagtgcggtcgtcgaagcccgtgcagcccggagcgagtgggtggtaggcgatcgagtcttccacgctcgctacggcgagggaaccatcagacgggtcgtgccgcggggcgtcgacgacgagctcgtgatcgcgttccacggcgctggcgagcgtcgcttcttcgcctcgatggtcaagctacgacgcgcgtgagctgagcccggctggggccgcgagagcccctgccgcgtccctggcggcgcatgtgcgccctcgtcggtcgtgtcggggcgcgcgtgtctcggctggctggccggatgggatgacgctgtcgagaagccggacgaccacagagcgtgggaatgcggagagtggtcacgcaacttcctgtggggagaaagtggcaacacagtgcgaacatgtcgatcaggtgtagtgaacagtgcgttacggggacaaatacctggagaactcgtgctggttggcccctcatggtgcggctacagttaccacagcgagagctgaaggtgtcgaattcgagtaaatgtgttggcacggatcgtcgtgcgtcgacactgatccgctcgacaaggaaggagaaccaccaccatgcgcatcatcgtctacggcgcggacggctacatcgggtggccgatggcgctgcacctcgcggcccaaggtcacgacgtgctcgccatcgacaacggtgcccgtcgccgttgggacgcagaaggcggtacccgtcccctgaacgagatcgcctcgttcaccgagcgcgtcgagacctggaacgccctcggcaagggtgcccccatccgcatcgccgaaggcgacatctgcgactacgacttcgtcctcgagaccatgcgcgcccacgacccagaggccctcgtgcacttcggcgagcagcgcagcgccccctactcgatgatctcgcgcgaccacgcggtgcgcactcaggtcaacaacatcgtgggcaacctcaacatcctctttgccatgcgcgaggtcaaccccgagatccacctcgtcaagctcggctccatgggcgagtacggaaccccgaacatcgacatcgaagagggttacctcaccatcacccacaacggccgtagcgacaccttgccctacccgaagctgccccacagcttctaccacctctccaaggtggccgactcctacaacatccacttcacgacgagggtgtggaacttccgcgccaccgacttgaaccagggcgtcgtctacggcgtcgccaccgacgagacggtgctcgatccgcgccttgcgacccgcttcgactacgactcggtctggggcaccgccctcaaccgcttcgtgatccaagggtccctcggctaccccatcaccgtctacggccgtggcggccagacccgtggctacctcgacatccgcgacaccatggcctgcatcaccctggcgctcgagaacccggccgcccccggtgagttccgtgtcttcaaccagttcaccgagcagttcaccctgaacgagctcgccgagaccgtggcaggtgtcctgggacgccgaggcctcacccccaccatcgcccacctcgacaacccacgcgtcgagaaggaagagcactactacaacgcccgtcactcggccctgctcgacctcggtctgcaaccccactacctcgccgacaccctcatcgactcgttggtggacttcgtccaggcgaacgccgccaacgtcgaccccgagctcctcgagaccccgacggtgacctggcgcgagggtgcgaacgaggtctggtatcgccacgcggacctcaccgtggcggccgagaaccgagcacgcgaggccacggacaccattcgggaggcgctggcgtaggtgccggcgcgagcagaggcgtgagggagggttgcgatggtcaagagccaggagtcgtcggaccgaccgtggtcaggcgatgacgaggagcagcgtggggctgaaaccatctggccgctcgtcgatcccgaatcgctcgagggcatcgatgtgacctcgtcggaggcggtcatcgacctgcgtgaggcgccgagtgcccctccggtgagcacgccggcggcgagtcctccagcgatggagctcccggtggtcgcagccccggtgcggccgtcgcgccgcggttggctcgttgccatcatcgtggcggtcgtcatcgtcgtggtcggctacgtggtcgtgagcggcctggctggctcaccactctcgtcgctgtcgtcggaggtggtcgacccgggtgaagtgagtctctcgttcccggctgcgggaacgatttcgcagctggccgttcacccaggcgagcgggtcgcgagcggccaggtactcgcgaccgaggtggtcccgggcctcagcgagacccgtcatgccgatcaggccgcgatcgcagcggacacgagcgaagtcagtgcgctgcaagcgctcatcgcgcagatgtcgagcgtgacctcggcgaacgctggggtcgtcgcccaggcggcccaggctgaggtcgcggcggcgcgccaagcactcacgagcgacgagagccagctggcatcggtccaagctcaaggggcggccacggtcgccgccgcacagtccctgctgggcgccgatcaggctgccgctgtggcggcatgctccggcgtcggcccgacggcttcgccgccaaccgcggcacaggtggcgtgtgctgatgcccagcatcgtgtcgctgccgatgagctcgccctcgcccaggccaaggcgagctcacagagcgccgtcgacggtgtccagagcctgattgctgcggatcaacgtgcgttgagcgacgcggaagcacaggcgagcgagagtgatggcgtgtcgtcgacgcagctcgcagcgctcaaggtctcgctggtagcagcccaggctcagcttgcgcgggatcaaggcgaactcaatgctgccgcccagaccgctgcgacacagaccctgcgagcgccgatcgctgggacggtcgtgagcgtcgacggcgcggtgggtgagacggtgagcgcgagtggggtcggcgatgcggtaccgagcggctcgagcgtggccgtgacccctgggttcacactgttcccgtcgacccagacggagtcgagccagccggtggcctcgaccccggtcgtggtcatcaagggtcacgcccccacgtacctcgagacgctcgtccccgagagcgtcatcggcaaggtgcacctcggtgatcaggtgacgttcacaccgagcagccaaggcatcggtgtcgtccacggggtcgtcgaacagatctttccccgcccggtcgttgcggccggcgtcgtgagctatgaggtccagtcggaactgagcggccgtcttccagccggtttgctgaccgggctcacggggaatgccagcatctcaagctctggtcgacgatgaccccacacggcgtcgtcgtcgtcctcggagccgtggccctgttggcggcgggcagttgggccgtgctccacggcgggcgtggtgaccatggcgacgggttgcgtcacgtgcgcctgccgtcaccgcagcgctcgatcccacgtctcgtagtgttcatcgtcgccatcgtggcgtggtcgatcctcgtagctcgcgactgggccgaggccgcaggcgcgttgaaggccgttcttgcgctgatcctcgagcgagccggactcggtgcctcgacggccagctcgtatctcgtccacaccaacccgctcttgctgctgctcgaggacgggagcctcagttctttcgtgatcgcacgtcgtcacagcgtgcgctcgctcgtcgtcagcgttggcgtcctcgctgtcgtcctcatcgggggaccgctcgtcgtcggggccgccgaggtgatggcatcgtggttcggggccccgtcggtggtggtcttctacctcgcagagctcgcgagtttggcggccggcttcgtcggcctgttggcattgatcttcctctcgagtgccttgccgcggcgctacgcggcaagggttgggctgcgcccgctcgccagcgcgctgctgctcatcggcgtcttcgtcctcattctcatcggcgccggcgcgctcgcccgcggcatcggtgggagcttgagcgctgtgtcgccgccggacggactgctcgtgttcttggccctgcccgcgctgatcatggccgtctcggtcgtgctgctgctcgtgcgcccgaaggatcgacctggggtcggggatcccacggagccgatcgacgtgatcatgccggccttcaacgaagaagctggcatcggtgccgcactcgccgcgctcgatgcggcggcggctgcctatcccggccgagtccgagtcctcgtcgcggacgacggttctcacgaccgcaccctcgaggtcatcgagatggcggcccagactgctcgggcggccgagatcgtcgctgtgggcgggccgcacggtggcaaggcggtcgcgctcaaccgggcgctcgaagccgcctccacgcgcatcgtcgtgcgtgtcgacgccgatatcctcgtggatgcgaactgcttgcggccgctcccagactggttcgccaacccggcgatcggctgcatcggtgccttcgaccttccgaacatggcgctccctgcgtggtacacgcgtggccgactcttcgagtgtctcatgaccttcgggttctctcggctggcgttcgagcgcgtggacgcgaacaacgttcccgggacctacatggccttccgcagagcggaggctctcgcgctcggtggctttgtcgaggggatgaacggtgaggactccgacctcaccttcaacctcggcaagctcggtctgcgttcggtgatcgacccgcgcatcgtgatctacgaggacgtcccccagacccttggggctttcttggagcagcgcactcggtggtcgcgcgcgtcgttccacatcggcgcgcgtcatcttccctggcgcgcgcgagagctccatccgcggctcatcatccaactccgcttcctcttcaacaagctcacctcgatgatccggccgatcacctacatctcgagtgccgtcttcttcttgctcatcccgcgggtcgctggctcgccgctgcgtaccctcgtgttgcttgctttcacccttgcgccgcaacttctcttgctgatcggcgtcgcgctctactggggattctggcgggaactacgccatctctgggtgtgggtgccctttaccatggtccgcaaactcggtttgctctcgggtatcctgtcgctgccgccgttgggcgcagccgtcgatccagaacgtcgggtcgaggccatggcagatgcgaacgctcgctaggcggctcatcctcggcgcgctcgcgctggcgctcgctggctgtggcgaggtgcaagcaccgcaccatcgcccgacgagtgagcgcgcggcgcacgagatcgccccgtcgctcgtcggggtgcattggtggctcgcggcctcggcgctgcgtcgcctcgatgcagcggcaggttcgagctggacgaatgcggtgttccgtccggcgaataccaccctgatcgtcgggccgtcgcaagcggccagctatgcggggtgggcggggcaccgcgccctcgatgcgacgagcctcgccggcgttcgcgaggcgctgcgcgtggcgacgtccggggatgtcgtattgctcgatctcgagcactggccgcgctcgccactggccgagcagcttcaggcgggtgcgacgttcacacaggctggcacgttggccagggcggcaggcgtcgatctcgtcgcggctcccgccaccgacctcgctctcgtcctcaccccgggccagcgtgttcggaccggttttctcgccagcggcgtggtgcaagcagcgtcgcgcgccgcgcagatcctcgagatccaggcacaaggtctcgaggcgacgccgtcgcggtatgcgagcttcgtcgatcaggtcgaggtgcttgctcggagtgcgaacccgacgattcgcttcgtgctcggactgtcgacgaacccgagtgggcaacgggtcagcgcgacaaccttggcccaggacatcgcgctgaccaaggctacggcgagcggctactggctgaacatcccccaggccggggtctcgtgtccgcggtgtggcatcgcgcagccgcaggtcgcggtggcgttgctgcggggtgagtcctgaggcgcaagctgctcctggcgggttcgctcgcgttggtggtggccgcggtcgtcgcggtcgcggcgccacgaggggcgaagcaccatcatcacacgcagcacctcttcatgccgagcccgacgggaggccaaccgatcgaggcaccaacgagcaggcacacgatctggctgctggccgaggcgcacttcgatcaagtcgtctccgtcgcccccgtccgtgctctctttgcccgtggcgtcgtgtacgaaccgatcacgccgcggcagcatccgagcaccctggtcccggtcattccgacggctgactttcacgccgagtcacagctcgcccaggcgatcgccgaccatgagcttgcgacgggagtgcgcgctgtgatctacgacaacgagcgctttgcgaacacccccaccgtcgagcaagacaacatccggctctccaccgagcgcgcagccgctgttgctcgcgccgcgggtctccagagcatctgtgactttatcgagtcggaccgacttccatcaggggagcgtacggcccagaacgaggtgccaccgtgcagcatcgtcgggctcaacacggtgcaacagtcggaacgatcgaccgcccggtaccgggctgtggtggcacgtgacgttgcggtgatccgctcggtcgatccgtcagtgccgatcatcgcaggcttgtcgtcgaatccgcgcggaacgccggtcactgcagcggagctcacggccgacatggaagcgacggcagggttggtgaacgggtactggctgaacgtgccggcgccaggcgtcggttgcccggcgtgccacgcgcccgaccccggactcatggcggaagcgctcgcggcgttgccagctgggttcgcgacgaccgggtgagtcggcacacacgacgaggacagtgacaaccagggggaaccacgacacgaggcgtgcgacggcagtggcggtggctgggtggcagtggctgggcgttgcgctggcgccaacgatctgctcgctcggcatcgtcgccgcgtcgtcggacacagctccagcggcgagcgaggtgccgggctggtcctttgccacggatctcgtcggcgcgacgacccaaggctcgctcgtggtgagtttcccgacaggcgcgagcgccggaacgcagctggtcgtcaacctgccgtgggcccacttctcgagtgccgtcacggtggcgctcgatggtcagtcctgccagggggtctcggctcgcgacgctggcgcgatcggcgcgagcctcgcgtgcacggttccggcggaactcgctgctggggagcacgtcatcgacgttgggggtgtgatgctcccgaacctcgtgctcgaggagtgagcgcccctgtggtggtcggtgctgaccggatctgcgcgaccgagtcggtggcgccacgttcggatgcagcggttggcgtgcgcatcgtggttcgcgacgcgagccgaagcgccgctggcgacagtgccctcgtcatcgcccagctcgtggatcggggcggtcttgcgaccacgaacggagccacgagcgttgcgctcgcgttcgacccggggaccggcgccagcgtcgcgccgccgtcgacatcgacgacacccgacggtgtcgtcggcgtgcggggatgtgctggccctggcaccgccggcatgacagcgaccgctgcgagctcgggcgaggtgctctgcgtcgtgatgcgccagacatcgtcggcgcccttgcgggtcgtcgacgcggcgagcgccttcgagtcgcctcagccgatggtcggtatcgctccgggctcggtcgtgggcctgggatcggcagcctgcgacgcctctgtcgtgacgaactcgggtggggtgctcgccgtcggcgagaacccactcggcgagctcggcaacggctcgaccacggtggcaagttcgacgccggtctcggtgacgttccctgctgggacccagatcgcgcaggtggccggcggtggctacttcacgctggcgcgctcgtcgaacggcacggtctctgccaggggcaggacgaccaggggcaggtcggcaacggcaccaccgaaaccgacgtcgccacgccggtgccggtcgcgctgcctgtcggcgctgccgaggtcgcggcgggttgtcacgcggcctcagtactgggtagcaacggcaccgtctacgcgagagggttcgaacacgacgggacagctgggtgccgggggtttcttcaacgacctcgtaccggtccaggtgcagttgcctcatggcgtgagcgtcagcgacgtcacctcgccaggcgtgtcgacggtggtcctgacaccacgagcggcgccgcctctgtcatgggcggcaacctgttcggccagctcggtgacggcatctacgtcacggccgcgacgccaacccgggttggacagtcacagctcgaagcggtcgcgatgggcggcttcacgaactggctggagccgttcccgaccatcgtccgcaccgacgctcggaccctcaagctcgagcgccctcctcggcgaggagtcgtggcagcgcacggggtgcgacgagcgcccgcacgacctcggcggcgcggcgtcgcttcgggacgatggctcgccgtgtgagaacgtcgtagtcgttgcgttcgacctcgagcatgatggcgctgtagagctcgcgtgccacctcgacgcagcggcgggaggcgcgcggcaggaggggatcaccggcgagtgagtcccgatagagggtccgtgctcgttcgatctcgaagcgcacgagcgctcgtaccgccggcgagggccgacgcgcgagcaagtcgtcgagcgccccgtggttcgccacgtcctcgagtggcaggtagatccgtccccgatcgaggtcttcgccgacgtcgcggatgaagttggtgagctggaaggcgagcccgagcgcgcgagcgggctcgcgagcagcgggtgggccaccgaggatggggaggaccatctcgccgatgacggcggcggatccttccatgtagtcgagcagatcgtcccatcgctggtagcgccggacggtgaggtcgcgccgcatcgcgccaaggaagcgagcgagcgtctccggctcgatctgccagcgctcgtaggtcgacaccagcgcatcgagggccgggtcgtcgctgccgccgcgtacgagggcctggcagagcatcgcttcgagctcgtcgagaccgcgacgcttttcgtcggtggtggcgctaccgtcgacgatgtcgtcggcccgtcgacagaaggcgtagatcgcccagatgcctgggcgcgcgtccggctcgaggaggcgggatgcgaggtagtacgtgcgcccgtagcggcgcgcgacggatcgagtcgaggagagaccagcggattggcgcatcatcgacgtaccatgcttcccgggtggtcggcgagcacgcgagccgcggcgagctgacccgaggtgagcgcgagcggaacgccgacgcccgggtgcgtccccgatcctgcgaggacgaggttgtcgaactcgcgaggggccatcggcgcgcggaacgggcccgattgccagaaggtgtgcgcgaacgagaacggcgtcccggcgtccatgccctgggcagcccacgcctcggggtcgagcacgatctcggagatggggtccgaacgacgagccagtccgaaggtgccgagacgctcttcgaggcgttcgcgcgccgcagccgcgtcctcgggccagcggagctggccgttcaggttcggcacgggctcgagggcgtagacgacacggccacggggcgcgatcgtcggatcggtgcgctggggcagcgagacgagcgtcgaggggtctcgcatgaggcgccgggtctcgatgaggtcgtcgaaggcttcctcccacgcttgcccgaagaacacgttgtggtgctcgaggtccgcgggaagcggggcgtcctcgtagcgcaccacgacgagggccgagggtgcgaggcgccaccgtcgcttggcgtagccgaggccgagacgtcgaccgaggccgagcgggtcctcggtcgtgacgacgacgtcggccgggtagcgcccctgtggcgtcgtgaccgcgctgatgcggctcccggtgcgttcgtagtgcgtcaccggctcgtcgaggtgcagctcggcgcccaggtcctcgcacaggcgcccgagcgcctcaccgagggccgccatgccgccgcgtggaaaaacgacgccgaggaccacgtccatgtaggcgatgacgccgaagagcccgagtgctcgctgcggggagacgccggcatagagcgcctggaaggtgaccgcccggcgaagcctcgggtcggacaggacgcgggccgcacgagcatccaagcgtccgaaggcgccgagtcgccacagacgccagagcgcgggtgcgcgcgtgagcagtcggtcgacgctggcgacgtcggcttcgatgaaggtcggcagctccgtcccggcgagctcctcgagccagcgggcccagcgctgccactcgtccagggcccgcgtgccggcgaaggcacggacttcctcggccatgcgctcgcgatcgctccaggttcgcagcacccccgcgccatcagggcccgtcgagtctgcgaacgcgagccggtaaccgggctcgacggggatgaggtcgaggtagtcgtcgaggttgcggcccgccgcgcgccagatcgatcgcagcgtaccgaccatggtgagcacgacggggccgaggtcgagcgtcgccccgtcgatgcgcacggcgtcggctcgcccccctgggcgcgagcgacgctcgagaatggtcacccgatgacctgcggccgccagcctcgaggccgcggagagtccggcgaacccagcgccgacgacgatgatacgtgccatcgatcagtgctgacgggcgacgatgaaggtcgcgaggtccccgagcgcgcagcgcgcctcagcggagagcgggaggtcgccgagggcatccatcgcctggtcggcaagctcgtcgatgcgttgctcgacccgatcgagggcaccgctacgacggacgaggccgagcacgtcgtcgagcgcacggccttcgaggttcgcatccccgagcgcctcgtcgaagcggacgagatcggcgacgtcgagccgctctcgggtctcggcaaccagcagggtccacttcccttcgcgtaggtcgtcgccgaccggcttgcgggtgcgagcaccgtcgccgaagacgccgaggacgtcgtcacgcagctgaaacgcgagccccaaggggagtgcgaagcgcgagagcgccgcgagcaccccgtcggccggatccgccagcagcgcgccgagatgcagcggtcgctccacggtgtacttggccgacttgaacagggcgatgtgctcggcgtgctccggggtgtcgaagagctgggcgctcgcgaccacgtcgaggtactggccgagattgacctcgagcttgagctgtgtgaacgtggcacgcaccgggagcggggccgcctcgagggcgccgtcggcaagcgtgagggccaagtccccgaccaagatgccgatcgcatccccgtaggtctcggcctcaccgcggagcttgagggagcggtgctcgtcgcgcgcgcgcgcatgaacggtcacagcaccgcggcgaagttcggagcgatccatgatgtcgtcgtgcacgagcgcgaaggtgtggaggagctcgatcgccaccagcaggtcaccgaggagctcgtcgtcgccgtccacaccgagcccacgcgcggcccagaacgcaagggcggggcggaggcgcttgccgcccgcacgcgtgaggcgtgacagctcatcgaacggttcggcgaagcgttcgtcgatggcgcgccagcgtgccgcctctgcgtcgagcagatggccgaggcgtgcctcgaccaggcgtgtgggggctccgaggacctccggttctgcgacgcacggctccaccaccgcgctcgattcgtcgtccacctgcgcctgactcctcgaccactcgtccttcacgacactgtgcaaccgcgaggtcgcaccgtggcttcccgtaccgagcctagtgacgagacctcggtaggctgaagccgtagcgacctggaggggagcgtcgtgatcgatccggagctggtggacctcgtgctccagcgcgcgctcgcccgtgggggcgacttcgccgaggtgttcgtcgaagaagtgcgctcgacctcggtgagcgtcgacgacgggcgggtcggcgccctggccgacgttggatggcgtggggtcgggatccgcgtcgtcgtcggcgagacgaccggctttgcccacaccaccgacctgtcgcctcgcgcgctcgtcgcggcggccgagaccgcctcgtcgatcgcgaagggaggcgcgagtcgggtcgctcccctcgaggtagcacccatcgagcctgcggcgcccgagcgcgacccgagcgccaagcggcgcatggtggagctgctgcgcgctggtgagacggaggcgcgagggctcgccgatgcgatcgtccaggtgtccggccaggccgcgaccgcgcggcgtcggatcctcgtggccaactccgagggccgattcgtcaccgatcggcaggcacgcacgcgtgtgtcgttccaggtcgtggccgccggggacaccggggcccagagtgggcgcgagacgtctgcggccaccgtcgatctcgaggagttgctcgacgccctcgacgtcggcgccctcgcgcaggtcgctggacgacgggcgcttgccaaactggcggcgcgtcccgctccagcaggcgttctgccggtggtgctggcgaaggggtcgggcggcatcttgttccacgaggcctgcggccacggcctcgaggccgaccacatcgccaagggcgcctccgtgtacgcaggccgtctcggtgagcgggtggcgagcccgctcgtgacgctcgtcgacgacgggacccgggccggggagtgggggagctaccacatcgacgacgagggcaaccctgcccagtcgaacgtgctgatccgcgatggtgagctcgtcgactacctctgggatcgccgcagcgccacgaagctcggccagagcccgcgtggcaacggtcggcgccaggactatcgatccctgccgatggtgcgcatgacgaacaccttcctcaccccgggggagagcgatccagcagacgtggttgcgagcaccgaccacggcgtctacgtggccgccctctccggcggtcaggtcaacacggccaccggagacttcgtcttcggggtgcaggaggcctacctcatcgagcacggccgcatcaccgctcccattcgcgacacccagctcatcgggaatggccccgaggtgctcgctgccgtggatgcggtcgcgaacgacttcgacatgaccgcggggacctgtggcaagaacggtcagtccgttccggtcgggtgcggccagccgacgctgcgactggccggtgtgacgctcgggggaacgatcggtggctgagctgttggagcaggctctcgcgctcgtggacgatcggcgggccggggaggaggtcgaggtcgtcgtcgggcgatcgcgccaggtggaggtcgtcggcttccacggcgcggtcgagtcgctgacccaggccgaggaggtcaccatcggggtccgggtcctcgtggcgggccgcatcggcttcgccacggtcgatgcgctcgaccccgctgccgcccgcgacgcgctctggcgcgcgagagagaacgctgagctcgtcgaggcggaccccgacgcggtcttcgcggtgcccgacgacgtcgcccccgtcgtgctcgagctcgtcgacgagaccctgtcggcggtctcgctcgatcgcaagatcgccacgtgcctcgatctcgagcgcgcgtgtcgggctgcggacccgcggatctgcgacgttcagtcggcgacctacggcgagctcgacggcgaggtcgccatcgcctcttccaccggtgtcgcgacgcaggtccgatcgacccgcgcttggctgttcctccaagcgctcgctgcggatgggcgcggtgtgctctcgacgggttttgcctcgtctggggcgcgaggcttcgagggcctcgacgcagatcgcgtggcgcacgaggcggcgagccgtgcgctccgggggatcgacgccaccaagcccgtgggccgcgaggtccaggtccgtttcgagcctcgctgcgcacagacgctgctcggtctctgggcgggtgccctgtcggggctcgcgctcgctcgtcgtcgctcgatgttcgtcgatcgcctcggagagcgggtcgcgccctcgtggttctcgttggtggacgacccgacggacgggcgctcgctgggggcgaccccggtcgacggcgagggactcgcgacccgaccccatcggctcatcgagggtggcgttgccgccgaggcgctctatgacgcctatgccgctcgactcgccggacggcaatccaacgcggccgcgctccgcgcggttggcggcctgccggcgccgggcgcgcgcgccgtgcgggtcgaggcgccgaggcgaccggtggccgaactcgatgccgccggtgacgtgctcgtcgtgcggtcgctgtcgggggtgcactcgggcaccagcctgatctcgggggacttctccgtggggatcgaaggggaactcgtcgggccgaacggtgctcagccggtgcgtgaggcgaccatctcaggcaacctccagcgcatgctgctcgatctcgctggcgtcggtgacgacgaggtcgaactgccgagcgggacgcgcgcggcgagcctgctggtcggatccatgacgctcgcgggccgctaggtgcgcctcgatctccatgtccacacctacgcctcgggggactcgacgacgagaccggaggagctcgcggcccgcatcgggcccgatgacgtcatcgccgtcaccgaccaccacgcgatcgtcgcggcgcgcgaggtcgcggcgcttgtcccgggccaagtcatcgtcggcgaggagatcgacaccggcgcgggggagctgatcggtctcgggctcgacgctcgggtgccgccgcgtgcgggcctcctcgagacggcgcggcgcatccgcgacctggggggtctcgtgctcgccccccacccgaccgatcccgcgcgtcgtggtctcggtcgagcgggactcgagcggctcgcggacgacggtctgctcgatctcgtcgaggtcgccaacgccaaacgcgtcgcctgggatcgggaggcggcgctcgtggcacgtgagcgagggatcacacaggtcgccgccagcgacgctcacgtacctgaggctctgttcgcgtcctacgtcgaggtcgccgggccgcggtgcgagatcagagggttgacggagctgctcgcgctccttgcgcgtggggcgctgcggcacgcgccgcgcgatccggtacgtccctggccccggccggtggtcccgggctcctgaggctcgaggacgatcgcgctagacttcgcgtcgtggacgatgtcctgtggctctccgccatccgtcgggcgccggtgcttgggcggggtggtcacgagtttggtcgtgtcgatgacgtggtgcttcgcctcgtcgaagccagctatccggtcgtcgtcggcgtcctcgtgcacgtcgacgaccagcccatgttcgtgccggcagatcgcatcgaggagttcggcaccgagcggatcgtcacgacgctcgaagagggcgagctcggccggttcgagcgtcggccccaggaggtgctcgcggttcgtgacctgctcgagcaccacctgatctggtcgaagtcgaagctgcgtccgcgactcgtgagcgctcgggacctcggcatgatcccgttcgcgggcgagtggcgcgtcatcgcggtcgacgtcgcccaagagcaccatcgacgcttctggcacgccaagcgcgaggcgagggtcgtcgactggcgcgatctcgtccccttggtgggccatgtgccgagtgcgaggatccgcctcgagctgcgctcgatccggcgcctgcacccggccgaactcgccgacctcctcgaggacgcctcggagtcggaggggcgcgagatcatggcggcgctgcaggcggacccggccttcgaagcggacgtcatggaagagctcacgccgcagggtcgtcgggacgcgatccgcgagcgcagcgacgccgaggtcggcgagctgctcggcaccatggagcccgacgacgcggtcgacttgttgatgagcctggagcaggagcgacgcgagagcgtgctcgcgctggtgcccgagccgcagcaggcgaccatcaagcgcctgctcgcctacaaccctgagtcggccggtgggctcatgacgaccgacgtcgtcgcgctcgcggcagggacgaccgtcgcggaggcctgcggcacgcttcgcgcgcgcgccgccgtaccggagaacctgtgggtgctgttcgtcgtcgacgccgagggtcgcttcctcggtcagctgcccctcgtcgcgctccttcgtgccgccgacgacgcctcggtggatcagctcgctgacaccgaggcgcgcaccgtgcgtcccgacgcggacctgacggaggtcgccgtcctcatggccgacttcaacctcgccgccgtggccgtcgtcgacgccgagggggtgctccttggcgcggtcaccgtcgacgacgtcctcgttcgcaccatccaaccgggatggcgccgacgtgccgaagcgctcgacgggtagccgcggcgcgcgtggcgtgtgcgggtcgatcgtggtaggcgcgcctgcgagcgctcgcgcgtgaccctcgctggcgcgctcgtcagtggccgaggtggacgaagctgacgaccatcagcatcaccgcgatcaccaggtaggcccgaagcccgatgagggcgacctgacggcctcgcgagaagcgcgggcggtgcaagagggcagcggcgggcatcgtccagcgcagacggtcttccatgggcatcgtgggacgatggtggcggctgcgaagttgggcgatcgcgacgaccgccgtcgcgacgacgacgagggcaccggtcgcgaggacgagcccgatcacgttgatcgagggcacgatcgtcaccaccgtgagcaccaggctcagctgcaggagcaagcccacgatgaacgttgcgaggacgttgagccaaggcgggttgacccaggggccgaggatctctcgatcgttgcacaggagcagcaagaacgcgagggcgctcggcaggaggacgcccgcgaggacctgcacggcgaggttgatgaggctgagggggagacgcgggatgagggtgagtcctccggcgagcaccacgagcgcgacgtagctcgcgtagaagcctcgagcctcgcggacgggggcgttcagcgactgctcgaccccgaacaagtcgccgagggcataggccgtcgagagcgtgaccgtggcggccccgatgagcgacgcctcggcgagcacgatggcaaagagcgcacctgcgacgacgctgacgtggtggctgaagcccgatgcgatcgcgcctgcgctgccaaacgaccctgcggctcccgcgagcgccgcggcggcggcgatgatcaccgcggcggcggcgacgttggtgacgacggccccgatgaaggtgtcggcacgctcgaagcggatccagcgaggcgtgatgcgcttgtcgatgacgttcgactgctggaagaacagctgccacggggcgatggtggtgccgacgatgccgatgatgaagatggtcgcctgcgaaccgaggccgcccttgacacctgggacgacgaggccgtggagtgcggccccccagtgcaccgggctcatgcccatgagggggaagacgaggaggctcacggccaccaggatcagcatgaagcgctcccagcgctcgaaccgtccggagacgacgctgccgatcagggctacggccatgaggcccgccgcgatcgtcgggctgatcccgaagaacccgagcgcgtagcggatgccgatgaactcggtgacgagggtgaggaagttcagcaggaagaggtcgacgacgctgaaggcggcccagaaggtgccgaagcgctctcggagcagcttgccgtggccgacaccggtgacggcaccgagccggaccaccatctcttgggccaccgcgaggacgacgatgaggatcggcagcgtccacagcagcgtgtagccgtaggcctggccggcctgggcataggtggtgataccaccggcgtcgttgtcgccgaccatgacgatgatgcctgggccgaggatcgcgagcagcgcgagcagacgccggcgccagttgggtgagccagccagtgtgccagcggtgacggaaccgagcccgccacggatgacctcatcctcgggcgtgctcgtgcgggagtcgtgcacggggggacctccacgttcgagacgatggccagaacgagcgcttaggcgcggcgtgcgcgccaagcccggacggagcggcggggacttgagggctcggtgcgcatcccagcctcccttcgctgcgtcggggtcctcagtgcatgcaggggcagtctacgccggatggggcgcgagcagggtcaggcggggacgtgcccgatcacgatcgccgcctccgagacgaccgggatgacctcgacgccgccgaagccagcctcccgcaggatcgtgacccagcgctcgcgggagatcggcctttcctggacgcgcaccacgtagcgcacggcgttcttggcgatgcgccagtacccggccggtccacgggcagcgaaggcgcggaccttctcggcgatgatcgcgcggtcgctggcggactcgccgcgcccgagcatcatgtcgccgatcacgaggcgacctcccggccggagccagccgtaggcggcacggaccacctcggccttcgcgcgatcggagagatggtgcaagacgtagttggagaccacgacgtccacgctgcgaggctcgagcgcgaagcgctcgagcggcgtcgcctcggcggtgacgttggcgaggttggcggcgcgcgcgcgctcgaggaggcgggcgaccatccgctcagagatgtcgacgccgtggacgtggtgggcgatggcggcggcgggcaagctcacctgacccgagccgcagccgaggtcgacgacctcgtcggtggggccgagcgcggcgtgggcgacgaccgcctcgacgacccgttcgagccctggcgaggcctcgtgctcccacgatccgacgcgccgttgccacacggtgcgttggagccagattgcaaggtcttcgctgcgtgccacgcggccagtgtaggagagcggggccgaggtacgcttgagggccatgtgcggccgtttcgaccagcggttcgggccggagcgcctcgcgcgagcgatcgccgagcttgcgacgccgctcggcgctgaatcggcgacgccgtcgggcatcgcgtcccgcggcgtcgtcgtgccgtcggacggcgcgatcgtcgtccgtatgagcccctcgctcgaggtcggtgagctcaccttcggcgtgaggacgcgggccggctcgctcgtcatcaatgcgcgtcgtgagacgctcggcgagcggccgctgtttcgcggtgcgctgtcggggggccgctgtgtggtgccgatcagggggttctacgagttcaccgggccgcgcggtgcgcgctcgccggtgttcttccactggaatggcgagctgcactggctctgcggcctcgccgtcggcgagggactcgtcgtcgtgaccgagcctgctggcgggcccgtcgccgggtggcacgatcgcgagcctgtcgtgctcgatcacctgggcggcgccgcgtggctccgcgacggcgaactcgccacgggcggtgcacacgacgccgaggtcatcgtgctcgatcgctcgtggacgtcgccacgtggcgatcgcgacccgttggcgttcggggggcctaggccggatccgacgtgatctcgggggtcgccgattcgtgcgcgccgagccaggtgcggatcttggcggcgatcccgaagccgtcgaggccgagatcggcgaggagcgcgtcggggggaccgtggtggatgtagcgcgtcgggatcccgagcgtcgcgacggggatggtcgggcgcacggcgcgcagcgcatcggcgaggaacgcgccggcgccgccgtggacgtagccgtcttccacggtgacgaccgcatcggccgaactggcgagggcgatgaggtcggggtcgatcggtcggacgacccgtgggtcgatcaccgtcgcctcgaggccatcgtcgtggaggaggtcggctgcggtgagcgcgggcgtcaccatcttgccgtaggcgacgatcacgaggccagatcccgcgtcgcgcaccacccgagcgccaaggcccgtgccgacgccgccgcggatgcgccggggacccggtgtcttcgagaagcggatcaggctcgggccgtcgagcttgagcgcctcctcgagggcgatgcgcacctcgtcggcgctcgacggcgtaaagatcgtgacgtcggggatcgcgagcatctcgacgaggtcgaggacgccatggtgactcggtccgtcgtcgccggtgatcccggcgcgatcggcgacgaagacgacggggaggtggtgcagaccgacgtcgaggttggcctggtcgaacgcccgagagaggaaggtcgagtagatcgcgacgaccgggcgcagcccgaccatcgccatccccgctgcggcggtgacggcgtgcgcctcggcgatgccgacgtcgaagtagcgatcaccgaagcgttcctggaacggcaggagccccgtgggagcgcccatcgcagccgtgatcgcgacgacacgccgatcgcgttcgccggcatccaccagcgcgcggctgaacgcctcggtgaacgagaccggctcggccccctcgatggtcgtgagcgctcgtggcaccttgaggtcgtgcatgcgctgcacctcgtcgtcgaccgctggctggtagccccggcccttctcggtgagcacgtgtacggcgatcggcccgtcccactccttggccccctcgaaggcgtagacgagctcgtcgatgtcgtgaccgtcgacgggcccggcgtagcgaatcccgagggcctcgaagaacacccgcggctcgatcgcttcgcgcagcgcggcggtcaccgaggcgatctgggatgcggcacgagggccgacacgaggaatgtccgagatgacctgtttgacgcggttgcgcgccgacatgtaggtggggttgagtcgcagtcgggtgagcgacgacgagagtcgggagatcgtgggggcatacgagcggccgttgtcgttccagacgatgatgatcgggagcttgcggtgaccgatggtgttgagcgcttcgtaggcgagcccgccggtgagcgagccgtcgccgaccaccgcgaccacccggcggtgtggtgcgctgccggtgaggtcgaagccagcggcgatcccgtaggcatacgacagtgccgtggaggcgtgggagttctcgatccagtcgtgctcgctctcggcgcgattcgggtagccggacagccccccttgctggcggagcgtgtcgaagatcgcgtgacgcccggtgagcagcttgtggggataggtctggtgcccggtgtcgaagaggatggcgtcacggggcgagtcgaacgcgagatggagcgcgatggtgagctccaccgctccgaggttggagccgaggtggccaccgttcgcgagcacggtcgtcacgatgcgttcgcgcagctcggcacagagcgccgtccgttgggcgggggtgagcgagcggaggtcctctggccccttgattcgatcaagtagttcgtaggacatgtaacccctagcttacgacggcgacgaccctcgttgcacaacgcgaatcattgtccacttcgtcccgtaggctcttcgtcgtggggcactggttctacctcgaggtccttggcctgtgcatactggtgacgctgccgctcgaggtcctcggggcgcgggtgtggcgccagccgcgtcggctcgctctcagcgtcggcatcgtcgccgtctgcttcagcctgatcgacgccgtcgaggtgtaccagcgcctgtggcactacaaccctcgctacgtgaccggtctgcgcatcggtgatctgccgatcgaggaggtcgcgttcttcgtcgtgatcccgatctgttccctcctcacctacgagaccgtgcgacgacgccacgagctcgtcgcgcggtggcgccggcggtgagctacacgctcgaggcggtggcgctcgcgatcgtggccgtcgccatcgactggtgggtcacgcgctcgcgtgtggtgcgaaccgcgtcgttctggatcacctgggtcgtggtcgctgcgttccagatccctgtcgacggagccctcacccgactccgcgcgccggtggtggagtaccgatccgggacctacctcgggatacggctcggccacgccatcccgatcgaggacttcgtctacggctttgccctcgtgctcgtgacgatctccctctgggtccggtttggtcgtcgcgcgagtcgctagggtggtactcaggcgtcgacagagcgtctctggcggctgtcgacggcgaagcaggaggtggcgcatgctcgtgctcatcgcgctgatcgcgttcgtcgcaatggaacccgtggccgcgctcgtccatcgtgggatcatgcacggtgtgggctgggtgatccacgcctcgcaccatcggccccgggaagggacgttcgaggcgaacgatgccttcccgctgttgttcgccctccccacgatcgcgttgttctggttcgggcggcatgaccctgtcgctgttgcgatcgcggtgggcatcacgctctacggcgtcgcctactcgttcgtgcacgacggctacatccacgagcgcctcggtcggatgccgaaggtgcgctacctcgagtacctcaagcacgcccatgcggtgcatcacctctacaacgagggcccctatggcatgctcgccccgatcgtgcccgccaagcatcgcgcgaagctcgagctcgaggcggtgcgcgcctggcgtccatcggtcgcacggtaggagcttcgctcctcgcatcgacgagaccagacagctagcatcgggacggtcgagcgaaggaggctgatcgtgccgaaggtgctcatcctgaccggcgacgctgcggagtctctcgaggtcttgtatccctaccagcgactgctcgaggagggctacgaggtcgatatcgcggcaccgtcgaagaagaagctccgcttcgtggtgcacgatttcgaggagggcttcgatacctacacggagaagccgggctactcgtggcctgcagacctgagctttgcggaggtcgaccccacggcctatgtcgcgttggtcatcccgggcggtcgggccccggagtacatccgcaacgaccccgatttcgtccggatcgtccgccacttcttcgaggctgaccagcccgtcgcgcagctctgccacgcgccgatcgcgctcgctgccgccggcgtgctgcaggggcggcggtcggctgcttatccagcgcttgcaccggacgtgcgcgctgcggacgccgagttcgtggatgcggcggcggtggtggatgggcagatggtgtcggcgcgcgcgtggccggatcatccgagctggatgcgggccttcatcgggatcctccgcgagaaggctccggtcggctgagtaccgtgccggccgcgaccagcttgtcgtaggtcggcatcgcacgacgggtactgtcgcgatcggtgcgacgtctggccacggtggtggcgcggcgaagctcgcatctcgcggcgtcgacggtcgtgtgcgagccgaggtgtcacggcgcacccgtcggtgactcaggggggtgctgtctgctcgagcacgtcccggagagggcaccgtctgttcgggcatcgtctggtcggggcgtcgggtggcctcgccggttggctggaccggttgtacaggaccagccgcgctggatggtcggtgcgagaccctcgcgggcgatgaggtgcgctcgcggtcgtgccgagtgggtcagtcctgcgcggcgaagttcggccggatctggaacagcaagtaccacccgatggcgatctcgatgagcgtctcgagcacaccgccgaccccgacgaagatggcgatgacgatgccgaaggcgagctggaggaccgtccccacgaagatgaggcgccagcctcggtagcgtccgcgcttcagcggtcccgtggccgcgatgtagagtacggcgaagaccgccgtcagggcggctgcgaggtagagctcactcgtaacgtgggtactcacgaagaagatgcccgcgagcgacgagccgagctcggtcgcaaggcgtgcgagctggacggcgtcgagtgcgaagaggatcccgacgacgaggctgatcagccacgcccaacgggtgagccacgccacggctccggcgggtagcttcggcaagccctcgctcagcgagccgaggcgctgctcgagcgcagtgatcacgacgacctccagttctcagcgatgtctcagtgtagcgacactcggtacgacgaagcggtcgttcatggggcggggcgaggagtggcgatcggcgcgacggtcccggcaccgaggtcggcgaggcgcgctgcgtcgatcgcgacgatggtgtcgggcgtgcccgcggccacccatacgacgcccgcacgagcgagctcggcgtcgaccaccacgcaggcagtcggcggcgcgatgagtggggtcgcgcccccgggcacgacgccgagcgcctcgatgaggtaggtccccggtgcgggctcgatgcgctggcgggccgcgcgctcgagcgagcgtcgatgcactctgcgatcgcccgcgacgacggcgagcaccgggccaaggtctccgcggaacacgacggtcttggcgatcttgtccgggtgcgtgccggcggctgcggctgcatcggaggcgaggtgggtcccggtcgcgaactggcgaatggtcgcgaggacgcctcggcgtgcgaggcgctcggcggccaagccagcgggatcggcgagcagttgcggcgtcatgcctcgagcgcgtcgacgatcgagacgccggccgggccgtcgagctcgccgatcacgagcacgcgcaccggctccccggccgcgacaccgtcgccgtcggggaccagggcgagcacgttggcgcccgcgagccctgagagcacgtgggagccctgaaggcggtagggctcgacgacgagctcgccgctgcgaacgtgggcccgcgcgcggacgaggtgcagcttgccgtcggggtggcgggtgatgggttcgagtgccctcgcggtgaggaccgggcgatgccaggtccgagcaccgagcatcttgcggatgagcgggcgtgcgaacaactcgaagctgacgatcgacgacaccgggttgccgggcaggccgatgacgggtgtctggcccatgcgcccgatggcgagcggcttggcgggcttgatcgcgacctgcatccagcgcatggttccccgctccgcgagcacctgcttggtgtagtcgaagtcaccgacgctcaccccgccgctcgtcaggatgagatcggcgctcgcagccgcctcgtcgaaggcgcggccgaggagcgctggatcatcggggatcgcgccgagatcgctgggaatgcctccggcctctgcgacgagggcgaggagcgcggggcggttcgagtcgtggatcttgccggggggaagcgggtcgaggtcggtgagctcgtccccggtcgagaacaccgcgacccgcggccgacggtggacgaagaccttgcggacgccgagggacgcgagcaggcctctgaccgctggcgtgacgggcgtgccctcggcgaggactcgctcgccggcagcggcgtcggagccgcgtcgacggacgtgcgtgccggccgcgatcggagcggtgaggtggacctcagagccgtcgacgatgacgtcctcgacgatcgcgatcgcatctgcgccctttgggatcggggcaccggtcatgatgcgtgcggcggtgcccgcggtgacgacgacgtcgttcgggtcgtggccggcggcgatggtagccacgatcgacaaggtcaccggcgtggcgcggctggccgcttgcgtgtcgacgctacggacagcgaagccgtccatgccggtgttgtcgaacggagggagcggatcggcgacgacgaccggcgcagcgaggacggcaccgagtgcctcgtcgatccccacctcgaccacgggtctcgcaccggcaagctcgagggctgctgcctgggcttcagcgagtgggatcacggtcctcctctgtcgtctcgaggagctcggtgagcacccttcgcagcgccggaccgaggtcgggccgttgaagggcgagctcgacgacgctccggaggtagtccagcttgtcgccgatgtcgtagcggtgacggccgtcgaagcgcaccgcaacgaccggctcgtgctcgatcagccgtgcgatggcatccgtgagctggatctcgcctcccttgccgggcggggtctcggcgagggcgtcgaagatcgccggcgtgaagatgtagcggccggtgatggcgagattcgacggcgcctcggaggcatcgggcttctcgacgacgctgcggacgtagtcgacaccgtcctcgtcgacgacaccggcggcgccgtagagcctgatgcgctcgggcgggacctccatgagcgagagcaccgaggcgccggtgcgctcgtggagggcgagcatgtcggccaggagcggcgaggcgggtcccatgatgtcatcggcgagcatgacgacgaaggggtctcggcccacgtgctgggcggcgacgctcaccgcgtggccgaggccacgcggttcgccctggcggaggtagtggatctggccgagatgggagatgtgctcgaccagcgccagttcggcgaacttctcttgcctggcgaggaggagctccagctcgacggcgcggtcgaagtggtcctcgatcgatcgcttgccgcgcccggtgacgacgaggatgttggtgaggccgtgcgtcacggcctcctcgacgacgtactggatggccggctggtcgacgaccggcagcatctccttcggttgggccttggttgcagggaggaaccgtgtgccgagcccagcggctggaatgaccaccttggtgagcacgaccgcctccatccatcgtctggcgcctggccaacagagcggagtctaggcgacgagaagggccaggttggggcctacgatggaaggtaccaacgtgcgcgccgtgtgcgcgagttgcgatcgtggtgcgatgagtcgttcgaccgaggtcgaggaggacaccgatgccgacctacgagtatgcctgcaagcagtgcggcgagcacctggaggtcgtccagtcgttccaggacgagccgctcagcgagtgcccgcggtgcggcggcgagctgcgcaaggtgttcggctccattgggatcgttttcaagggttctggcttctacaagaccgattcgcgtgcgagctcgtccgggtcggtcggtcgcagccacggctccggtgggagcgatgccgcgagcgctcccgcgtcgacctcgtccacgtcgacgtcgaccacgggcgctgagtcgtcctcgtcgagttcgtcgacggctggctctgccgcctagggtcgcctgcccgggcccgggggttaccggacggtaggctacgtccgtgcacaaccaccaggcctggtgcggtccttcggccgtgcgagcgagtcggggcgccagctctcgtggctgaggatcgtcttcgtatcgccctcacggtgtatcgagggaaccccacctccggaggccaaggcgtctacacggccgaactcgcgcgccgtctcgtcgcgcggggccacagcgtcaccgtcgtgtcgggtccaccgtatcccgcgctcgccgagtcgatccgcctcgagcccctcggcggcctcgatctgctgcgccagccggatccgtttcgccggccccgactcgacgaactcaccgacgcctacgacctggcagaggtcgcgctcttggcgaccggcgccttccccgatccccgcgcgttcggcctgcgctttcgcgcctggtggcggcgtgagggtcatcggttcgacctcgtgcacgacaaccagtcgctgacgccagcgcacgccgagctcgtgcgcgacggcgtcccggtggtggccgcgatccaccatcccatcaccgtggatcgccagctcgccctcgcggccgctggatcggtcaaagagcgcatcggcctgcgccgcttcttcggcttcgtgccgatgcaggtgcgcacggcgcgggtgatgccgcgcgtgctcaccgtctcgtccgcctcggctcgtgacatcagccgcgagctcggggtggcgcgctcgcgcctccgggtcgtgccgatcggcgtggacgcggaggtcttccgacccctcgaaggggtgcagcgcaccgccacgttgctcgcgaccacggcgagcgcggatgtgccgctcaagggtctcggggtgctgctgctcgcgctcgcgcgcctgccgagcgacgtcgagctcgtcgtgatgggcccgcgccgggagggctcccccatcgaggcgctcatcggtcagctgggcctcggtgagcgcgtgcacctcgtcggtgcggtgagccgcgagcggatggtggaggtgtacgcgagcgctgcggtcgcggtcgtgccgtcgatgtacgagggcttctccttgcccgccgtcgaggcgatggcctgcggggtgccgctcgtcgcgacgaccggtggggcgctcgcggaggtcgtcggcgggctggcgccccaggtgcccccgggcgatccggtcgcgttggcccaggcgatcgccgcacagctcgccgaccccgccggcgcccgcgagcgcgccgcgagcgcgcggagccgggtgctcgcgcgctactcgtgggacgaggcggctcggcgcaccgagcaggtctaccgcgaggtgttggaggcgtgatcacctttcggccggagcacctcgcaccgctcgagggtcgtcgcgtgctcgacctcggtgcgggtggcggtcgccatgcggcatggctccgcgaccacggggccctcgtcgtcgccggcgacctcgtcgtcgaaccgaccgatcgtgagggggtcgactgggtccgcctcgacggtgcggctctgccctttgcggacggctcgttcgacgtggtgctctgtgccgaggtcctcgagcacgtcgcgcacccggctcaggtggtgcgcgaagcgcggcgtgtgctcgcacccgggggccagctggtcgtgagcgtgccctcggcgtggccggaggccgtctgttgggcgctgtcgctcgagtaccacgccgttcccggcggccacgtgcgcatctggacgctcgcagggatccggcgcctcctcgaggccgagggtttccgcgtggtcgcgcgccatcgccgtcacgccctgcacgcgccgtactggtgggctcggtgcctgctcggcgtggagcgctcgggtcaagatccgcgcatcgagtggctggggtggcgtctcgtcaaggcggccgtcggcgaggctccgctgctcgcgcgcctcgagacgctgctcgaccccgtcctcgggaagtcgctcgtcctctatgccgaggccgcaccgtgctgagccggagcgagctgcgtcgcaccgcggcggccatcgcgagggtccagttgccctcggggatgatcccctgggccccgcgtcgccatggcgatccgtggaaccacgccgaggcggtcgccgcactcgcgctcggtggggaactcgccgccgccgagcggggtctggactggctggcgggcgtggtcgcgcgagacggtgccttctgtcagtactacctcgcgagcggcgtcgaggagcctcggatcgacctgaacgtgtgtgcctacccgatcgtcgcgatcgtcgcgtgggtcgcggcagggggctcggtcgcgaccgcacgggcgcacctcgcgtggtaccggcgcaccctcgagctcgtcctcggccaccagctcggcgacgggaggttcccctgggccctcgaccccgggcgtcgtcccctcgagggctccttgcgtgccggttcggccgcgatggtgatcgcgctcgatggcgccgcctgggccgcgaacgaactcggggtgctcgaggctgggccgatcgaggaagcgcgctcgcgtctcgcgctcgcgatcgccaaggacgaggggttcctcgaccgcttcgagtggtcgatggactggtactaccccgtgctcgcgggcgtcctcgagctcgatgcggccgaagatcggctcgatggactcttcgagcgggcgcgcgagtcgaccggccagctgcgctgcgtgctgtcggctccgtgggtgacgacggccgagaccgccgaggcggcgatggcggcctggcgactcggtcgcatcgcagatgcccgagcgctcctcgcgtccgtcgagtccctccgcgaacccgacggctcctaccgcaccggtatcgtcgtgccggagggacactccttcccgaccggggagtgctcgacctactcggcagccgcggtggtgctcgcgcaccacgtgcttcgtgccccgccgcgcgccggcctcatcgaggccctcgtcgcggcctcgtagcgcgcctcgcgatggcgagcgagccggtgcgctcgacgaggtcgaagccgaggtggagggcggcggtgagcatgcgccacggtgcctggcccccgtcggccgggtcctcgaagacgtcgtggacggcgagcagcccgcccggtacgaggaagcggcgggcgagctcgagatcgagatggcagctccgcgcgtcgtgaccgccgtcgacgaggacgaatcctgccaccgggcgcacgaggtcgatgaggccacgcccatcgcccacccagagggtgacgtgacgctcgaggtcagcgagcgccagggcgtcgcgcagcgtcccgagcgagtcggggctaccgaggtcgccgtcgaggagacgcgggtcggcccaggggaacggtgggcgcatctcgatggagccccggtggtggtcgacggcgaggaggcggaggcctcgttcgcgtgcgaccgagccgagccgcacggtcgagcgaccgcagtaggaaccgagctcgacgagccatccgcccgctcgcggggcgactcgcgcagcctcgatgagcgcacggagctcgtcggcggggaagaagcccgggagtaggtcggcgagagcagccggcccgtctcgcctaggctggtcggcgtgcagcttcgctggatcgtcgtcgcgctcgtgacgctggcggccggcggcgccctcgggggcgccggctggatcgcgggtgccatcgcggcggccgtggtcgtggccgccgggaggcgatgccgaggggcctcgtgcgcgagctcgcacggcgggctcaggcgagttggctggtgagccgtcctgcgtagcgggcgcgcaggcgcaggttgacctggtagcgctccagggtctgggcgagcacgcgcttgcccgccgggatcgggtgctcctcgaggaagcgtacgatctcgccggcgcgctggtaggtggtcggtccgatgacgagcgcgatgctctggagcatgcgatcgatcgtgttgagcgggaatcgggcgagcatctcatcgaagcgagcgaacaagaagtcgatcgcctggttctggagcgctgggttcgcgatcactcggttgatgaggaagggtgcgtcctgggttcgcacttcgctcatggccagatccagcacgcgccgcccgagcgctggttggcggaactccgcgagggcgaacaggtgacgctgctcgtcctgggggttgcgcgggtgccgatagcgatcgagcatgaaggcaaagtccgactcatcaccgaagcgcgcgacgacgccgaggacggccgcgacgagatcggcgctcggcccgccgatgccgctcatctcctcacggaagcgttctctggcgtgctggcgcacgtcgggatcctcggcgatgtcgccgagcacgtcgtaggcgatggcacgcgcggtgcgatcctgcggggtgtccgtcgggcgggcctcggtgccgaagtagtcgaggaccggtccgaacaccgaggccgcgagggcacggacgtgggtgatctcgctcggttcggcgatgcgctccagcaggccgagtgcggcttggccgatcccgaggatgttcgggtcgcgctcgtcgcggaggcgctcggcgagaccgaggaagtcctcgagtggcgcggcgcccgactgggtgagcgcccatgcatcggcgatgaggttgaagcgctcgagcgtctcgagctggccgaacgactcggccagctgggcgaggagctgttgggcgtagcgggcccgaaagacgccctcgccgtgggcgttgaccacgaccggcgcgggaccgacctcggccgacatctcgggctggtcgagcagcacccgccgctcgccatcgacgagcgagcgcagtgcgatcggcacgtgccacagtgatccgatggcgccgatcggatcgtcgtcggccgcgaggagccggaacggcgtctgggcgagccggacgccatcggggagcggatcgacgctgacgagcggatggccgccctggaacacccaggtgtccatcatggcgccgacgtcggtaccgctcgcctcgccaagggcagcccagagatcctgggtctcggcgttgccgtaggcgtgggcccgcaggtagcgacgcacgccgtcgcggaagacctcgggtccgaggtgctcggaggccatgcgcaagatggacgcccccttctcgtaggtgagaaggtcgaacatgtcctcggcgtcctcgggtgcgcgcaccgtgtactcgatggggcgggtcgagggaagggcgtcgatgcccatggccgcgagccgaccgatggcaaaggcctcccaccggcgccactcggggcggaaggcgtcgacggcggtgacctccatgaaggtggcgaaggcctcgttcagccagatgccgttccaccagcgcatcgtgacgagatcgccgaaccacatgtgggcgagctcgtggcagacgacgtcggcgacgcgctcgagatccacctgcgcggcgttgtcgcggtcgacgaggagggcggtctcgcggaaggtgatcgcgcccaggttctccatcgcgccggccgcgaagtcggggatcgcgagcaggtcgaccttgggggcggggtaggcgatcgcgaagtagtcctcgaagaaggcgagggcgtgctgggcgacctcgagagcaaaggccgtgagctgctccttaccgggcacgtgcacgacccggatggggacgtcgcggtggaagaccggctcggtcgcgacgaagcggccgatgaccatggcgagcaggtaggtggacatcgtcatcgtgggcgcaaaacgccaccggtcggtgccgggtgcgatcgtcgtgcgctcggtgacgggatagttcgagtaggcctcgaggtggctcgggatctcgagcgtgacggcgaaggtggccttggcgtcgggctcgtcgaagcaagggaaggccttgcgcgcaccggtggattcgaactgcgtcgtcgcgatgcgatgcgtcgtgccgtctgcgtcgcgataggtcgacaggtacagtccgtcgaggtcccgacgcagcgcacccgagaagtcgagatcgagcgcgaaggggccggctggcatgggcgcatccgcgtggagctcgaccacgccgtgctcgctgcgcgggcggggtgtgagggtgacgcgcgtcccggcgaacgtggcgatcgccgacgagatcgccagatcgaccgcgtgcacctcgagcaccgcggtgggctcgtggacgtcaccgtcgatgcgcacgtgacccgtgtaggggtcgacgtccgggtcgacctggagcgtgaggtcgtagtgtcgaggggtccagacccgcgaaagccggtacgggttgtgctctgtcacgggtgccacgctagctcggcccaggtccctgtgagacacgatgccaccggtaggctcgccgtgtggccagacgagacgtggtagcgctggggtcggcgatcgtggatctcggggtgcgggtgcgcgctcgggagatcgatcgtctcggccttgcacgcgggacgatgacgcttgccgaggccgaggacctcgatcgcctgatcgaggcggtcggtggtgaggtcgagatccgaggtgggggatcggccgcgaacacggccgtcgggctcgcttcgctcggggtcgacaccgccatggtgacccaggtgggcgacgacgacctcggggagcggtgggcaagcgaggtcgccgaggccggcgtcgaggtcgtgctcgtgccggcgccaccgggctcgcggaccgcacgctcgttgatcatggtcgacgaggggggagagcgcaccatggtgacctcgctcggggtcgcgagctcgctcgatgtcgacgagctccctctgcccctgctcgccgaggcccgctggtgcttcgtcgagggctacctgctcgatgcggccggcgacggactcttcgagcgcctcgatgtggtccggcgtctcggcggtcggatcgccctctcgctcggtgaccaactgctcgtcgaccgtcaccgcgatcggctcgtgcgggctctcggtcgcgtggtcgacgtcgtgctcggcaacggcgccgaggcggcccaactcgtgcgtcgccaggccctctcgaccatcgtcgaggagctccaggctcgcggcgtcgagggcgcactcacgctcggcgccgatggcgcggtcgtcttcagcgcggacgaggcgctccatcagcctgcgcccgagaccatcgcagacgtcgtcgacaccaccggtgcgggcgatcagttcgcggccggctaccttgccgcgctcgtccgcggtggcgacctctcgagccgagcgatgctcggcacgcacgtcgcgaccgccgtcgtgacgcacgagggcgcgcgtccacggcccgacaccccactcgccgcggctccggcgctcaccgaactcttggccgggctcggactgagtcgtgaggcggatcccgccttcgacgagcggtcgagcgatgagcctgtggcgggggagcgccacggcgagtgacgagccatcgggcccgcgcgggtgggccgtggacctcgtgtgcgtgcggtcaggtcgccctgcgtcgttcgtcggcgcgcggggggcccgccatggctcgggtacctcggcgcgcaggtgccggcagaagttgcgcgatggtcagggcgtcgggctgggtgagggaccaggagcagctgggctgcgacgattcgtgagccagacgagggtcgcgagtgcgacgccgaccccggcgaagagccaggtcagctcccgcgcgccgaggcgcgggaggaggagcgctgccgcgagacccgccgcggtccacccgatcgagtagctcgcatagaggacggagaaggcgctcgtgagttcgttgggcgcgaacatggtggggacgagtccgacgcggagcgcgttgatcggcgcgatggcgatgcctgcggcgacactggtcgcgagccagagccacgcggcaggcgccgagagcccccaggcagccagggccgctccaagaccgagcacgagcgctgcgagggtgctcacacgtgcgggccgatggctccagatgcgcgtgtagacgaccccgctcgcgaccgagccgacgctcatcgctgtgagtgcgacaccgccgagcgggctcgatcggagccagtgcacggcgagagggaccgcgagcaggaccgcacccccctcgagcacgccctcgagcgccgagagcacccagagccaggtgccacggcggagccggtgggggagggctcgctggtcgatgtgcggcctcgtgcggtagcgaagtgccccgacggtggcgacaaggccggcgagtgcgacgaggtcgaggaggagcggacggaggccgacgacgacgaggacgctggcgacgaggggcgccccgagccacgtgagctcctgggccaccgagtcgatggcgaaggcgcgcccgcggtcggaaggatcgaggcgatcggtgaggttgcggcgcagctcgcccgtgacgagggtcgctgcggcaccgacgccgaacgcgccgacggcaccgagggcgagtggggcaccgacggtgacggcagcgagcagcgcggcggcgcaggtcatgaggccgaggcggctggggagcgacgcggcagcgacgaaggggacggcgagcagggcgagcgcgccgacctcgccgagggggacgagtgccgcgaggccgctcgcggtggcgtagccaaggcgcgcaccgacgacgtaggtgatcgcgatggggacgaggaagttcgcgacgcgatagggggtggcgagcgcgagccatcgagcgagcgcgcgaccgggcggcgcgctgcgttcgaccatgggagtcaccctaccggcgagcgcacgacgaggtgggcagggcagcgctcgtgtgattggatggtaggcgtggcacttccactcgaacagtacggcttcgtcggcgatctgcacaccggcgcgatgatcggtgcggagggcagcgtggcgtggctgtgcgtgcctcgcttcgacgccgatgcgtgcttcgcgtcgctcctcggcgacgagtcgaacggcacgtttcgcatcgctccgtcgggcccgttcgagtcgacgcagacctacgtcgaggacacgctggtcctcgagacgacctttgcgacccggactggtcgtgccaaggtcatcgacttcatgccgatccgagagcgccatgcacggctcgtgcgcatcgtcgaggggatctcgggcgaggtttcgatggaggtgaccctgacgctgcgcttcgactacgggcgctccattccgtgggtgcggcgcgtcgcgcgtggccactcgttcgtcgtggggccgatcgcggccctgctcgagaccccggtcgagctcgagggtcgcaatcagcgcacggtcggttcgttcgtggtgcacgagggcgagcgggtcccgttcgtgctcagtttccacgactccgtcctccccccgcccaggcggatcgacccccagctcgagttggccggcgtcgtcgagtggtggcggcgctgggtcgccacttcccaggtgcgcttcggtcgctacgagccccttgcgcgacggagcctgatcaccttgaaagcactcacctacgccccgacgggtggcatggtggccgcgctcaccacctcgctccccgaggaccccggtggttcgcgcaactgggactatcgcttctgctggctgcgtgacgccgcgttcgccgtggaggcgttcctcgcgcgcggcatgctcgacgaggcccgcgcgtggcggggttggctgttgcgcgccatcgcgggggacgcgcgtcagatccagatcctctacggggttgggggtgagcgcaggatccccgagctcgaactcgagtggctgcccggctacgaggggtcgcggccggtgagggtgggcaacggcgccgcgggtcagttccagatggacgtctacggcgaggttgccgacgtgttgtggcggatggtgcgagctggcatccgtcccgacgagaacgcatgggagatccagcgctacctgacggacttcgtcgtgtcctcctggcgtgagcccgacgacgggatctgggagatccggggcgagcgccagcacttcacccactcgaagatcatggcctgggtggcgatcgatcggggcgtcaaggtcgccgaggcgatgggcgtcgaggcgccctcggcctggcacgcggcccgcgctcaggtgcacgccgccgtgctcgaggaagggtggaacgagtcggtcggtgcgttcacccaggccttcgggtcgacgcggctggacgcggccgtgctgctcgccccactcgtcgggttcatcgaccccgacgatccgcgggctcggcgcacggccaagaccatcgcccgatccctcacgaagggcgggttcgtccagcgctacgagccgaccgccggtgtcgatggcatcggcgagcccgagggtgcctttctgccctgcaccttctggctggtgcagaacctcgccctccagggcgaagtcgacgaggccgaggtctacttcgagcgtgcgagccgggcggccaatgcgctcggcatcttctcggaggagtacgagccgacggagcgacgcatgctcggcaacttcgcccaagcgttcacgcacgtcgccatgttgcacgccgcccacgcgctcgagcgtgctcgcgaggcccgtcgcgacggtgagcgtgagcgccagggggcctagcctcagttctggagatggtcgagcaacgggaaggactggccgatgacgcagaggattccgttcgtgctcttcggggcgaccggcgacttggctcgccgcatgctgttgccggcgctcatgtcggtgcgagagcgccatgcagactaccagttggacatcatcggcgtcgcgggtagtcgtttcgacgacgagagcttccgtgcgcacgtggtggagatcctcaccaaggacaagcgctgctcccgcgaggaggccgagaccttcgcgaagaccatcagctacctctcgggcgactaccacgacccgaacctcttcgacgcactggccgctcgggtctcgcccgacgagcgtcctatcgtctacttggccatccctccctcgctcttcgaggtcgtgatcgaacagctcgcgcgcgccggcttcgacgagcacgctcggatcatggtcgagaagccgttcggccgtaacctcgccgacgcccagcgcctgtcgaaggtgctcgcaagccacttccgacccgagcagatcttccgcatcgaccacttcctcggcaaggaggcggtgcagaacctcttggtgttccgcttcgcgaactcgatcctcgagccgctgtggaatcggaactacgtctcgcggatcgagctcaacatgctcgaggcgttcggcgtcgaggggcgcggcgccttctacgacggcgtcggcgtggtgcgcgacgtcgtgcagaaccatctgctccagctgctcacgctgctgctcatggagcccccgctcgcgatgagcgggcgcgacctcaccgaccagcgcacgaaggtgctccaggccatccgtccgatccggcccgacgacgcggtgcttgcccagtaccgtggctatcggctcgaggccggggtggccgacgactcgtccacgcccacgtacgcggcaatccgcctcgaggtgaactcctggcgctgggcaggggtgccggtgttcgtgcgtgcgggcaaggggttgcgcgagacccgcaccgaggcggtcgttgagttccggcgcccgccgacgctgatcttcggcaccggggaaggggagcagcaccagcccgagccgaacgcgttcatcttccacttcaagcccgacgggcgcatcgagctcttgatgcagtcgaaggtgcccggtcctcggctgatctcgagaccgacgatgctcacggtgtcctcctcggacgactcggcgcgctccgacgacgcctacgcccagctcatcgacgacgtggtgcgcgacgatcagacgcgctttgcgacccaggagtcggtggaggctggatggcggatcgtcgatcccgtgctcgaggcgccggccgagtcgacctacgtcgtcggcagtgatggaccgcgcgaggccgatcgcctcgtcgccgacgtgcatgggtggtatcgatgacggcgcaggtggcgagatgggggtccgacgatgagtgacgagatcctcgcggtcgatctcggcgggacgaactttcgcatggccaaggtgagcagcgagggcgtgctgctcgctcgggccgagatcccgacggcgtcgatcaccgacgtcgtggacggcctcggtcggctcgtcgaccaggtcgacggtggcggggtcgcaacgctcgtgttcgcggcccctggcgtcgtcgaccgtgacgcgggcacggtcgtcttctgcgggaacctcgatgacgccgtgcggcgcaccatcgtcgcgagccggatcgccgatgcgctcgccaagcgcgtcgtcctcgtcaacgacgccgatgcggccgccatcggtgaggcgtgggcgggagccgggcgcggcgctcgaacggtcgtgtacgtgaccgtctcgaccgggatcggtgcgggtctcgtccaccgcggcacgctctacgtcgggcgcttcacgggcatggaggccggtcagatccgtctcggcctcgaagacgtcgatcgcgccgagcacgtcggttcggggaccgcgctcgctcgtaccgcccgccagctcgggctcgagctcgccaaccccgaggtcgtgcgccgcgcgcaccaggagggtgtcgcgcgcctcgcgctcacccgcacgatggaggcgctcggggtcacgctcgccaacctcgcctggctcctcgtgcccgatcgcatcgtcatcgggggcgggctcggcctgtcggatccgctggtcctcgagctcgccacgcaggcgttccaccgcgccggcccggcgttcctcgaggatctctccatcgtcccggccgcgctcggcgacgacgccggactcatcggggcggcgttcgcggagcgggcgctccaaggcgcccagtgaggttctcgctccagtcgacgcgctcgctcgcagcgctcgctggggcgagcatcctggtcggtgcgtacgatcaggcagcgatcggggtcgccctcggtccgctgcgacgcagctggcacctctcgagctccgaggtggcgctcatcgcctcggcatcggctgcggggatggtggtgggtggcctcgtggccgggttcctcgccgatcgctgcgggcgtcgtcgcctgctcgtcgtcgacgtcgcgctgctcgcgctcgcgagtctcgccgctgcgttcgcacctggggcgggtgtcctcctcgctgcgcgcttcgtcggtggggtcgccgtcggggcgagctacacgatcgtcttcgtctaccagcgcgagctcacgagcgccgcgatgagcacgcgttggatggcgaccacgctctgggcggccaactggggcatgcttcttgcctacggcgtcggcgccgtcgcaggtggcaccacgttgggtgcgcgcatcgtcctcggcgtcggtgcgctcggcgcccttccgctcgttgcggcccgacgtcggctcccggagacccggacgacggatgggcacctctcgctccgcgcgagcctcgcagccctccgttcggtgcgagagctcgaggccgcgggggcgtggttcctctatcagatctctgaccagggcatcaacgtgctgctccccatcgtcgtcgccagcctcggcgtggtgtcgctgcggagcgccgatgcgacggcgctcgtcgtgaaagccgtgaccatccctgcgtcgctgacgacgatctggctggtgggttggctcgggcggcggcgtctccagttggctgggttcctcggccgagcgctcgccctcgggctcgtcgcggtcgccttcgccctgggcgctcctctcgtcgtgaccgtgatcctgctcgcggttggtcttgcggcaggctccatgggccccgacaagacgacggtgatgggggcctgtctcgaggacgagccgatggcgctcgcgacgcgccagggcgtcgcacagaccgcaggtcgcctcggtggcatcgtgggaccggcggcgttcgtgctgctgaccagcgtcggtggcccggcacccgggatcgccctgttcgcgctcagcgcgctcgcgggctgggccatcaccctcccgatgacggcgtgagctggtcggtcggctagctcgcggcttctcggggcgcgtcgcccaccagcacgtcggtcgcgacctcgggagcgacgacgttgatgggcacgccggtgccgagctcgaagcctgcacgggtggtgagcttcggatagacgtgggcgtgccagtggaactgcccgaaggcgcgatagggcgatgagtggaacaccacgttgtaggcgacgggcccaaggcgcgtccggaggcgtgcgaggccgtcgcggaccatctcgccgacggcgaacaaggtctcctgggcagcgaggtggaggtgggctccgtggtgacggggcacgatgagcagctcgaacggcgtcgccgaccagtagggcgcgatcacgaccgcgtgttcggttccgagcacgaggcgctcaccgatgctctcttcgagtgccaccgtgttgcagagcagacatcccccgacgaagcgcgcaaaacccgcctgctcgtcggagagctcgcgtgggacgaaggagatgccgaggagctgtgcgtgggggtgggccatggaggcgccggcgtcacgcccttggttgacgatcacctgggagtagcggatggcagccgagtgtgagtgcgcctcgatccgatctcggatggccgacatgaccacgtgcgtctgctcgtcgtcgagcgctgcccagctcgcgtcgtggtcgggggtgagcacgaggacctcgtgaatgccgctcgcgggtgcgctcgtgaagaccggtccgtgggtcgtcgagaccatgggctcgtcaccctcgaaggcgggatagaggttcgggacgacccgtacgctccacgagccgctcggcccgtaggtctcgagggcgggaggggtgtcttcctcgttgcccgggcagaaggggcaaggacgcgagtcgtcctcagggccgtgctcgtcggagagggcgagggcctttggacgccagcgacgctgctctgcgacgacgacccagcgaccggtgagtggatcgaggcgcagctgatgcgtggccatgggctccctctgctgagaacggacttatcgcccccagcgtagcgcgtcggcggttgctcgggcgggcccgccggtcgctggcgctcgtcgtggttgggtgtcgcctcgtagactcgctcccatggcggtctacctcgaccacgccgcgaccacgcggatcgcgcccgaggtcagggcgctcatggttgagctgctccgcgtcgagggcaaccctgcggccgcacacgcctgcgggagggccgcgaaggccattctcgagcgggcacgggtcgaggcggccgacgcgctcggcgtctcgtctcgtgaggtcgtcttcacgggttcggcgaccgaggcgctcgacatcgggatcggcgatctcgacctcgcgcccgacgtcgtcgtggccacgagtccgatcgagcaccccgccgtgctcgatgcgctcgcggggcggcccatcgtcgagcttcccctcgacggcgaggggcgagtggccatcgggtcggcgcgcgagatcctccgcgacctcggcccacggctcggagcgctcgtcgtgaccggggctgcgagcgagaccggcgtcattcagcctgtcggtcggctcgcccacatcgcacgcagcgtcgctgcgaaggcggtcgtcgtgagcgacctcgtggcgctcgcaccgctcgggctcgacgcgggctctccggctcgtcggatgctggaggtcgtcgacgtcgcggtggtcgcgccgcacaagctcggcggtccgacgggggtcggagtcctcgtggtgcgggagggaacgccgctcgcgccgcggcgtcgctacgtgggccaggagcgcggcctgcgcggtgggacacaagcggtgtggctggcggggggtgcggcacgcgccctcagccttgcggctgcccagggcgcgtcacggcgcgaggccatcgtcgcgcgacgtgaacggctcgagcaagcgctcgtggaggcggttcccgctgccaaggtggcaggcgcgggtgctgcgcgtgtcgggatcagcctggtggccgtccctggggctcgctcggaggaactcgcggtgctcctcgacaccgaaggcgtgtgcgtgtcggtgggggcggcctgtcgagcgggtgctcccgagccatccccctcgctgctggcgatggggtgggacgagcccgaggcgcgatcggtcgtacggctgagcgtcgcgccggagacgaccgacgacgacgtcgtcgcggcggcgatggcgctcgcgcgtatcgcggagctcctcggggccgccgggtgatcggtcttctgtcggccacgggtccgatcgcgacggtgctcatccttgcccatgtcggcgtcgggatcgtgggctatggtaccaatgcgctggccggctgggacgcaagcgaggtcctgcgcggtcggacggaggggcggcggtttctcgacgggagcgtcgcgccatcgcagctcgccatgctctgggttccgatcctcggggcgctgctcgtggcactcgtcgatccagaggcccttggcacggcgtggttcctcgtcgcgttcggtgcgtggtgtgtgagtgtcgcgctcgtgctcgcggtggcgtggccggcccagcgagaactcgggcgcttgctcgctgcgacgtcggccgtacccgaggcgctgcgcagaccagctcgacggatgctgcgtgcgcagcagctcatcgtggtctgctacgtcatcgcgttctggttgatggtgctgaagccagggaatcggtaacgatctgcgtcgtacgagcgtgatcgattggggtggtggcctggatcgcaaggatgccgatcatggatcggactgatcgccgggtgcgcgatgcgacgggccttctcccagccagtgtgacgcctgctaccggaggagagaattgacatgacgccgagctcgcccgtcgcgtctctgccgcgcggcgccgacgaggacgccaccttaaggcaggtccgacgaacgtaccctcgctggtgctcgaccagcggcgcaggtgtgttggcgtcggctgtgacctcggcgcgagcgacgcgactttggcaactcgggtgggccgggaacgcatcgatcgacgtgagcaagcccaggagcgcgcgcgtccacgcggcgacgccgccgaggagtggctggccgcatgagcatctgctcccaccgcgaatcgagagacctgtgccacacacatggtcatagcagacaggcgatgctcttggcgactcgccagaaggtgtcgcagccggcatcggtcccggttggggtcgcaagaagacaagcctgtcatgagccacatccacgacacgccctcatcggtggacgtgcttgcgatcaagccaccgcagcgggccgggatcactggcggcatcggtccccaggcggacaggtcccaggcattgcaccccgacggggtcactcggttcatgcgtctcaccgggaaccagacgacgacattgatcgatcctgccagcaggcccgaggccagccaaggacgatacgtacaggtggttcagtccgctcccacgacactctcgtgccaacgtactcggctgtgtgcgagggatggggcatcacgtcagcagggagggaactgtcgactgcacctcggtcgaatgcagggaccgagaacaccgcccaggcacggtgtgcctgggcggtgtggagtgggggatcagtggtctagtacagccgtgcgagggttgaggccggctccagatacaccgtcttcaagttgccgctcggggtgaactgcaccacctcgaaggaggagaagacgttgtggtactggttgaagttctcgttgccactcgcgccctcgtagttgatcttcttgccctctttgaggagtgttgcgcagctggtgtagctgtagcacttgatcccaggagggttcgagaccttggtgatgtagggccgccacaccgtgggattggacgagtgggctgcatccatggcgagtgccgcgataatcaccgcgtcgtacattgccggggaggccggcaggggctggttggtgtgccacaccgcctcgtaggccgacaggaaggccttgttcgactgggcgtatcccggaggcgccgccatgccggtcagccatcgagacgcattggagagtcccatcgcctgagccatctgcagtgacgcacccgtgtcgcccgtgatgtaggggatgttgagatgccccagctgtttgacgttggcgaagaaggtgctcgctgtctgcggatccatgtggaagaacacgcatcccggctgtgcacctgagaacatcttggccacgaccgacaggtaggagctctggcccgccacgatcgtctcggaagcgacgatcttgccaccgagcttctcgtacgcacgggtcactggtccaacctcggcttgcgcgttcggcccggagtcgtacacttctgccgcctgggtgcagtgcttggccgtgtaggcgtagtaggcctcgcccgacaggagctcagagtctgacgggaacactcgatagacgtatgggtagcgcatgtagtcgagctgcgtcgtgccgccttccatgagatcgaccacgtggtcaggaccgaagtcccggatcacgccctcgatctcgagcgaggacggtccaaagaccacgaccggcttcttgagcagcaacgtccggagcgccgtgactgcgtccacagggtcccccgcagtgtcctcgagctgtgaggtgatcttcgcgccgagtacgccgccaccgtggttgaccgcgtagatgcccgcgagcacgccgtggtcgaaccattgtccgacgaacgcctccttgccgctcatcggcagaaggatgccggcttgaatcggtccggtcagcttgccagaggagctcgccgagctggccgacgagctcgacccgcatgctgcgagcgccagagatccgagcgcagcaagccccgccgccatgccacgggtccgccaccggcgagtcccctgtcggttccgttgcatctatccttcccccttcgttgtcactcgtgatcttgggaatcacgatcccaggaagaggcgaccgccgcctcctccgccccccccgattggccgaggaagattgctgccatgtcgagctttgcgagctctgccggcgccccgtcacgaagattgcgtccggcgacgaggatgtagacccagtccgcagaggcaagcgcccgctcgacgttctgctccacgacgaccacggtcgtcccgagggcggccacctgggcgatctgcgaccagacaacgtccacgttcgccggtgagagaccggcagtgggctcgtccaggagcaccaccttcgggttgctcatgagcgcacggcccatgccgagcatgttgcgctggccaccggacagcagacccgccttgcgcttgcgggccagcgccaaggcggggaagatctcgaagaccagctccttgcgggcgtcgagcgaacctcgctcgacgaatcctccgagctcgaggttttcctcgacgctcatcgaggcaaagacgttgtccacctgagggacatacgccatgccagctcgggcagcgtgatgggcactgagatccgtgatgtcggtttcgtcgagatacaccttgccggccatgcgcggaatcagtccgaaggtggccttcagcgccgtcgacttgcctgccccgttggggccgatcagggtgacgacctgggagaccgacgcgtggaagctaatcccgtcgacgatcggcgccttgccgtagccagcggtaagtccctcaacgcgcagcacgtgcatcgctggctcctcccgtcaagtacgcattcacgacggcctcgttctcgcgcagctcggccatggtcccggttgcgagtgcgcagccagctgccatcaccacgacgtggtcggtgatccgctcaaccacatcgaggttgtgttcgacgatgagaaaggtcacgcccagcgaagagcggatctcgttgatgtgttcgcagatgcggtcgaccagcgcggggttgatccccgccatgggctcatccaagatcagcatcttcggctcggccatgacggcacgagccagctcgagcagacgcttctggccaccagagaggctgccagcgtactcatcgcgcatgtgctccaacccgaaggccgcgaggatccctcgggcgcgtgcaaccagctccagctcctgctgtcgatagcgccgaggtgcgaagagcgcggtcatgagaccctcgcccacctgacggagcggggacaccatgaggttttccatcacggtcatcgccggatactcccgtgagatctggaaggttcggatgagaccgagctcggcaaccttgtggggcgcgagtccagtgatgtcgtgcccgtcgaagttgatcgtgccggcgtcggggcgcagcgctcctgcgatgaggttgaccatcgtcgacttgcctgccccgttcgggccgatcaagccggtgatcgatccgtccgcaacggtgaagctgcagccatcgaccgcatggacacccccaaaggcgcggaccacaccgtcgaccaccaggatcgggtcagtcgtcgacatcgacggcacctccagccacgggaatcggatcgggcagacctacgagcttgactggctccgggaagcgcgctttgcgctctgggacaacgccttgcggacggaaccacaagacgaggatgacgagtgcaccgatgcacatgttgcggatctctgggatcaggttcggcatcgaggagatcgctggcaagaatcgagtggcctcattgaagagcaccgcaaccaggaacgatcccacgaccgcaccagtgttgttgccacgacctccaacgatcagggcggcccagatgacgaaggtctcactcgtgccccagcctgccggggccagcgccgtcacgtaccagatggtgaggacgcccccgatcccgacgaagacgcaccccagcaccatcgcgatcatgcgcactcggtaggtgtgcttgccgaaggcctcggctacgtcgaggtcctcgcggatggcccgcatcgtgcgaccgagcggcgatcgatagaggcgattggcaagcagccagcagatagccatgaccacagccgagaaggcgagaaagaccagggaataggagttcggtccgagctggagcacgccgttgaagggttgcggcaccccgaccagtccctcgaacccatcaaagatcttggtgttgttcccaacgagcccatagatgatcgagccggcggcgagcgtgacgattgcgaggtagtcgctgcgcagccgccggagcgccacaagcccgatcaggtagccaagcaatcccgctgacgccgccccgatcagcatcgagattggccatgggagcccaaggccaaggatgtagtagatccccgagctcggcacctcgtgggtcagcgacgcgacccccgccatgtaaccgccgatcgccatgaaggtgatgacggtgaagttcaggatccctgcgtagccgaactgaatgttcaagccgagcgcgaagatgttgtagatacagaagtacaccccgagagtggccgcataccccacgatgacgcccatgatgtgcctcctaagcctttccagcggtcgcgaagatcccctgcggccgaatgagcagtgtcaagaccagcaccaagaaggcgacgtccaggctgtaggcagcagagatcacgagcgtcgagaggctgatggcgagcccgatcacgagtgcgcccaccatggcgccgtagatcttgccgataccgccgaggatgaccgcggcgaagatcacgaacaggaaggtgttgccggtgaaggcttgaaactcgaccgtgttgagtgcgagcgtgatgccccccagtcctgcgagcgcaccactcaggaaccatgtccagcgtgtggtgcggcgcgtgtcaatgccgctcgcggcggcgagcggcgcgttgtccgacatcgcccgcatcgccatgccgagtcgcgtgcgcgtcagcagcaggtggaccccgaccatcaccacggcggcgacgatgacgaccccgatctgggcggcggtcaagctgaaaggaccgaggtgcaggggattgcctgctgcgatggggtagcgatcgaacccaaccccccagattgcctgcaccaggttcagtaggatgagcgagaggccgaacgtcacgatcaagaggaagaagccactcgtgcctcgacggacgaaaggctcgagcacggcgacatcgaccgccacagccgcaagcccactggcgatcaccccgaccaagccgccgagccagaagggcaagtgcaggccgaccgacgcagtgtaggtcacgaacattcccactgcgagataggctccgtaggcaaagttgacgtagttcgtgactccgaactgcaagctgaggcctaccgcagcgagcgccagcaccgccgaagtcacgatcccaaagcccagggtcagtaagaacaggctcattctcccccctctcgttggcctctcgtcttagtgccgcttgcaccgcgtgcgggagtttggccaccaagatgcagtttcgtgcgaatcgtgcactttggctcgtttcgctcaccgcgcctcacccctgggagctcgcgggtccacgcagcgaccgtgtccgtgccgtggcgacgcgtgctgggggagggacatgaacagtgcatgctgactcgcccctggtgacggcccgccaagtgccggcgaggcgccccaccggaccggacaattccatcgcgtcgcttcggcccaggtcctcgatcggcaccgcacgatcaggaggtcgttcgcgagcgcgacgtgaacgagccggtgcttgccagccggaccaccctctgttgcagtcgtacgtgaggccacgtcgctggtcgtgtcgctgcacggagagggtggttgacgattgagaccccggccaccatgacgcccgagcgcatgccaagtcggcacgggaccagagccatacccgatatgcccggaccaagggttctcgagcgaacccgaaggacgagatgctgctctgcattcgtgggctcgggcaggccagcgatcggggcgtcaagtcgttggccgatgctgttcagcacccctgtactcgggcctttgccgagcgtgacagcctctcgaagcgagggggagagcttcggtccgccaaacgggtcgcgggtccttccgcgtcagcgagtggcgttgccgcgtgagcgtggtcaagacggcgcgcggtcgtgcccgctagggtcctcgtcgctctgtgcagccggaggtcgcgcgtctcgagtgctgccctgttgggtgaggccgaccgcatcaaggctcgcaaggccaccgcgttgcagaagacgtcgccgtagacctggagcgaccgatcgtcgccgacgctggcgatcacgaggcatgaggtggccccgacgcgtgcggtcgtcgtgcgccgaggagcacacagcgcgtcgtctccggggccacggtcgtcttggggaagcgagacggcagctcgacactgcgccgatgtcgagcgcgcggaagaaggtacggtaacgtgttcgcgctcttcgggtgttgtgtcgaccagcaacgcccatcgtcggcatgaggttgagccgcggacctaccactcagcgaaccgcggccgtgatcgccgagatcgggcctgcgcgagggcggacagcgacttgcgatggaccggtgcgttgcccaggggggagtggccgaggatcggcgtgcgacggtgtccgatcccatcccaaagcctgccaccggccgagcaggagagggccgtccggagctgcgggccgaggtgattggtcttccccgcagaccgaagcatgcagggccagcatcgtgccctgcctgaagtcggtctgcactggctgagagacctggtgagctgcgacgaccgaacccgggagagcctcgtcttgccggttccgctcgtcgctcgccatgggctcgtcgctcgtgcgattacgtggatgaggttggtggcgatggtgatgcaacctcgtgtttcggttgggactcgagtccaaccgaccctgacgtggcgagccggtgcgggtgctaacgaggccatcggtagcgatgctcaggtcgcccgattccgtagcggagcacgagctcgatccgtcccatgcgcgcgaggtgtgagaggtagcgttgcgcggtggcccgagagactccggagcgggctgcgacttcctcggccgagagctcctccgtcgcgccgcgcagcgtctcgacgatgaccccgagcgtctcacgcgattgccccttgggcagcgaacgttcgacgctcgttcgcagcgtggtatagatctcgtccaccttgtcctgactggcctcctcaagggcgtcgagcttcttccgcatggcggcataagcctcgaggcgctccatcaggatcgagggtgcgaagggcttcaccaggtagtagagggctcctgagcgcacagactcggcgacactcgcaacatctcgtgcggcggtaatcaccatgacgtcgatgggtcgccctgcgatgcgcccgagtgccttgagcacttcgagccccgagacatcggggagatagagatcgagcaacacgaggtctggatggtgctcctcggcggcagccagcgcgtgcgctccggtgtgggactctgccacgacctcgaagcccgatacacgctcgacaaaggccctgtgcagcgcggcgacccggaagtcgtcgtccaccacgaggattcgatacctcatgagtgctgcgtgtcagagaaggctgggatgtgttgacgcaggatcccaggcaatcgaacgacaaacactgcgccaacctctcgcagcacctcgatcgaccctccatagcgctccacgagttgcctgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcagccgtacgagggcgaggccaagcccccggcgtgtcccactgcgcgtgagcttggtgctgaagccgtcgagaaagatctctgaggcgatgtgggctgggacccttggacctgagtcggcgacgatcatggtgagcgcatctcccatggcgagaaagctcgcctcgatccaggcgttgggagtatctgcagctgcatcgatcgcattgtcgatcaggttgccgagcagtgtgacgagatcgctcgcgggcatgcactcgggcggcacgcggtcggaaggtccgaggcgtagctcgacgtgacgctcggcagccactgcactcttcgccaacaggagcgccacgatgacgggattgcccacctcgcgggccaggcgatccatgagcgcggtgtcacgaagtgcgatgtcggtggcgaatcggatggcctcatcggtctctcccagttcgatgaggccgacgacggtgtggatccggttggagaagtcgtgcgcctgtgctcgaagcgcgtcggtgagtccgagcatgccgtcgagctcgcgcagcagtgcctcggactcggtgcggtccacgagcgtgacgacatagccgagtaggcgcccttgcacctcgacggctcgacgattggcgatcaggattcgatcctcgtggacgacgagcaggtccttgcccacgacctcgcccgtcagaatgccttggagtcgaccatctggcaccagcacgccgacagggcgctcgaggaaccttactggaaggtgtaggaggcggcgggcctcctcgttggcgaactggaaccttccctcgggatcgatccccgcaaccgcctcccggatgccgtggaaaatcgcgtcctgttcctggatgagtttggtcagctcgtcgagctcgaggccaaaggtgcgatcgcgaagccatcggctcgccagccacgatcctgctgcaccgatggccagtgccacggtgagcgcttcgagcgcacgcactgcggatccggtgatgagggcaagtgggttaggcgccgagaactcgacgacgactccgagaccagccgagtgcgagatcggggctcgcgcagcgacgggtccggaaccgccgttgaggacgccactccagacgtttcgtccgtcgagctcggcgacgagctgaccacgagtgagtgatccactccccgcctcgacgagaccatggcgattcacgactgccacggcgagcgcgccaatggccctgcgcgactgtgtgaggagggcttgtcggttctccgttccggactcgagggtggcgatatctgggttcgcagcgacgctctgtgccgcaaggagcgcctgatgtgtgtcggatccgagcccagtcgggacctcgagcgtcacccacgcgatcgctgcaatgacgctcaccagaatgatcccggcctggatggccagcatgcgagaggcgagcttcgcgccccgcctacctctcgagaccgacggatcgtcacgcatgtgtaccccaccacaacacgccgcacggtctgcattgacctgcccttgagtgtacggtggtcgcttgtgcccgcgcaagtgagacgaagtgaaccgagcctcctcgaagtcgcgcggtcgctcgtggcgcagcggccagcgcgtgtgtaggcaccgggcgttaactgaccctagaacaccggaacgatagtgacccaccctccagagtaggttgccctcgagaatcaagaagggggcagcccgatgctgaagggcaggatgctcctatgtctgtcaagtggcgagcgcgctcagcccttcgagccactggcgatactggatggccaactcgtcgtgacgcgtgaggccgccctcgagccgcgataggcgccccacggtcgttgacagggcagctgcagccgcttggagcacgacgcccaagggagtgccgtagctcgcgaagttccgtgccggtgatgacgggcgcggggttcgtgaggaggccaaagatctcccgggcgatggagcgcttcaggcagcgcatgatctctcgatcactcttgccttcctggcgtcgccgctcgaggtagcgcatggtcgggccgtgacggtgggcgaggcggaccatcgcgatgcgccagagcgcgttgttcgcctcacggttgccaccccggttcaggcgatgtcgtacgaccttgcccgaggaagctgcgatggggctcaccccggcgagcgcagcgaaggaggcctcgctccggaggcgctcggggttgtcgcccgctgccacgacgagggctgaggcgacctcgggcccgacacccggagctgcgacgagtgcagggttcacctccgagcacaggcgagcgatcgcgtggtccagctcggcgatctctcgctccagggcctggtggcgcctcgccagcgtcacgagcgccagcgtcgttgcggcaccagtcgcaagtgcccacagcgtcgccccaggctgccacacgctccacctggcgagcacgacgaagcctcgtgagttcctcacgctgctcatcggccaaggtgacgatcaggtcgcggagctggttgccagcttcgggtgcgtgctcggatcgcagagcgacgcgcgacgccaagtgggcttccccccatttgcttgacagtctgaatttaggccacggccgcctcctcccgggcccaggtgagctcgtactcgattggcggtcggtacccgaggctcgagtgcagccggacggtgttgtagcgatggatccaggctgcgatggctgagcgggcctcggcgaggttcgcgaagcggtagcgagccaccagctcgcgcttcaaactcccgaagaaggactcggccacggcgttgtcgtagcaagtagtcaccctgcccaccgactggcgaacgccgagggtcgcgagcaggctccgaaccttccgggagaggtactgtccggattcaaccggtcgtcgcaacacctgttgctccatctgagcctaggagtgcctccagcgcttctgctggggtccgccagccgagtgtcttgcgaggccgctggcccgagcgcgaaggcgaccgcgtcgaggtcgtgctcactccagcgggacaggtcggtgcccttcgggaagtactggcgcaggagtccgttggtgttctcgttcgtcccgcgcatccatggcgagtgagggtcggcgaagtagatggcgagtcccgtgtcgatgcgcagctggacgtgctgggccatctccgtgccgcgatcccacgtgagcgatcggcgcaggtgctcggggagggtggtgatcttggcagcgatcgcagtgcggactgcctcggcaccgtggccggcaaggggtggtccgtgcttcgcgcgcgcctcaccgtcgtggccctccatgggcggtaggtggagcagcatcacggagcgggtggtgcgctcgaggcgcgtgccgatcgccgaacggtgcagcccgatgatgaggtctccctcccagtgcccgggcaccgcacggtcctcggcctcggcgggccgctgcgagatcagcacctccggggtgatgaagccctggcctcgtccgtgagcccgtgctcgtgggacccgaagggctcgtccggtcctcaaggcaggtcacgagttcgcgcctgagcaccccgcgcccctggacgaagagtgcctggtagatggcctcgtgactgatacgcatcatcgtatcgttcgggaagtcgatcgggaggcgcttggcgatctcgtcggggctccaggcccgtgcccacctgcgatcctgactgcggccgtggcgacgacccgtgaacctgacggtgggaccgtctgcggtcgtgccatcgggatgggcgatgcgaccagcgaggcgatcctccacgtaggcacggagctcctcgttgcgaacgagcttggccaccttcgggcgcttggcggcgagcttgcgccttccactgggcaacgaccgcccggtactcgagcgtgccacccctcgtggctgcgttgcgacggagctcacgcgagatggtcgaggggtgacgcccgagctgacgagcgacgcttcgaccccagccccttttcgctcgtgcgagcgcgatctcctcgcgctcgctgagagcgagagggagcggcccgagggctcgcccagcgtgcatggtggcaccccaccagcatggctgaaccagcgcgcaccgaccgccaccgacacgcccacgcgctcgcaggcgtccgcggtcgagatccccgtggcgatgagctgccagaaggcccgctggagcacccgtggtgggtctggccgccctggggagcgcatcggcggccgcagggcacgatcggccgcccactgtcgcctcgctcccggaggagcctggttcctgtttcgttgcacgtgctcctccgtcaccgggggtgttgcaacgaccggttgaacccggacagtagctctcccggaaggttcggagcctgctcgcgaccctcggcgttcgccagtcggtgggcagggtggctacttgctacgacaacgccgtcgccgaggccttcttcggaagtttgaagcgcgagctggtggctcgctaccgctgcgtgaacctcgccgaggcccgcgtcgccatcacagcctggatccactgctacaacaccgtccggctgcactcgagcctcgggtaccgaccgccaatcgagtacgagctcacctgggcccgcgaggaggcggccgtggcctaaattcagactgtcaagcaaatggggggaagcccaggcctcctggcgggagatccagtggtagcggctcactgtcccccctccttcacccagaaggccatcgctcgcttgagcagctcacgttccatggtgagctgcttgacctgccgacgcagccgggtcagctcctcgcgctcggcgctggtcaggccttctcgctcacctcggtcgaatggaggagccccgaagcgaccagctcatcgatgctgccgccgtactcgaacattgggttgagactcagccaaggttccggccaaagcgttccctcgctgagggcttcttgcaccctggaacggattcgctcatcgcgaatatcaacgaagctctcgacgaatgatctgaactcgcgaacgacggtgtctcgaaggtcgaagacgtccattgccgtcctctagagctccgacgtcagggtcacaagttgatgcgaaccattctccactacagtgggcttccccccatttgcttgacagtctgaatttaggccacggccacctcccggcaggcccaggagagctcgtactcgacgggcggtaggtacccgaggcttgagtgcaggcggaccgtgttgtaacggtgaatccagctagcgatggcagagcgagcccctgagaggttcgcgaagcggtagcgagccaccagctcgcgcttcaagctcccgaagaaggactcggccacggcgttgtcgtagcaggtcgcgaccctccccaccgactggcgaatgccaagggtcgcgagcaggctccgtaccttccgggagaggtactggctgccgcgatcgctgtgaaagatcgccccagccaggctgccccgagtcccgagtgcttcgcggatcgcctcgaccaccaggtcatcgggcatgtgacgcccaagtgaccagcccacgatgcgcctcgagccaagatctgccaccgtggcgagatagcagaacccctcatcggtgcggacgtaggtgatgtcgctcacatacctgcgcttcggctcaccaggagcgaagtcctgacggacgaggtccgggagcgctgcgtcctctccccgcctcgtcgtgactacgaagcgccggcgtgggcccgctgccatctcgagctcgcgcatcaggcgttccacccgcttgtggttcacgcagaacccgcgccgtcgcagctcgtgggtgatgcgggggctgccgtaggtgccgtcgctctcgtgccagatggcgcgaagctcgctcgcgagcaccaggtgctcgggatcctcgcctcggtcccgacggtgtcgccaggcgtagtaggcctggcgagagaccccgatgactcgtgctgctgccgctacagagaagcccttggcctcctggcgggagatccagtggtagcggctcactgtcccccctccttcacccagaaggccatcgctcgcttgagcagctcgcgttccacggtgagctgcttgacctggcggcgcagccgtgtcagctcctcgcgctcggcgctcgtcaggccctctcgctcacctcggtcgatgcgttcctgacggacccagttaccaagggtctgctcgttgatgccaagctcacgggcgacgtcagcgatggtgcggcgctggtcgagaaccaacgctgccgcgtccttgcggaactggctcgggtagcggccgcgtcgtcgtccagcggggccgtcgcccggtggtgggttcggtgtctggctcatcccttcctcctatagcaggtgtcaacctggaggggggaaggccacagtctcctggcacacaagcatgctggtgcgagcaccgaggccatggctcgatctcatgtcgatcctcggcgaagcttagcggaggccttgggtgagggccagcggcccgggatgccagcgtagcgtcgctgccgctcgtccagggtgcgaacgcggtttggccgagccacatggacctcgcgccaggagcaaggttgtatccctcgtgctccgtgccaactcctctgacgtgcgcacggtacacgcggagcatggacccgcatgagctccacagcgaacttggctgcaagcaccgtaacggccgtcggccccggcacagccggggccgacgtggtctgggtgggagtgaaggttgtgtcggctacggagtcgtgtcgtcgttgacgttgacgtcgaacgtcgaccagccctgagccccgttcggtcctgtcgcgatgacgcgccagtagccggccgtcgggaacgtgagggtcgcctgggccgtgccgtcgacgagatcgactgatgcggggtacgtggcagacggagcccccgacggaccgaccaccgtgaggttcaccgtgcccgagacggatgtatccgtcgtgaggccagcagtcttcgcctcgacgttcacgacgagcggcgttccgggcgtcgctgcgagattctcggcaggatcggcgacctggatcgtgtcgctcggcacgtcgggtagcgatacgggagcgatcggcgcttggtggaagtcgaacatgccgagcaggtcgttctggcgggccaccagcttggtgagcgggtgcatcccccagaggcgatccatgagggcaaggatccccatgtcggtcgtctgcttcgagaagactccgggtcgcacccacggcgagatgaccaccatgggggtgcgggtgccgtagccgaaacgctgcgcgatcggcggggccacgtgatcccagaagccaccgccctcgtcgtaggtgatgaagatggcggtgctcttccactcgggcgagtgctcgatcatcgacacgagctgtccgacccatgcgtcaccgagctggatgtccgtgggcggatgctcgctgtagagccaggtcggaacgacgaaggagaagttcggcagttggttgttctggacgtcggccacgaactggctcgtgttcgcgacgtcgttccagaggtgcttgtcctggagcaccggcgtgtaccaggctgggttccagtgggtgacgaagccgttcccctcttgggttgggggtgggccgttgtagtcgccctggaagatgccccaactcagcccgtgctgggtgagctggtcgaagacggtgcggatcgggaaggacccagagctcggcggggaatccgacagccacgcgtctgcggtgcccgccacggcgtagatccgattgggctgggtcgggccgatcgcgggctggaagttgttgtcggcgagcacgaagtgctgggctaggtcccagaggttcggctcgacgctcttgccgaaggtcgtgatggacgcaaggccgttcgtcggcagcgtggtgtagtagttcatcttccaccccggcttgccggtcaggtacgcgttcgacggcgtcgcggaggtgaagtagcccgtcccgcccgccagcagtgcggggcggtagtccatcgcctcgatctcggcagcgcggttgtggttgaggtccaccgtgtcaccgacgttggcgggagccgggatcggcgcgacgggtgcggctgcgtagttcgtcgacggattcgggaactcggttcctgccgggatcccgttcgcgccagggaacgacccgaacaggttgtcgaacgtatggttctccagcatgatctcgacgacgtgctggatcgggctccgcatgccgctcgtcgcggctgctggggctcctgtgccgagggtgctccagcccactaaggctgtcgccaaactggtcgccgccgcgatcgaggcgacccaccgactgcgtgctcgcatcgttacctccccttcgatgatgtgggtgtccactcgggacgactccatgcttgaccccagagcttgcgctcaggttgcgctcaggtgactcgcaggacacggggagtggaacgtttgggtggcggtccgacgatcggtcgccctcgcgagttcggatctctcatgtccccacggccacctgcatgcgacgagcgcgaggccgctgcccgagggagcttgctcgcgtggcagatggacccctgaccggctccttccggcgagctgggcgggcgtgcgagatgtcgcggccgcggtggtcgtggcgctggtaccgggacgcatcccacggcagaaccgtgcgcgtgggggtgctcatgtcgtcccgcacaccccttcgacctcacggccgaggctgtgcttgcagcgaggtggtgccctgaaggtagatcgatcgctcccgctgggaatcggaccgcgcgagctcggcgaaccccacagcatcccacgcgatcgctgccgtggcgcgagggcggctcgaccgcgcgacacgtgtcgatcgccttcgtcgccccgacctaggtgcgcccccaccgtgggcgcgatccgtgcgcgtgcgcgtcgcggatgtgccgactacggcgcgctctggccgcggtggttcgccaactcgaggacctcggccccgtgtgcgagtccctcgacgacgcgttcggcgtgcgtcaccacgaccagggttcgatcgatggcgagccgggcgagaagtgcgacgagatcatcctcggtctcgccgtcgacgttggcggtcggctcgtcgaggatccacgtgtgctggtcggcgagcagcaggcgagcgagtccgatgcgctgtgcctcgcccgaggagacggcgtcgtgggcgaggcgcgtttggagcccgtcgggtagtcgcgcgagcagcggtgcgagtcccacgtcgccgagcgctcggacgaggtcggcgtcggatgcgtcggggcgggcgagccggaggttcgccgcgagcgtcgcgtcgaagacccacgcttcctgggggacgtagccgacgtggtgcgccacggtcgactcggtgagctggcgcgtgtcgacgccgccgaggcggatcgtgccacgggtgggctcccatgcggctcgcagcagaccgacgagcgtcgacttgccagccccgctctcaccgacgacgaggagccgacctcttggagggatcgagaggctgaggcgatcgaggatcgcggtggtggcgccagggtaggagaagctcacgtcctcgacgtcgatggcgaggggaccgtcgggcaggggcgtagtgttcgctggctggtcgcgacctcggagcgcgaggaccgagtcgaggcgtcgggacgaggcgagctcgctcgcgagatgggtcgcgctcacgccgatgccgctcgtcgcctcgaagagcccgagggcgaggaacggcacgacggcgagctccacggcctcgaggtggtggtgcgcgatcgccccggcaccgatcgcgacggttgcggcgatggtcagtgcttcggcgagaccggcgagcgaggcggggatcagctcgagcgctgcgttggtccgtcgacgcctggcgagcttgcggatgtgggccgcgagctcatcggtgagggtgtgctcgcccggcgttccggcgcgctcgggagcagagtcggcgatggcgagtgcgatcgtgtgggcggcttcggcggtcgcggcgagttcgcgggtcggtgctcgcccgagccgcgccgcggccgctggcgcgacgacgagcgtgacgacgaggccgagggcgaggaccactccgagggcggggttgaagacccaggccacgaccgtgcccacgaggcctgcacccaccgcaccggcgaggggagccgcgatgcgcaggagcagcgaggagagcgcatcgagatctcccgtggcagctcgcgagagcgtgccggcgatcgcgctcgggaccctgtggggtgcggccccagccacggcacgatagagcgcgacgcgaaccacgcgcacgaggcgcagcgtgaggcgatggccgaggaggcgctctccatactgaccggcacctcgggcgagggcgaagaagcgcaccgaaccgacggccacccccagcgtcaagatgccaggtcggagcgaggacttggcgaggaggtaggcggagaaggcgaacaggatggctggggagagcgcagcagcgagtgaggtacccaggtagccagcgaccagtctgcgctcagagtcgaggtggttgcggatgatcgtgacgaggttcatgtcgtcggctccgtcgtcggcgatggcgtcgctcgggtcccgatcgaagcgtcgctgagctcgaggacgcaggtagcgcggcgaaccacgagctcgcgatggctcgcgctgatgacgatggaccccttcgcctcgcgcgtgagcagctcgaggaatcgctcctcggtgcccacgtcgaggtggctcgtcggctcgtcgagcacgaccacgtcgcggccgagtgcgagtgcacgcgcgagggcgactcgttgtcgttggcccgccgagaggttcgcccccccgggtgcgaccaggtcgtcgcggcgctgaacgagttcgatcgcgccgagctcggcgaggaggtcgagtgcgacctcgaggcgatcgtggcccgcgacgagttggaggttgtcagcgatcgttccgggcaccatggcggggcgagccggcacccacaccgttcgttccgcagggagcgctcgatggatctcgtggtcgagcacgagggttccacggagcgttgcgccgcgacccacgagggccatgagcagcgtcgacttgccgatgccgctgcggccgacgacgcagagatggtcgccaggtgcgagcgacagcgtgaccggagggtcgagctctatctcgacagtggtcacggaacggagctcgagcagcgcctcatcgtgcgacggtgcggcccgcaggagacgtgtcgccggagcttgggacgtgcgtggcacgggggactcaggaggcgccgcgagggcgtcgatggcctcggctgctgcgcggccgtcggcggtggtgtggaactggagcgatgcggcccggagcggggcgaacacctcgggcgtccagaacaggacggtcgcgcccgtggcgagcgccatcgaggcgtcgttcagtcggatgccgatcgagacggcgacgagcgccacgacgatcgccgagaggatgtcgaggctcacacccgagaggaacgcgatctcgagcacgcgcatggttcgatgctcgagcgatgcagctgcggcgtcgacggcatcggcctgctcgtcggcgcgtccgaaggcggccagcgtccccgcaccaccgaggagatcgaggtagcgatgctcgagctcgatggtggcatcaagttggtcgcgagcgcgccggtcggtggcgatcccgatgagcgccgcgaggatcggcatcgcgacgaggccgccggcgagctcgatgccgaggatggggctggccaaccaggtcgcgaccacgagcgtcgggatctgcgcgacggtctcggcgaccggtggcgcgaccgatgcgaccgcggtcgcgaggcggtcgaggccctcgctcgcgagataggcgaggcggctcggatcggggttcgtcccgcgtgcggccgcgaggagggcgggctctgcggcgctggctgctcgctcgccagcctcacgggccgccacctggcccagccgccgcaggacgacccgcacgacgagggcagccccgaggacgacgccggccgtggcactcgcgccgagtcggtgcgcgacgacggcgtcgctgagcgctgcgccaaaagcgcgagccgccacgaggagcgcgacgagttgggcgagcgtggtcgcagcgaggatcgcccagaacggcatcgcccccggtgcgcgaagcgcccgggggtcgatgggaccacgtcgctcgctcacacctcgtgcggctggtcgctcgcggggacggtctcgtggggcagcgagacgcgacgccggaagatgtagtagctccagccctggtagaggaggacgaacggggtgaagatcgccgccacgatggtcatcgcgcgcaaggtgtagggctgcgaggcagcctcggcgatggtgagcgacgcagcggacgagagcgacgaggtgatgacgtcaggatacaaggtcatgaagaccgtcgccgtgatggcgaggatggcgacgcccgtcacggtgaaggcccagcccgagagccgctcgcgattgagccagctcgccgcgaccacgagcaggagggcggacacggggatcatgcctgggacgtcaccggcgtggtgctcggtccgtgccacctcccacgtccaggcgaggaaggcgaggatgatgacggcggtgatcggcgcgatgcgcccggcgagcgcggaggcacgctccttcagtgcgccggtggtcttcaggttgaggaacaaggcaccgtggaggaggaacaggctcagggtcgcgagccccgcgacgagcgcgtagggctgcaggagcgagagcagcgagcccgtgaagatgccgttcgcggtgatcgggatccccttgatgaggtcgccgaaggcgacgccccagaggagggcgggcaccagcgaccccaccgtgatcacgatgtcccagttgcgtcgccaggtcgcgctctggcgcttgccgcggtactcgaacgcgacgcctcggatgatgagcgcgacgaggaggatgaacagagcgaggtagaacgcggagaacatgcgggcataccacagggggaacgccgcgaacgtcgccccgcctgccacgatgacccagacctcgttgccgtcccaggtcgcaccgatggtgttgatgacggcgcgacgttcgaggtcgtcgcgtccgatgagcgtcagcagcatgccgaccccgaagtcgaagccctcgaggaagaagtagccggcccagaggacgccgatcaggatgaaccagaagagttcgagaccagtggtgtgcatcgtgcgctcctagtagatcagcgagccgacttcgtgctcggtctcggtgtcagcgccgggttcgagtgagcgtcgaccatagcgaaccatcaacgagatgtccacgaccgcgaggatgccgtagagcaccgtgaacccgacgagggtgatcccgaccgaccatggcgacaggtgcgaggccccttgggaggtcttcaacaagccgtagacgatccagggctggcggccggtctcggtgtagatccagccggtggtgttggcgatgaaggggagcgggatggtccagagggcgaccttggcgaaccagcgcgactgctcgaggcgatggtggtagagcagccagccaccccagagggcgatcaggatgatgacggctccgatccccgccatgatgcgaaagctccagtagtcgagggcaacgggcgggatgtagctgcccgggccgtactggcggaccatcgcggcttggagctgattgatgccctgaacgaccccgttccagtggtcggtggcgagcaggctgaggacgtgcgggatgccgatggagaagatgggcttgtcgtggaggttgccgatcgtgaggatcgattcggacgcaccgcgggacgtgttgtagagggcctcgccggcggcgagcttcatgggttgggtctcggcgatcacctggccgtcgatgtggccgtcgaggcccatgagcagcgccgagatgagcatgacgatgagcgacacgcgcgcgcctgcggcgaagacctcgcgggtctcggtgctgcggtggtactgccacagcgagatgccgagcacgagcgcagagccggtcaggaaggaggcgagcagggtgtggaacagcgtcacgaggaagagctcgttcgtgaggatggcccagaagttcgtcatgaccgcctggtgggtggccggatcgatgcgatagcccaccgggtgctgcatccacgagttcgcggcgaggatgaaggcggcagacagcatggtcccgatcgagacgagccagatggaggcgaggtgcacgcgccgtggcacgcgatccttgccgaagagccacacgccgaggaaggtggactccatgaagaaggcgaggagtccctcgatggcgagcggcgggccgaagatgttgccgacgtaggcggagtaggccgaccagttcatcccgaactggaactcctggacgatgccggtgacgaccccgatggcgaagttgatcaggaagagcttgccgaagaagtcgagcacgcgctcgtagcggtcgtcgcccgaacggtaggcggccgtctgcaggatcgccacgatcagacccagcccgatggtgacggggacgaacaggaagtggtagatggtggtggctgcgaactgccacctcgacagcagcacggtcatcgacgcgaccatgagaccctccctctgacaccgcagctcgagctgaacgtacgcaaccgagctgcgagctccagcctacgaatcgtcctgatgggcgcacctgggcccttcgtcacgtcttggccgggactcgggtcgcccgccgggagcagcgagtcgactagcctcgtggcttcatgggttctctcatcaagaagcgccgcaagcgcatgcgcaagaagaagcatcgcaagatgctgaagaagactcgctggcagcgccgagccggtcgctagctcgcacgacgttcacgaacgccccgcggctgcggggcgttcgtgcgtcgtggcggcttcgccaccggagcctgcccgcttcgccaccggagcctgcccgctgtgccagcggccctcggcggtcaggctgactcgccggcgctcggtgtctcgctcgacacctcggtcgctggggaggcgagggcgcggggcagcgtccgtgtctcgatcagccacacgggcaagtccgcgagcatgaggcgcgtggcccggacgtcgtcgcctcccacggtgacgtgggcagcagggcccctcgcgaactcgtcgccgaggccgagggtgcctgccgagtgccaccacgccagcgtcgagcccgagccggcgagtcgaggacgtcgtccggtgcgtcgctcggcagcggcgatgagcgcccccagccgtggctcgatggcgcaggcggcggcctcgaggtcgtttgcgacctcgtcgtcgtcgtgtggtccaccgagtgcgtcccaggctcgatagacggagcccgtcgcgacgccgaagggcggcacgatgagcgtcacgaccgcatccaggtcgtcgagggccatgacctgctcgccgatgccgcgggcatcgacgtggccagcgagctgacacagcgcgacgtcggcaccgaggtgccggccggtcgcgagcggtgctccgaaggcgcggaggacggcgcccgcgtcggcggagccgccgccgagccccccttcgaccgggatgcgcttcgtgatcgcaagggtgcctgtctcgccgatgagctcaagggctcgccaggcgaggttcgtcgcgtcggtcgggacgcgagcgaggtcgacccagggggcgccagcgacgaggtcgatggtggtggcaggggccggggcgaggtcgacggtgtcggcgagggcgaggtggacggcctcgatctcgacctcgtgcagaccgtcggctcggcgtccgagcacgcggagggtgcgggtgagcttggcgggcgcgacgagcctcaccgggcacccttcgaggttgcgatggcgcgccccagcgcgacccactcgtcgagcgcgagcgactcggcgcggcgcatggggtcgatgccgacggcatcgagcgccgccagctcgtcgtcgccgagggcgcgtcggagcatctgacgccgacgttcgaagccgtggcggatcgcacgcaccgtggcgtcgaaggtcgtgggctcggtcaccgcgagcggctcgctgcggcgatcggcgacgacgagcttcgaccacaccgtcggctgcgggtggaagacgaccggtggcaccttggcggcgacgtgcgcgtcgatgctgagcgcgagccgcaccccgagcgccgagcacgctcgggtgccggcggcagcgacgatgcggtcggcgaactccgcctggaccatgacgaccacacgctcgaggaaccaggcctcctcgacgaggcgaacgaggatctgtgagccggagtggtaggggaggttcgcgaccagcgcgctggggcgtcgttccagcgggagcgggtcggcgagcgcatcggcgtgctcgattcggacgttgtcgatccctcgcgcggccagcacctcgccgagcgccgggatcagtcgtcggtcggcctcgagcgccaccacctcgtcgaagtactcggccagccacacggtgagcgagccgaggcccggccccacttcgaccgcgacccgaagccccgcctccgcggccagcgctgcttccttgcgcgcgatgttgccgtcggtgaggaagttctggccgagggccttggagggctcgagcccgatgcgctcgaggtgtgcgacgatctcccgcttcgtgactggacgcatggtgctcagggagatggctcgacctcacggagcccgaagagccgccgtgtcgtcgccgcggtgatcgccgcgagccggtcggcgtcgactcccttctcgctggccacgaagcgtcccgtgacggcgacgttggcgatgtggttgggtcggccgcggagcgggaccggcgcgaggaagggcgtatcggtctcgacgagcagccgctcgatcggggcgagccgaagcgcctcgcgaacgggctgggcgttcttgaaggtcacgatccccgagaacgacaggtaccagccgcgtgcgagggcgcgctcggcctcgtcgggaccttccgagaacgagtggatgatgaccgctggcggactcggggcgtcgtcgaggatggcctcggtgtcggcccaggcttcgcgcgtgtggaccacgagggcgagcccgaggcggtgggcgagggcgacctgctcggcgaagacgcgccgctggacggggcgcggcgagtagtcgtagtggtagtcgagcccgcattcgcccaccccgacgacgatgcccgggtactcgacgacgagcgcggcgaggtcggcgatcgcgccaccgtgcgcctcggcatcgtggggatggatgccgatcgtcgcgccgacgctgaggtcgagccgttcggtggcgagctggtcggcgatacgggccgcttcttgcgagctcgcagggtccgtcccgatcgcgacgaacccgacgaccccggcgtcgacgaggagcgccagctcctcgtcgaggctcacgcgctcgggatgggcgtgcgcatcgatccagcccgcactcatcggcgccccaccacggcatcgaggtcggtgcgtgggaagagcggggctggcttcgtgatggtggccccgcccatgcccggttgccaagcgagcggtcccgcctcgtcgaacccgagcgctcgtcgggcacgttcggccccatcggggatggcgggggagaggagcacgctcgcgaggcgcgccccctcgcgagcggtgccgaggacggaggcggcctcggccgatcccttcgcgagacgccagggctccgtggcctcgaggtaggcgttcagccgatggacgaggccgatcgctgcgtccatggcgtcgttcggccgccaccgttcccaacctgcgcggacggcctcgatggtctcggcgatggcgagctcgtcggggggcgtcgcgggtgcgtcgggcacgtggcccccgagccgttggacgatgagcgagcccacccgcgcgacgaggttcccgaagccgttcgcgagctcggcgttgtagagtgcgacgagcgcctcgagggacacgtcccagtccggcccgatcgccgaggagcgcaccaggtagtgccggagcgcatcggcactgagcgcgcgttggacacccagcgggtcgatctggttcgcgagcgacttcgacatcttctcgccctcgttgagcagccagccggtcacgatcagctgggccgggggatcgatgccggccgcgaggcacatcgccggccaccacacggcgtggaagcgcaggatgtccttgccgagcaggtggtgggccgcgggccaccaggcggccacctcggcggagtcctctgcgtagccgatcgccgtgaggtagttcacgagcgcgtcgtaccacacgtagaagacgtgtcgcgagtcccaggggacgcgcacgccccagtcgatcgaggtgcgggtgatggagatgtcggtgaggccgccctcgatgaagcggagcacctcgttgcggcgcgactcgggccagatggcctccggatggcgctcgtagtgctcgaggagacgatcttggtagcgcgagagggcgaagaagtagttctcttcgcgcatccgttcgcaggcgacgtggtgcaccgggcaaagctcccccggctcgagctcgccgggttggtagtaggcctcgcaccgcacgcagtagaggccctcgtaggtgccgaggtagatgtcgccgcggtcgtggatgcgctcgaggaagcgttggacgcttcggtggtggcgtggctcggtggtgcggatgaagtcgtcgtaggagacctcgagcgcatcccaggcgcgtcggaactgggccgaggtcacgtccacccaggcctgtggactcacgccgtgcgcctcggccgactgggcgatcttcagcccgtgctcgtcggtgccggtgacgaagcgcacctcgtcgccgatcaggcgatgccagcgggcgatcgcgtcggcgaggatcacggcataggccgtgccgaggtgggggtcaccgttgacgtagaagatgggggtggtgatgtagaagcgccccacgagcccagcgacctcctcgccgatcgatctcgtcccaagcttaccgaggcgccggtcgctcgctgggacgagcgtcgggacgcgccgcgaggatggcggcataggcctcctggcggggcgcgttcgtgaggcgagcgacgatccgcgccgcctccgacggcgcgagcgaactctcggcgagcgctcgggtgaggcgctcgtgctcgacgacgctcgtgggcggggcaactcgtgccggccccaccacgacgacccactcgcctcgccgatcgatggcgcgcgcccacgcccctgcggcgcgcgcggtcccttggaaggacgtctcgtggatcttggtgagctccttggcgagcagcacctcgcgctcggggtcgagctcgccgatcgcatcgacgagctcgaggatgcggttcggggcctcgaagacgacggtggggacgccctcggcgagcaggtcagcaaggagccgtcctcgctcggccccgcgctggggcaagaaccccgccacgcagtagcgggcgacctcgtggggccagagcgccatcacggccgtcgcggcgctcgggccggggatgacgacgacggtggcgcccaccgcgcgcgcggtggcgacgaatggcgcccccggatcggaggtgcccggcatgccggcgtcgacgacgagcacgacgtgctctccgtcgaggaggtgtgtggcgagcgcttcgggctcgatcgcgttctggccgcggagcgcgcggaccgctcggaggcggatgccgagtgcgctggcgaggcgcctcgtgacgcgggtgtcctcgcagacgacgaggtcggcggtctcgagggcgcttcgaagccgcgggctcgcgtcggcgaggttgccgatcggggtgccggcgacgctcagcacgccgctcatcgacggacctcgaggcggtcgcccgccgaagggggggcgtcgtgccagagggcgcgtggcaggacgacgatgcgccagggggcgacgacgaggcgtggccgccatggatggagccgaacggtgctgcggacgagcccgttgcggtcgagggcgagcgcgagcgcatcgccgagctccccgagcccgctccagagcgcgatcggtgtcgagatgagcaggccgtgggagtcctcggtgtgccagatcaccgggcccgcggcgtccagggtgccgagcacccgaccgcgctcgttcaccagccacgccatggcgatcacacgttgaagcggatctcgagcacgtcgccgtcggcgacgagatagtcgcgcccttcgagccggaccttgttctgcgccttggcccgggtccacgagcccgcctcgaccacgtcgcgccaggaggccacctcggcgcggatgaagccgcgggcgagatcggagtggatgatgcccgcgcaggtctgggcgttcgagccgcgtcggaaggtccacgcgtgggtgtccttgtcgccgctcgtgaagaaggtccagcgctccagggtttcgaaggcggctcgagcgatgcgctcgagggcgctcgaaccgatggcgagggcctccatcatctcggcacgttcggcaggctcgagcctggcgagctccgcctcgagcgcgagcggtgcggtgacgacggtggcgtgatcgccgaggcgccctcgcacggtgtcctcgacggccacgtcggcctcggcaccctcgtcggcgttgatcaccgcgatggcgggtttggtcgtgatgagaaaggccgagcggaccagctcgagcacgtcggtctcgagggtggcccgatagagggggatcccgtctgcgaggaccgcttggacgacctcgagggcggccacctcgggtcgggccgaggggtccgaccgcgcgaccttgcggcgccgctcgagcgcgctctcgacgctggcgaggtcggcgagggtgagctcgagctcgagggcgtcgaggttcgcgatcgggtcgtcgtcgcccgggactcggtcgtcgtggaacgcgcgcagcacgtagaggatggcgtccgcctctcgcagctggccgaggaagcgattgccgaggccggcgccttgggaggacccagcggtgagcccggcgatgtccgcgagctgcatgtgggcatagaccagcttgcgcgagtggtggatcgccgcgagcgcgtcgacgcgctcgtcgggtacgaccgcctcggcgatggtggtgtcggtggtggtgaaggggtggggcgcgacgggggtgtcgagaccggtgagggcgttgaagagtgtggacttgccggcgttggcgagtcccacgagaccgagcttgtccatggccccctcgatcatagggccagcggggagtcgtctctcgagccgctagccttgccccccgtgtcgaagcgaaccgtcaagcgcaagttgcgcgcgaagaagaaggccaatcacggacgcaagccgaactgcggtcgcggctagtcgtcaggcgtgatgccccgacgtcgctcgatgccggtgatctgaccccggagctcctctgggacgatcggtctgggtttcgtgctggcctcggcgagggcggcctcgatcgcgtcgtaggcctctcgcgatttgggcgcgcgtgccagatagagcacgacgtgcgcgagcgtgatgcgggcttcgggcatgccgatgcgctcgaccgtgtccgcggccgcggccgcgaggacaagagcctcgggatcggcgaggccgacgtcctctgatgcaaagatcacgaggcgccgcgcgatgaagcgcggatcttcgcctgcggcgagcgccgcggcgagccaccggatcgcctcggtcggtcggctctggcgcatcgacttgatgagcgcactggcgagctcgtagtgggtcgagtcgtcgagcccgagcgcggcgatctcgctgatgcgctcgaggagctcgacggtgagcggtcgctgggccgccgcgggggctgcacgctcgaggatgcgcaacagcgccctcgcgtcgccgcgcgctgcggcgacgagccaggcgatcgccgcatcgtcggcgatgaggccgaggtgggcgagcgctcgctcggcgaccgcgcggagcacggggggctcgagtgcgcggagccgaacgacgtcgcagcgcgacagcagcgcgggtgagagcgtgacggcggggttctcggtcgtcgcaccgatgaaggagatctcgccccgttcgatgggcgcgagcaggagatcgagctgggtccggccgaagcgatggacctcgtcgacgaaccagagtgtcccgtcgccgtggcgggcgcgtcgggcggcttcggcccgcgcctcgcgcaggtcccgcacgccggtgtcggtcgcgtgcagctcgacgaggtgctcgcctcgtgcccgtgcgagcaggctcgcgatggtcgtcttgcccacccccggcggcccggtcatgatcaccgcgatcgtccggggcgcggtggcgagggcctcgaggcgcgctcgcgcgtggtcttgtccgaggacctcggcgagcgaggtcggtcggagctcctcggcgagcgggcgtgctcgcaccatgtgctcctcgaagagactcaccgcgtccctgagcgcagctcgcgacgtcgcgcctcgagcccgagtgcagcgagcacgccgtcgtcgacgggcttcggtgcaccggtcatggggtcctggccgctctgggtcttcgggaacgcgatgacctcacggatggtctcctcgccgagcaggagcgcgacgaggcgatcgatcccgaaggcgaagccgccgtgcggcggcgggccgaagcggaaggcgtcgaggaggaagccgaagcgatcggccgccgcctgctcgtcgagcccgagcaggccgaagatctgtgcctggaggtcgggacggtggatcctgatcgagcccgagccgagctcccatccgttcatgacgaggtcgtaggactgggagcgcacccgcaacggctcgcgctcgaggaggtccatgtcgtcggcgtggggcatcgtgaaggggtggtgggccgagacgaggtgaccctcgtcgtcgacgccctcgaagagtgggaagtcgatcacccagaagacgtcgagcgcgtcggggtcggcgaggtggcgcccgagcgcgaggcggatggtcccgagcgcggtgcaggcgacctcgaagcgatcggcgacgacgaggatcgtgtcgccgacctcggctccggtgcgctccacgagtgcttcgagcgccgccggcgtcatcgccttggcgagcggtgaggcgatctcgagcggcgtgcggctctcgacacggaaccaggcgagtcccttcgcgcccgcgctgcgggctcgttgggtgagctcgtcgagtcgggagcgcgagaggggctctgcgacgacgagggcggtgacgtagtcggccgcgagcgcgcgcgcaccggagtcgcggaccgcctcggtgacgtcgacgagttccatgccgaagcgtcggtcgggcttgtccgagccccagcgggtcatcgcctcgtgccaggtgatcgtcccaatggggacgtcgtcgacgccccgtaccgagcggatgacctcgcgaatggccgcagagacgaaggatcgcacgtcctcttgggtgacgaacgacgcctcgaggtcgagctgggtgaactcgaactgtcggtcggcgcggagatcctcgtcgcggaggcagcgcgcgatctgatagtagcgatcgacgccgccgatcatgaggagctgcttggcgatctggggcgactgcggcagggagtagaccgatccgggctgggtccgggagggcacgaggaactcgcgtgcgccctcgggcgtcggtgtccagaggagcggcgtctcgacctcgacgaagccctgggcctccatcgcgcgtcggatggcggcgttggtggcggcacgggcgcgcaggttgcgctgcatgcgtgcgcgccggagatcgaggtaacgccacctgagccgcgtggtctcctcgacctcggcgtgctcgtcgagggggagcggcaggggatcggcgtcgccgagcacctcggcgtgttgcacacgaagctcgatcgcgccggtggcgaggtcggtgttctccgttccttcgggacgccgcgccacctgaccctcgatgcgcaccgccgcttcggtgtgcagcgaccctcgaccgtccatgacgcactgcacggtgccggtgtggtcgcgcacgtcgacgaagacgaggtgttctccgtgctcgcggatgcgcgccacccagccgcagacgctgacgtcgcggtcgaggagggattcgtcgagcgcgccgatgtagtgcgttcgaaggccggctgctggcggcagggtccgttcactcatgcgcggtggcatctccttcggttcggggcgctggcctcggcggcagcacctcgcgagcctagactgccgccgtggtcacggctcagggaaggctcatcggcgtcggggtgggcccaggggaccccgacctcgtcacggtccgtgccgtgcgtacgctcgagcgcgcccgcttggtgctggcccccacgctcgatgcggcgagccccgggcgcgccgagcgcatctgccgcgaggcggcgccgtcggcacggatcgagcgcgtggtcatgccgatgacgagcgatgcggaggcttcgtcgcggcgccgggcgagcgccgccgaggtggctcccctggtggtggccgcgctcgaggtgggtggtgacgtcgcgtgggtgacgctcggcgacccagggatctactccaccttctggctcctcgtcgatgccgtccatgcgctcgcccctgacgtgctggtcgaggtcgtcccgggcgtggtcgccttcagcgcccttgccgccgcggccggcgttgagctcctcgacgacgccgaccacctcgtcctcgcgaccgggcgcacccggaccgaggtcgtcgacgctgccctcgccgatcccgacagcgccctcgtgctctacaagcccggtcgccaggtccagagggtgcgtgaggcggtggcgtcgtcggatcggcgtgcggtcgtcgggtggctgctcggcacgcccgaagccgagatccgaccgctcgccgaggcgcccgacgaggttccctacctcaccacggtgctcgtcgcaccgaggaggccacgggcgtgagcgtcgagctcgtgctcggggctcggcgatcgggcaagtcggcctgggcggaggcgcgcgccgtcgagctgcggatcgggacctatctcgccaccgcagcggcacacgcgctcgatgcggagcgtctcgcggcccatcgtgcgaggcgcatcgggcgcttcgtgacgctcgagccgggcgacccgggcgaactcgtggagttggtccggaccgtcccggggggcctcctgctcgacgggctcgggctctgggtcggctggcagctgagctcggaccacgacgtgtcctcgggcgagctcgtcgcggcgctcgcacggcggagctccccgacgatcgtcgtctccgacgaggtcgggtggtcggtgcatcccgagcgtgcactcgcgcagcgcttcgtcgatgagctcggtgcgctcaaccaggcggtggccgccatcgcggcccaagtcaccctcgtggtcgcgggcctgccgcttcggctcaaaggtgcgtgagtgaagctcgtccgctcgctcgccgggggcctcggcttcctcacgatctggccgttcgcggcaccggtgagcgccgagagcgtcctcgggttcccgctcgcgggtgtgctggtggggctgtgcctcgtcgtcgtcagggtcggagcccagcgtgccggagccctcgtggtgggggcgctcgcgttggcggcggacgcactcgtgacgcgtgggctccactacgacgcgctcgccgacaccgccgacgggctcggggggttcatggagccggcagagcgtctcgcggcgatggacgacccccgtctcggcggcctcggcgctctcgcgctcgcggtgacggtggtggtgcgcgctgcggtgctcggtgcggctggcatcagcgcgctcgggctcgtgctcgcgctcgcctggtcgcgctccgtcatgggtgtggtggtgctggagagtccgagtgcaaagcccggtggcatgacgcggtggttccgcgacgcctcgctcggggtgcgtgtcgcctcggtgagtgccctcgtcgtgttctcggcggcgatcgtcgtggtcgagggcgcgccggggttgttcggcgtgtgcgtcgggacgatcgcgggcgggttgctgtggctgagggccactcgcgcgctcggcggcgtcaccggggatgtggtcggcgcggtcggcatcgtggccgagaccgcgctcatcgtgggggtcgtgctgggtgcgacgcactaggtcgctcgagctcgcggtcgcgctcgggctcgatgcgatgctcggtgacccgcccgaccgctggcacccggtggcctggttcggtcgggccgcgagcgtgctcgagcgacgctactggcgtgacgatcgtcgtgtcggcgcgctcgtggcaggtgcgctcgttgtgggtggcacgctggtcggcgcggtgatcgatcgcgtgcctggtggggccctagccagtgcgtgggtcgccctcggaggggccgggctgcggcgacgagcgctcgacgtcgcgcgtgcgttggacgacggtgacctcgagcaggcgcgtgcgtggctcggctggctcgtgggtcgcgatcgcgacgggctggacgcgaccgagatcgcgcgcgcgaccatcgagtccgtggccgagaacacggtggatgccgtgctcggccccatggtctggcacgtcgcgctcggctcgatgggctcgatcgcgctgcgcgccgtcaacaccctcgatgcgatggtcggccatcggaacgctcggttcgagcggttcgggtggttcgcagcacgcctcgacgatctcgtcatggcgccgccacgccggctcgcgatcgcgctcgcggcgccgtcgcatcgccggctcctcccggcggctcggtcgcacccgagtccgaacgccgggcccatggaggcgctggtggcggccgcggtcggcgtgcgcctcggtggtgtcaaccgctacggggacgcggtcgtcgagctcccggtgctcgatggcggacccccgcccgacgccgcagccattcggcgggcggttcggtggtcgcgcagcgtgacacttggcacgctcgcctttctcgccgtggccgagcaggcggcgaacgcggcggtgggccgggccccgtagcgtggtggtgtgctggttcgtgaggtgcgtgtgcacacggggcgtcggctcgtcaccgacgtctccgccctcgtcgcagcgatcgtcgccgaccagggcgatggcctcgtcaactgcgtggtgccgcatgcgacggcaggtctttgcctgatggagatcggctcgggatcggaagacgacctcgccgtcatgctcgagcagctcgcgccgcgcacgacgccgtggcgccaccgacacggaactcccgggcacgggcgtgatcacgtcattccggcggtcgttgcgccctcggtggtgctgccggtgatcgacggtcgcctgctgctcggcacctggcagtcgctcgtcatcgtcgattcgaacgtcgacaaccccgagcggcggctcgtcgtcgccatgctggctgatggcaaatcccggggcgcgagcgcacccgaggagcgctcggatgcgggcgaacggcccggtcgggacgtgccttaggccgtgcgcagacgacctgagggccgccgctccggtgggacctgtgcgatgagtgggttcgtctggtcgcgctcggagatgacggggtcatcgagctgccagaggccgtggaacgtggggtcgttccagcggagtccgagttcgtcgtcggggttgtagtagccgtcgacgaggtaggtcagcgtcaggtccgtgagggcggcgaaaccgtgggcgaccccaggggggatgaagaggccgatcgggtcctcgtcgcccatcagcagggaccacgtcgtgccctcggtccgcgatccgtggcgaaagtcatagagcagcacctgtgccgtgccccgcacgacgtaccagtagtcggcctggtggaggtggtagtgcatgcccacgagcgagccagcgaccttgtcggagcgcgacccctgcaccatctcacgaccgagcgggaaccacgagcgacgataggtctcttggaacgcgccgcgcgcgtcggcgtggacggtcgggcggatgacgatcacgtcggcgatctctccgtgggccatggcaacctcctgactcgccggctcagtgtaggcccggccaagctaagtgggcggtggccgtgagtctctgagcgatcggcgacattcggtaggctatgagtggcacagttgcacgcacggtgcacgcaaggagctctatgaatgcagcgatcgtgatcgtcgcgctcttcgtggtggtcggcgtcgtggccatcgtctcgcttcgaggacgtacgcgcgaggtgcgcacggtcgatcaccatcagcgagcgctcgacacgctcgagcgcttcgccaaggagcgcggtgtgcaagccgaccatcgcgtcggcttgcccaagagcgagcaacgtcgagtcgccgccggatcggacgacgcgcccccggtgcggctcgacctcggtcggctcgccgacctcaccgacccggacatgatccgcatcgaggcggactacctggcgagtggcgccagcgccgagacatccgctcaggcgcccggtgacgaggaaccgacgaaggatgctgccgtggccgcatccacggaggacgaggcggtcgagcaggccccgccaccggcgacgaggccgatcgatcgggccgtggccgatcggaccacggcgatggcggcgatcacgcccgatcgagcgcccgaggaccgaaccgaactgctctcggcggtgggcccatcggccgccgtggccgccgacgatcgatcgcaccgcggtgacgacgctgtgcgcgagcaccgggtctaccagctccatcggcgtactcggctcccggccgtgatcggtggtgcgggaatcgcggcgatcgcgatcggtctcgtcgccttcgaactctcgagccaccatgcggcagcaccgacgtcgcagtccgcctcgagcccgacctcgtcggcgccctcgaccacgaagcagtcgtcgaacgcgaagacctcgacgacgtcggcgtcgaagaagacctcgacgacgtcgaagacgacgtcgtcggcgaagaaggccaagggttcggcgagcgctgggccggcggtcgcgctggtgagctccagcagtaccggcgcgacctacaacgtggtcggcggtgcccacaccgtcgttctgcaggtgtcgagcgcaccctgctgggtcgaggacgcccaggctcccggtggtcaggtgctctgggacgcgaccttgccggcgggtggcagctacacgatctcctggagcggtggaccgctgtggctccgcaccggcaactcgggcgtgctgtcggtgagcgtgaacggccatccggtgcacttcagcgcaccgccgggtccgttcgacctgctgttccagccggtgcgttagtcggtcgctggggtcagcgccgcttgcacgaaggcaaggacctgggcctcgtcgtgccaggcgtccttgcgcttcgtgggcccgaggtgaccttgttcgtcgtcgacacggatccacacccgtgcctcgggattgaccaaccggagcttggctacgtacttgagtggttcgaagaagccgacgcgcacgtcgttcagcccggtcgtgacgaggatcggcgggtaggtcccttcgtgcaggttgtcgtaggggctccatcgcgccatcgtctcggcgatgacgtcggattcgagcggattgccccactcctcccactccgtcacggtgagcggcagtgaggggtcggacatcgtcgtcaggcagtcgacgaaggggacctcgaggacggcggccgcgaagcgctctggcgcccgattgagggccgcaccgacggtgatgccgcccgcactggcaccacgaatggcgatcgcggagggatcggcgatgccctccgcaacgaggcctgccacgacgtcgagcaggtcgcgcacggtccgttccttgcgctcgagccgaccggcgtcgtaccacgatcggccgagttcgccgccgcctcgcacgtgagcgatggcgaacgtgatgcccgcgtccaagagtgagaggcgcgagatcgagaaggtcgggtcgatggcctcctcgtaggcgccgtaggcgtagacgagcacgggtcccggcgcaggtgcgctccggcggcgagcgatcgtgaccgggacgaggacgccgtcgtcggcggggagccacagccgtctcgtctcgtagtcgtcgaggtcgacgtcgccaccgacgcgctggcgccagcgctgcgtcgtcgtctcggtggtcggcatgtaggaccagatggtggcgggctcgacgagcgagaccgtctcgaagcgaacctcgtcgtcgtcgaggtcgaggttgccgaccagcgctgcggtcgagggctgctcgggatcgacgaggaggcgacgttcgctcgctggcgctccccaggggaggaacgacacgacgagcgaggcgcggcgtcgcgtctggatcgcaaggccgtggcgggtgatctcgaacccctccaggatctcgccgtcctcgagtaggtcgacctcggtgaggggttgctcggggtcggcggtgcggaagagacggaactcggcgtcgtcgcggctctcgatgaggtagaacccgtccgggccgtggtcgagctggtagagtcgaccctcctcgcgcggtgcgaagggccgagggggggtcgcgagtgggtcggtggcgtcgaggagccaccattggctcgtgcgcttggattcggcctggatggtcaagaaggcgcgatccttcgtccgtcccacgtcgaggaagtagtgggcatcgggttcttcgagcacgaggatgtcgtcggacgggtcgctgccgatgcggtgtgcccacacggacgcggggcgcagggtctcgtcggggcgcgtgtagaggagcgttcgcgagtcgttggagaggacgaagccgtagccggccggaaagatctcctcggctcgagtgatgatgccggcctccagccggccgacgacgaggcggagctgctcggagccgtcggtgtcgacgccgacgacgacggtgtgctcgtcgtcgccgatcaggagtccggcgagtgcgaagtaggcgtgaccgtcggcccaggcgttctcgtcgaggacgagctcgcgtggtccgcctgcgacgggctcgcggtagtgcaccggatagtcgaggtccggttcgatccggctgaggtagcgccatgacccgcgacggacggggtagctctcgtcgggttcgaccacgcgtgagcggatcgtcgcctcgatgcgtgttgcggcgggcgccaggcgttctgcgagtgctgcgaagctggtgcgagccgaggcgatcatgtgctgggtgcgcgggtcgtcgatcgagcgcagataccagtaggggtcgatccgtgtgcccgcccgccctcggagcgtgtgtggttcggggtcgggagcaccgagaggagcgaggtccctcgtgagggcatcgagcatcgtgcgcatggacgcgagtgtagggagcgccgttggctcgggccgttcggggcgatatagactaccgaggtagtgcaaatagggaggcccgatggcgaaggttgacctggccctcgatcgctacaagctcggctggtctgacgaagaggcctatgtcttcaagccccgcaagggcttgagccgcgagatcgtcgaggagatgtcgcgcatcaagggcgaacccgagtggatgcgccgattccgcctccgctcgctcgactacttcttccgtcggccgatggcgccgtggttcgcggtgaacatgcccgacctcgacttcgatgacatctactactacatcaagccgaccgatcgccaggtggaccagtgggaggcactccctgagaccatcaagcgaacctgggaccgcctcggcatccctgaggctgagcggaagtacctcgccggcgtcaccgcccagtacgagtccgaggtcgtctaccaccgcaaccgcgaggagctcgcccagcaaggggtcatcttcaccgacatggactcggccgtgcgcgagtaccccgacctcgtgcgccagtacttcggcaccgtgattcctccgaacgacaacaagttcgctgcgctcaactcagcggtgtggtcggggggttcgttcatctacgtgccgccaggggtcaaggtcgacatgcccctccaggcgtacttccgcatcaacgccgagaacatggggcagttcgagcggaccctgatcatcgcggacgagggcgcgcaggtccactacatcgaggggtgttcggcgccggtctactcgagcgactctctgcactcggccgtggtcgagctcatcgccaagcccggtgcgcgcatcacctacacgaccatccagaactggtcgtccaacgtctacaacttggtgacgaagcgtgctcgagcagaggccgaggctcgagtcgagtggatcgacggcaacatcggctcgaggctcacgatgaagtacccgtcggtgtatctcgtgggtccgaaggcgtccggtgaggtgctgtcggtggcctacgccggtgccggccaacaccaggacacgggcgcgaagatgatccatgctgctccggagaccacgtcgaccatcgtgtcgaagtcgatctcgaaggacgggggcaatgcgacctatcgcggactcgtccacgtcgacgatggcgccgagggcgcgcggagcttcgtgcgttgcgacgcgctgttgctcgacgaccattcggtgtcggagaccaagccctacatggaggtcgccgagcgcgcgtcgtggatcggtcatgaggcaacgatctccaaggtcagcgacgaccagctgttctatctgatgagccggggtctgtcggagtcgcaggcgatgagcatgatcgtgaacggcttcatcgagccggtgacgcgaaccctgccgatggagtatgccgtggagtggtcgcggctcatcgagctccagatggacggggcggtcggctaggtcgtcgtcgctgccgcgagcgcgcgctggttggcggggtcgtagccgagttcgcctcgaggtcgttccatggcggcgtcccggggcgcgcgggcatcgctcgccgacatgtctgctctttcgtagctcgtcgcatttgggagcttcgggggccgtggtcggtgtttggtctgcgaggcttctcggggagccatcggaggctcgtcgcacgcgcatccgggcgctggggcaacgatcgtcgtcgtgtcgcgacgtgcacgagccgctcgaccgtgcctcgccagattcaaggtctcgccgtgaggttcgccggctgagggtcgtgtgagcgcatcgcgatgcctgaagcgtacgccggctcgcagtcgcggcccgaactcagatggcctgcgccgttgtcggctgtgggcacgggggcgcgacagctgggcagcggcgccgtcgtgaggatcgaggacgatgcgcatcgaaggccggtggtacaatcggccggagagccattcggaggcgtcgtgctcacagtcgatcaagcgacctcccagaccaaggggaatcaggcgcgcccaacccggtcggtgccgcgtgtgttgcggtttgctcctccttcggtcctcaccccggacgaactcgtccggctgcagcgttcggtgggcaacgaggccgtcgagcagttgctcacccaacgcctcgatgcgcttgctcacaagaagcccatcgatttcacggcaccggtcacggtcgtggtggatgacggtgtgcccgacgttacgaaagggcagtcttctccagagccggatccatacgccaagacgccgggcaccgttgggaccggcaccgaactccagggccccggcaacgcaccagtcgggccgacgtcgccctggagccagggcaatcgcccctttggaccgcgtacgacgccgttgatcggccagcgggactcgaagtcgccggatccatacgccaattcgaagtcgccgagtccggtgtccggacctgcgagcaattcctggcagtggggattccgatcgcacgtgcctgcgaagctgagcgtccttggttctggccggcgaagcgatccgtacgctcggtcgcctggaagcctgcccgcacccacgacggctccaatggcacagggtccatcggtcacgcaggcactcgaggttacagggtctggctccggcgctcgggtgcccaagtcgctgaagacgacccagggctatctcaaactcaagtcccgtcgctccgaatttgaaaacgagttcacttcggtcagcgaatccatgaaacgggtcatgaagtttgtcgagtcggggttgcagcgtggagagttccccgacaccacggtcgagggtgtcctcatgcatgcctttggttggaccgaggatgattgcaagaaatatggtaagttcctcaaggatccgacgaagcagtacaagaaggaagagacccccgtcgtgactgctgtgcagccgaacgagcgctatcagtacgagctgcatttcggctcaaccatcacgcgaggaacatcgaccactccgtatgacaccacagcagagcggagtcagttcctcggcagtggttatgccatctacgtcatggaccagcaggggaagttctatgctggaaaccagaaggtcggtcttttccaccactcctcgctaatcggaggaggccaggtcgcaggcgcaggggagctgcaagtcaagaacggcgaactgaagttcttgagcaacgaaagcgggcactatcgtcccggcattgaacaatgtctccaagtgcttgaagagctacgatcgcagcggattgatctctccaaggtggagttcaagttcgtgtcatcgtgggatgaaccaaagatctggaatgccgaacagctctggaacgtgctctcgcattctcaggtaccgtcttaggcccggtcggaacgagggtctctggtgaccgaatgagtcgttcgcagcttggcgacgtcgtcgcggcgtatcttgtcaatcggccttggggtgttcaacaggtggccgacgccacctatgccatcgaagttcatggtgaacatgggcagtggcagtcatacctcacggttcgagaggacgagcagcaggtgctcgttcacgccatactgccctttcgcatcccgttcgaccgccgagccgaggtggcgttgtatctcactcgggccaactacggcctggtcatcggcaacttcgagtttgatctcgatgacggcgaggtccgtttcaagacggcgatcgatgtcgagggcgctgccttgaccgaggcactggtcgaccacctggtgatcgcaggagccgtgacgactgatcgctacctcccggggatccatgccgtggtcgaaggtgcgacggctcgcgaagccatcgccgtcgtcgagggcgagcagggccaagagttgtgagggtggtcaacgctccgctggaggcggagtgtcggaacggttgctcgacgcgcgaacttggtgcatctccgcggcgggaaccggcgagcctgtgagcaacggtcgagctgagctgctcgtgggtccgagccaccctcatcgtcatggcggcggtcggccttcgggatctcgtcaccagggagtcctcgtcgagtgcgcgcagagacggcagatcggaggcgacgttactcagttggtggtgagggaactcctcgaaacgagtgcgtagccgctcaggatcaggtcgcgctgctcgttgtcgagggacgaggatcctcgtcccatcagcgcccttcagcgcgtaggtcaagaccggaccatcggtctcacggaggagtcgcggggcgaccctgacctggagatcaggttggatcacgtcccgccgagtggtgtcaactcactccctggctggcctcagctcacgacggctggctcctcctcggcgggcgaggccagcacgcgagcagcgcggaggggccgagacgtcttcgaggtgcccgccgtctgtcgtcgcgcgtggcagtttcgagctcgaccatggactcctctgacaggtcgtgttgctcgaaagcgccccatttcccgtgttggccgagcacgatagcggtgacgaggcgcccgagagctgcgtcgttgccgaagaccccgacgacgttggtgcgccgctcgatctcatgatgggcccgaccagagcgggttcgtgaccagatcgtgcccgaggagctccccgggaagctctcgggacggtgcgcgacctcctctgtggcctcggcgaccatggcgcgagccgctgggagtgtcgtggcaagggagtcgatgacctcgtcgtcctgggtcgggagcgctgccggggaggcttccctctgtgtcaatcttgagtgagaccactctcccgaccccattgttgtatcgagagggcggctgaccaaggagatcctgaggaccatgacgaccgacgagaccgcgagcacgcaccagactggagccatgccccccacccctgacccagaccctgaggtcccggagcgagctcgaggaccaagacgcttctccgcggcctacaaggcacggatccttgccgagtatgacacgcttgcaaaggccgagaagggagccctgctccggagagagggcttgtactcctcactcatcaccgagtggcgacgccaactgagaccgtgccatcgaggaagcactcgcacgcccaccaggacgccaacccgctgatccccgcgaccaggagatcgcacgcctcgaggcgccgcgccgagcgcctcgaggccgacctcgccaaggcccgcaaggtgatcgaggtccagggaaaactctccgcgcgcctggagcacctcgccaccgacagcgcgcccgcgacccacggcgagaccacgtgatcgacgaagccatcggcgaactggcgccaactgtcggggtacgcgcagcctgcgccgcccttggagagccccgggcgcgctatggccttcccccctccaggttgacacctgctataggaggaagggatgagccagacaccgaacccaccaccgggcgacgggccagttcgtcgtcgacgaggtcgctacccgagccagttccgtaaggacgccgcagcgttggtcctcgatcagcggcgaaccatcgccgacgtcgcccgcgagctcgccttcaacgaacagacccttggcaactgggtccgtcaggaacgcatcgaccgcggcgagcgcgaaggtctcacgagcgccgagcgcgaggagctgacccggctgcgtcggcaggtcaagcagctcaccatggaacgtgagctgctcaaacgagcgatggccttctgggtgaaggagggcaaccagtgagccgctaccactggattgccaaccaggaggccgagggcgtcccggtaacggcggcgtgccgagtagcgagggtctcccgccaggcctactacgcctggcgacaccgcaacaaccgaggccctgacccagagcacctggtgctcgtcagcgaacttcgcaccatctggcaggcaagcgacggcacctacggcagccctcgcatcacccacgagctgcgacgacgcgggttctgcgtgaaccataagcgggtggagcgcatgatgcgcgagctggggatggcagcgtgcccaccccggcgcttcgtgcgtaccacgaggcgtggggaagacacgccgctcccagatctcgtctgtcaggacttcgcccctcgcgagccagcgcgccggtacgtgagcgacatcacctgcgtcagaagcgacgagtgtaggcaccgggcgttaactgaccctagaacaccggaacgatagtgacccaccctccagagtaggttgccctcaagaagtcaagaagggggcagcccgatgctgaagggcaggtcgttgatgaggctattcgaactgcaggcagaggggctcagctaccgcgagatctcacggcgcacgggccactcccggaacactcctacgtcgctacctgccagacggcgcaggcacgaggaaagtcacccgcccccgacggggctccaagctggacccctccaaggcgcaagatcgaccggctggtggccgaggggctcacctcggccccggccatcatggaacggatcgccaagctgggctatgagggcaaggtcaccatcgtgcgcgactctgtgcacaccatccgccatatggcacccccgaggccggtgcccatccgccgctacgagaccccgcctggccaccagctccaggtggagcgggggatcttctcctacgtggacgcccgaggcgaggagcggcgcatcccagggctcgtggccaccctcgggcactcgaggcgcactgcgccacgtttgccccgagcgccgacagcgacgggttcatcggtgcactgctggaggccttctgccacttcggagggctcacgaagtggtgctcaccgaccacgcaaagaccgtcgtgctcggcggggatggcgagagcggctacgagtaccaccctcgagctccttgacctcgctcgctacctcggcatctcgatctcgctgtgtcgggtccgccgacctcaagaccaagggcaaggtggagcgctccatccgctacgccaaggagcacatctcgccagcccgccagttcgtcgacctcgcggacttgaacgaccaggcccgtcggtggagcctcgagcgtgaccaccggctgcatccgagcctcggtaccacgccgatggaggtcttcgaccgcgccgagcgtgatgccttgcgtcccctgccgccacgcaccgagctcgatgcctttgtgcgccgtccgagacgggtgagcttggacggcctcgtctccttcggtggcatcaactacggggtgccgatcgcctatgtcaagcgcacggtgtgggtgctgccccgaggtcgcactctcgagatcactgacgcaaccgggaaggtgatcgccacccacccgctcgggttcaagacccgcacagtggtctacctgccccagcagtaccaggggatcgctgcctcagaacctgcgctcgcactccgaggcccccgagctcgccaactcgccgaggtcgatgtcgaggtgcgctcgctcgatgcctatgaggcgcttgtccatgcttgaggtcgccgaagcactccttggcgagctcggccttgcccgcagcgccgagctgctcgcttcgaccatcgaggcagccacccaacgcgaggcctcgtacgcggacttcctgatcacgctgctcggtgccgagcgcgacgagcgtcgccaccgtagctacgagactcgtctcaggctggcgggcctgccccatcgcaagggccttggcgagttcgacttcgacttcgccaccggggtggaccgctccctcgtcaacgagctcgcctcctcgcgccttcgtggtgaacgctgcgggcgtggtgctcctcggaccccctggggtgggcaagactcaccttgcggtgggactcgccctgtcggcgctcgaggccgggcactccgtctacttcgccaccatggcccgtatggtggcagacctcgagggcatggtgagcccgaggcgcttgcgcaaatacctcgcccccaaggtgctcgtcatcgatgagatcggcaccggacgctctcgcacggggcagcaggggtcttcttcgaggtgatctcggctcgctacgagaccgggagcatcatctgcacctcgaacaagggcttcggggagtggggcagcctggtgggggacccggtgctcgcaaccgccatcttggaccgcctgctccaccacgccacggtcctgaacatccgcggtgagagctaccgcttgaaggaccgcaccaagcaacggctacccggtgggctgctgtcccaggcggccgaggccatggcgaaaggaggtgatgccgaacaccacgatctggggagctatcccctatagttgtgtcgcgggtgggtcagttctgactggtgatatcgggtcaaaagaaggccggtgcctacaacgaggggttctgctatctcgcctcggtactcgaccttggctcgaggcgcgtcgtcggttggtcactcgagcgtcgcatgccaggagaacaggtggtcgaggcgatcgagggagccctttcgactcgggggagccttgctggggccatcttccacagcgatcgcgccaatcagtacctctcccggaaggttcgccagctgtgcaccacgctcgggcttcgccagtcggtgggcagggtcgctacctggtacgacaacgccgtggcggaggcgttcttcgggagtttgaagcgcgagctggtggctcgctaccgcttcgcgaacctcgccgaggcccgctcagccatcgcagcccggatccaccgctacaacaccgtccggctgcactcgagcctcgggtacggaccgccaatcgagtacgagctcacctgggcccgggaggaggcggccgtggcctaaattcagactgtcaagcaaatggggggcagcccagctcgctctggcgtcgctccctggatccaccctccaacacggtcggagtgcattccgagcctcgggtacgtgccgcccgtgaagtacgagctctcctggggggcgaggaggtggctgtggcgtaacttcagactgtcaagcaaaggggggaggcccagggtgcctcttctggctagctgctaactgacacaccagagatcgctcgggggcccgccctcctggagtgcgggccggccggatatgacaccacttggtgggacgccactcagtttcctaccctaggattggctcatggcagctacgaacatcccgcagtatcacgagctgatgtggccagtgctgactgctctcagggagctgggcgggtctgccacggtcagggaaatctacgaccgggtcgtcgaaaacgagcatttctccgaggaccagcaggctgaatcgaccaaggatggtcgtatgtctgagatcgagtaccgcctccattgggcgagaacccacctgaagggaatcggcgcgatcgagaacagctctcgtggtgtctggtcgttgaccgacaagggccggacgatcacgctggaccagatgaggaccgatacgaaggcgtatcgagacgaggtgcagcgtcgggcaagacagaagcaggctttgaacagcgcagccgtagaaactggtgatgaggagccggagacctggaagaatcaacttatcgatcggctcctcctcatcccgccggacggcttcgaacgactcgctcagcgactgcttcgtgaggccggatttgtgaacgtaacggttctcggcaagagcggggacggaggcatcgacggtgtcggtgtgtaccgactttccctcgtctcgtttcccgtctacttccagtgcaagcgctataaaggaaccgtgacggcaggtgcggtccgagactttcggggtgccatggcaggccgtggagagaagggtctcctgatcacgaccggctctttcaccaaggacgctcagaacgaggccagccgtgacggagcaccccctgtcgagctgatcgacggggatcggctctgcgacctcctccgtgactaccggctcggcgtggacgtccgggagcgcgtcgaccttgagattgcgctcgattcctcgttctttgacgagtatggctctaccgacgctaccagcccgacctccgcttgaagcccgctgccaaacgccccacccgattgtcccctcttccgaggcgaagcggctgtcgtggtggatgaacacagggaggagctggcacgtgcgggcctggctccttggacttcgcggttcgtgtccccgctcgaggctggcgacgcgtgagctgccgaggcacgagcagtcggctggccgcgtcaacaacaagcgcatccatcgcctgtgggttgcagcgaggcgctcaaggtgccgatgcaagcgccgcaagcagccgctccgcggtcttggcgtcgcaggaggcgccatgggcccgatcaagcctcacgtcgtgtctggcctgtgactttcagttcgatcagacgagcgacgccaaggagccaaagctcctcgacgtcatcgacgagttcatccgagaggcccttgccacctaggtggcacgggccatctgtgctgatggcgtcgttcgctgtgtggaccagatcgcgcttgcgcggggagtaccagcctctgtccttggaccacggactgcgagttcgtggcgcgaggcagtggcggactggtgcagctacaacgcagacggggaccgttgtcatcgacccaggctcgccgtggcagaacgcctggatcgaaagcttcaacgggaggatgcgcgatgggcacctgaacccaaaccgcttcgacagcctgctcgaggccacagtgctcaggccaagactggaggaacgacgacaactggaccaggcctcagagtgcgcatggctgggtcagtcccgcgcagttcgcaaaggcctggcgagagaagcatgagttacagccacagaggggctggactcggcaatgggaaccggtcaaagtctcgagccgccgagagcgcgagcgccggggcggtcagtagctcccgccttcccgacggtgggccaggctcccaaccggaggtggatcagaccccaccaaccggtgggggccgagcactcgcgtgggggccgtagcgagatgtctgtcgctgtcggaacccaccatgggtagtcctcgcatcgtgggaagtggactcgggcggcgagcgcgatgacgggcggggtgtgagcgatcctcaggagtgcacgggcaagagatacgctccgatggtgtcgtgcacgcgtgctgggcacgtggcacgtctggtccgggcgcgagtgaggggagccgggacgccacttggctgcagggccatcgcatcggcggcgtacgactggactgattgaatcggattcccaatgggccaggaagcccacgccccttcggggccatcggcgaggcggggctgagctatgcctgagtgcggaggaagggtgggcgctgtcgggcgaagttacgtcggcggcgcggtgcgtcatcgaccgcgtacgacgcgtaccgatccgaacgccgtgacgaccgtggccgagagggctcggccgtcgtgcatgggttcacggtgccgtcgacgcaagcgcgagccgacgatggtgacgccggtgagcgcgagccgatcatgggccgcgacgacgagcttggtggttccgaacaggttgacgatgactacgcgtcggggcgggggattggtggcagggaactccactcgaagtcggcccatcgcgttcacgatcacgttgacggatcgcttgagctggagaactcccgatccgaacgcattgaagccgatgccaaccccgggctcgtgtggcgcgggcagctcgagcggccggaggtcggcgaggagtcgagcgagctcactctgcctacgcgcggcgtaggcgccctcgatgcgctcggcggcctcgtcgacgtcgagctcgccggcggcgagcgcctgacgaaggcgctccgcggctgcctctcgttcggcgtccgagcagcggtgctcgcggtcgtccgccatcgatgctgagcctataggccttttgcgcgcgacgcgggcgatgaggggatctgagtggacgatgagggtgtggggccaacccggtcagacagacgactgggaggtgggagcatcactggtgcgcgacgggtgacggggtcggcgcaggttgtcgaggatgcggcggagctcgccggtggtcgtctgctcggtaccctcggcgggtggcgtggacggcgcttcgatcgagtcctcgagatcgaggcgtggcagatcgaaaccgaacgtcgtgcctcgccccaggccgtcggaacggacccaggccgttccaccgtgtgcatgcacgatcgcagcgacgagtgcgagtccgaggccggccccgccgctcgcgcgtgagcgtgactcctccgcgcggtagaagcgctcgaagacgtgctgggcaaccgctggtgtgagtcctggtccgctatcggcgacgctgacgcggaccttctcgtcccactcgagcatcgcgaccgtcgggtcaatcccgccgaagagatcgctcacctccgtgggcgtgatggccccagggggcagaggagcgctgcgcgccaaggcctcgaccgtgacgtggacggtcgtgccgggtggtgtgtgggttcgtacgttggcgagcaggttcgtgacgacttgggtgagccggttgtggtcggcgaggacgagcaagccgtcgggggcgtccacggtggtcggacggcgatcgtcgaccacgttggcgtcctcgacggcatggcggacgagactgccgacgtcgacgggcgccaactcgagcgggagggactggtccatgcgcgcgagtgacaggagatcctcgacgaggctgcgcatgcgctgactctgctcgagcgagcgctgcaccgccatctgcgcgatctccgggtcgtagcccgagcgatcgacgagctccaggtaaccctggatcgaggcgaggggcgtgcgcagctcgtgactcacgtcggcgatgaactggcgcagtcgctccctggaggtctccgaggtggcataggcgctctggagccgtccgagcatggtgttgagcgctcgagcgagcgcctcgacctcggccggaccggattcgtcgacgcgagcctgggtgtcgcccgcgctgatggcctgggcactgcggcgcatccgctcgagcgggctgagccccagttggatggatgcccagcccacgatgccgagcgtgatggtcacgccgagcgatacgagcagctcggcgagcgcgaggcggccgacggtgtcctgcacgctggtgagcggttctgcgacgaccatcgtgccgccgaactcggggatctgggccgcgaggacgcgataggtgatgtcgctcaaggggtcgtgcagcgacactggtcgtccgacgggcacggcgagctcggcccgtccgttgctgaagcgcgtgagtggcggtgcctgctgccccacgtagagggtggggctgagtggggtggtgatggtcgagccgttggcgtagacgaaggttccccacgatccgaacggcaggctgagatgcaggtcttggttcccgttcgggtgcaggaccacctcggccgctgcgggggcgatcgactcctcgagggtcgtgtcgatgcggttgatcaggaacgcgtgcagcgcggtgatggtcgcgagatcgatgaccgcaacgccgaccacgagggtcgcgagggtgatcgcgagcagacggagccgcagggtccgttggcggcccccgtggtcgctacgccgactccgccgcacggagggagtagccgacgccgcggacggtcttgatcatcggtggaccgtagccgtcgagcttcttgcgcagatacgagatgtaggtctccacgatgtttgcgtcgccgccgaagtcgtactgccagacgtggtcgaggatctgcgccttggagaccaccttgttcgcgttcagcatgaggtagcgcagcagcttgaactcggtcgccgtgagctcgatctcgtgtcccgctcgcagcacctggtgggcatcctcgtcgaggacgaggtcgccgacgacgatccgagtgggcgcacccgtcccctggccggagcgtcgcaggatcgcctcgacgcgcgccacgagctctgccaacgagaagggcttcgtgacgtagtcgtccgagccgagctggaggccctggacgcggtcctcgacggcgtccttcgcggtgagcaggagcacggggacgtcgttgcgctcttctcgcagacgacggagcagggtgaagccatccatccctggcatcatgacgtcgaggatgagcaggtctggcttcacggtccggagtacgtcgagagcctcgcggccggacgaagcgacgctcacgtcatagccttcgaaggtgagcgccatctgcaggagctcggtgatgggcagctcatcgtcgaccacgagcacgcgaacgcccttcgctggcttgcgcaaactgtccatctgcccacctcgctgtcgtgttgagtgtaggtccttaccaggggccgtgcatcaggccgccggcgaggtgccgagcgtcgccgtcagggattgctgggccccgctctgggtcacgatcgacaacgtgatctgttgccccggcgacttggcgtggatcgccgtggcgagtgcgttcgcggaggtgacggcctgtccatcgaccgcggtgatcacgtcacctggctggatgcctgcgttggccgcgccggagccgggatagacgtactcgacgagcacgccggtctgcgaggtcggcaagccgagctgtgagtcgagcgtgggcgtgagtgtctgtatcccgacgccgaggaatgctccggatcccgccgtcgtggtcgacggtgacgtcgaggaaccggtgtaggcggtcgggttctgttcgatggtcttcacgatgggcagcaccgagttgatcgactcggcaaagcccaggttctgcgccgaggtctgaccgctcgaggcgatgaccgccgtgttcatcccgaccacgtccccttgggcgtccacgagcgggccgcccgagttgccggagctgatgggggcgtcggtctggatcatgccgctgatggtctcggtggtcccgaggctgtccgtcgcggtgatcgtgcggttgagggccgacacgatgccttgggtcaccgttggcgtgccttggagcgccagggcgttgccgatcgcgaccactgggtcaccgaccaccagcgcggacgagtcgccgaacgtgacggtcgggaggttcgatgcgccctcgatctggagcagcgccacgtcgtgagccggatcggtgccgatgatcttcgccgggcgcgagctcgactgaccgtagagcgtgacgcgcacgttgctcgccccggccaccacgtggttgttcgtgagcacgagaccgttcgacgagatgatcatcccggtcccggcgtcttcgaactggctcacgccgaagccgttgctcgtcgtgccggtggcggtgatgtccacgacggcaggctcgaccttggcgaggatcgcggggatgttcagcccgccttggccgctgagtgcggcgggctgcgccttgacctggcggatgacgatcggtgtgcgcgagccgccgctcgactgtccggtgaggcggaccacggcgtagctcgtgcccgccgcgacgagggcagcgagcaccgcggcggtgccgacgacgacgccggggcgccggcgtggcttggtgcgggtgggctgggtcgatccgaagctcgtgatcggctcggcggtcgaggtccacgacggttccgcgtgggcccaggtgacggtgtcgtcctcggcccgcggtagctcgtcggcgccgacggtgggtacctcgtcggtcggacgctcgtcgtcacccgacggaggttcgctcacctcggcggggtcagcggacgcaggcgcctcatcctgcggtgattcggccgcgtcgtccggctctccggcgacgggcgtcgcgtcggtgtcgtcgatgctcatctgtcctccctcgtggagctgggagcgccgctgggggcgccacgcataccagcatgggttctccacctttgcgggagcttaggctcctgtgggaggttcgctggaggatgaccgagcgcgcatgagctggacgttcgcgagcgcggcttgcgcaagctcggcctccatgcgcgttcgtcgggcggcgatcacgaggcgcttcgtggcacgctgggcctcggtgggagcggcgagaaattgggcggccacggcatcgacgcgtcgggcgagctcggcgtcgtccgccacgacgtcgtcgaggatgccgtacgctcgcgcttcgttcgcgtcgagctcgcctgcccccagggcgagggcgagggcacggtgcgtaccgacgacctctgggagcaggctgagtcctccgagatcggcgacgataccgaagcgcacctccggcagtgagcaacgcacccaccgcgtcccgatgcgaacgtcgcacgcgagcgcgagctcgaggcccgcaccgatgcaggcgccgtcgatggcggcgatggtggggatctcaagcgtggcgagcgcgaggaacccgcgctggagcatgccgatcgtctcgggacttggggtagcgccgagacctcgaagcagatcgagatcgatccctgcggagaagtgcttgccgctcccgcgcacgacgacgcaggcggcggcggcatcggacccgatctcggccaggagatccgcgaggtcgccgaagtcctccatgccgagggcgttcgccttggtggggttcgcgatcgtgatggtgcgcagcggtcccgaggtctccatcgtcagcatggcccgaccgtagctgacccaggcgaccttctgggttcacctgggccctacgatggagaggaggtggccaagggaggcgagtcagcggtggtccgaatcttcgatcgcgaggtcgcctgggagctcccctcgcgcagcagcgcccacgcggacgtcgtcgcggcgctggagccggcgacggagaagctcgaggcgtggcgctacagcccgatcgatgacgtctctgtcgcgtcgtacgccgcggtggcgaccgagacgatcgacctcggtgctgcccgcgcgctgctcggcgccgcgggtcggtcggggggagcagatgtcgtcgtcgggccgcgaggtctcgtcgctgcgcatgaggtcgagggctccgccgtggcgggcgatcgtggggccgatgagctgatcacgctcgacgaggagcccttcgcgacgctcgcgaacctgttggccccggagcgagtcgagcttcgcctcgacggtgcagccgaggccgcactcatcgtgggcgggagcggtcaccagagcgcagcctttgcctggatcaagatccacatcaccgccccgacgaccttgtggctcgtggacggagctggcccggagacgctcgcgagcgcgctcgtcgaggtcgaggtcgccgacggggtgcacgcctcgctgcgtcatctctcgatggggggtgcgggcagcatcggtttcctccagctgcgtacgcgtcttggggccgacgccgatctcgtcgttgccgaggtcgctgcccaagggggctaccaccgcacgcgcagcgacgtccacctcaccggcgaacgcgcgcgcgtgcgcatccgctcggccttcgtcgctgggagcggtgaagtggaggagtttcggacgttcgtcgtccacgcagcgccgcgcaccgcgagcgacctgctctacaagggcgcactgaccggttctggaacctcggtgtactccggcctgatcacgatcgagcccgctggtcatggatccgatgcgttccagaccaaccgaaacctgttgctctcgcccgaggcgcgcgcagagtcggttccgaacctcgacatccaggtcagcgatgtgcgctgctcgcacgcctcgacggtgggtccgctcgaggccgagctcgtgttcgcactcgaggccaagggcatcgaccccgatcgggcgcagcggatcctcgccgacggcttcttcgccgacatcgcggatctgtcggagggcgagcgcgcactcgttcggcgagctttggaggaacgatggctgtcgtaggtcgtgtggaggacttcgtcgacgcgaagccgcgtgccgtcgaggtcgacggtcacccggtgtgtgtggtgaggatcggcgatcggttcttcgcggtcgacgacatctgctcccatgcgcactatcggctctccgagggcgatgtctacgaagaggagctcgagatcgagtgctggaagcacggctcgaccttctcgttgctcgacgggcggccccagtcactgccggcgacgcgaccgatcggggtccatcgcatcagcgttcgtgaggacggctcggtcgaggtcgaactcggaggggacaagtgaccacgcccgcactcgtcatcgaagacctggtcgtcgaggtcgccgaacgtgaggtgctccacggcgtgagcctggcggtggagcccggcacgacggtcgcgatcatgggtcccaacggatcgggcaagtcgacgctggtgcgcacgatcttcgggcgaccgggctacgtccggcgccgtggggtgatccgcgtcggcggggtcgacgtgagcgaggcgccgacgtacgagcgcgcacgagcgggtctcgcgctcatcgagcaagacccggtcgaggtccctggcgtcgcacccacgacggtcgtcgccgagggcctggccgctcgtggtgaggacgcggcgcgcgcggtcgccgtgctcgagcgcgaggccgaggcggtgtcgctggatcgtgcgctcctcgatcgttggtacaacgtggagctctccggcggcgagcagaagaagctcgagaccgcgatcgccgcgtcgctccccgggcacgtcgtggtcggcgacgagatcgactccgggctcgacgtggacgcgctgcgaacggtcgctcgccggctcgagagtctgcgctcagaggggcgaggcttgcttctcgtcacccactacccacggcttttgacgcacgtcgcccccgacgtggtgatcgtgcttgtccagggtcgcattgccgagacgggagggatggaactcgccgagcgcgtcgaggctgaaggctaccgcgcctacggggtcgaggagggtccgctcagctgagctcgagcgcacgctcgagctcgtgtcggcgctcgacgacgtcttcggcgacgtcgaggaggacgaatccctcgaggcgcccgtcgcgatagtacgcgaacgtcgagtccgagcgttgctcctcgtcggcgtccgctcccggggtgccgagcacttggatgaggtgtccgtgttggtcgctccagccgaacgggacgtctcgccacggctcgtggccaccgaggaggttgcgggcggcgagctgaccttgggtggccgcggtctcgaagtgctcgctccgcacggggcgcccccaccccgggtgatgccaggtcgcgacgtcgccggcggcggcgatgccgtcctcgatccgtccgtaggcgtcgcacacgaggccaagtcccgcgacggctgggacggcgtcgctgatccagtcggtggcggggcgcacccccaacccgacgaccaccgtgtcggcgccgatgcgcgtgccgtcgtcgagagcgaccccgtcgtcgtcgaccgcgagcgcccggtggccggtgacgacggtgacgccgttcgcctcgtgccacgcaaggaccgtggtggctgctcgcgggccgagggctcgagggaggatccgctcggctgcctccacgaccgtgacccgacagccgcgttcgcgggccgtcgcggcgagctcgagcccgatgaagccagcaccgagggtcacgagccggtgacctggtaccagacgatcgcgaagccggagggcgtcgtcgagtgtgcgcagggtgagcgcgttcgggtggcgcaggggcgctgggtggagtggtgccgcccccgtcgcgatgacgaggagatcgaagccgatcggtccggcggtcgtcgcgaccgtacgctcgtcgaggtcgatgccctcggcgcgcacactcggccggtgggtgtaggcccccgacggggtgcgcagccgggttcgctccggtgcgacgtgaccagcgaggagacccttcgacagcggagggcgttgatacggcgggtgcggttcgtcaccgatgaccacgatgtcgaggtccgcatcgcgacgtctggcctcgagggcagcgcgatggcccgcgagcgaggccccgacgacgacgagacgcgtcatcgtgatcgtcggtcctagtcgacgatcgtgatggcttgcgtggggcaggctcgagccgcctggtcgaccagcgcgcgcaggtcctcggacggtgtctcgtcgagcacgtagaggtaaccgtcgtcacggacctcgaagatcgcgggtgcgaccgcttggcacaccgcgttggactggcacttgtcgaagtcgacctcgatgcgcattggctagctccctccctcggcccttcccaggctaccgaccccgtgggcgctcgtgccctggcgatggccgagtttgtcctatctcgataggggaaagcgggccggctatgctgaatgcgtggcaactcctgtactcgaggtcgacgacctgtgggtcgaggctgaaggcaccccgatcctgcgtggtctgtcgctggtgatccgaccaggcgagctgcacgtgatcatggggccgaacggctcgggcaagtcgagcttcgcgaacgtgctgatgggcaatccggtctatcacatcaccaagggcacgattcgctatcaaggggtcgatgtgagcgagctccccgtcgacgagcgggccaaggccggcatcttcctcgccttccaagatcccgaggccatcagcggcgtgtcggtcgtgcagttcctgcgtcaagccttgagtgctcggcggggccgggaagtgtcggtcctcgaggttcgttttgcgctcgccgagtggctcgagcgcctcgggctcgacccgtcgttcgcgcagcgccatctcaacgagggattctccggtggtgagcgcaagcgcaacgaggtgatccagctcgccatgctcgagccggagctcgccgtgctcgacgagaccgactcggggctcgatgtcgacgcgttgcgcatcgtcgccgacggcatcacgttggtgcgacaccaacatcccgagatggcgacggtcatgatcacccactaccagcgcatcctctcgctgctcgagccgacccacacccacatcctcgtggacggtcgactggttgcctccggcggtcccgaactcgccgagcaggtcgagcgcgagggataccagcagttccgagaggcggaggcgcttcgatgacagcgacacgtggccttgggctcgacgtcgaggagctgcgtaaggacttcccgatcttcgccgagcgcggtgcgggcttccactacctcgactcggcggcctcggcccagaggccgagtgcggtgctcgaggcgatggacgcctactaccgttcccaccacgccaacgtccaccgcggcgtctacggcctcgccgaggacgccaccgatcgctacgagcgcgcacgccgagccatcggccgcttcgtcaacgcccccgacccggagcgcgaggtggtgttcacgaagaacgccaccgaagcgctcaatctcgtcgcgcagggtctcggccgggtgctcctcggacccggtcgcgccgtcgtcctgacggagatggagcaccatgccaacttggtcccgtggatgatcctgcaggagcagctcgggttcgagctgcgctacctgcccttcgatggtgacggccagctggtgctcgacgacgcggagcggatcctcgacggcgccgccatcctcagcgtcaccgcgatgtcgaacgtgctcgggacgctgaacccgatcccccatctcgccgagctcgcgcacggagcaggtgccgtcgtggtcgtggacgcagcgcagtatgcgccgcaccatccgatcgacgtgcaggcctggggcgtcgatctcgttgcgatgaccggacacaagatgctcggccctacgggcatcggcgcgctgtgggggcggctcgagctgctcgagcagatgacgccgttcctcggtggcggcgacatgatcctcgacgtgacgctggaggggttcgtgccgaacgaggtgccgtacaagttcgaggccggtacgcccccgatcgccgaggccatcgggtgggaggtcgccatcgactacctccgcgaccgtgtcgggttcgaggcactcgccgcccacgagcgctcgctgaccgcctatgccctcggtagcttggctgatggcctcggggagcgcattcggatcttcggcccccgcgacccggagcgtcgaggcggcgtgatctcgttcgagctccagggcgtgcatccccacgacgtcgcccaagtgctcgatcgtcacggagtgtgcgtgcgtgcgggacaccactgcgccaagcctctcatgcgagagatcggccaggccgcgaccgcccgtgcgtcgctgtatctctacaacgaccgtgctgacatcgacgctctcgtcatggcactccaagacgcctggcagcgcttcaacgactaggagacctcatggacgacctcgaggacctgtatcgagagatcatcctcgatcactacaagcacccacgcaaccagggcgtgctcgacgatcccgacgcgatccgagaggagggcttcaatccgctctgcggtgacgagatcaagctctcgatcctggtcaagggcgaccggctcgccgacatccgcgtcgatgggcatggctgttccatctcgcgctcgtcggcctcgctcatgagcgaggcggtcaaggggaaggacctcgccgaggtcgatcgcatcatcgagcgtttcaaggcgatggtcgtcggcggtgagggagctgctgaggggctcgattcgctgcgcacgctcggtgaactcgcggcgctccagggcgtcgtgaagttcccggtgcgtgtgaagtgcgcgacgttgccgtggaactcgctccagaacgcacttgccacggctcgagctcgcggaggcgagtagcacccccacgagctcgatgcggtggggaggtgcgccgtcgcgggccttcgcgatcggcatctcgaggacctgcgtcggcgtctgacgcttggtgcgagcctctccgtgtggccggctcacaatggctgtggcggagtcagacccgtacgagcttcgcgcgttggcgagccacccgaacgatccggcgggaacctcatcggaactgcccctgccctgccacgacgatgggccagggtgtgcgcggcgcgtgcgctcgtcgcgagttcgggagatgtcgatgtggccatgcggcggatcctcgtcggctggacccggatgtttgccgcggccgacgtctctcgcgcccagcgggacctgtcatcggtcgggcgaggaggtcgggctcggggtgacggtcgagtcggttgcggggcgggccggcggtcgggtgcgaaggtacgcgcggacgctctctcacagagcacgcagtgcggagtcccacgccgacgcccacgccttcttcgccgcgagccatcgctgcagcgctctggtatctggccgcgctcggccctcagacttcgagccctcgtcgtcacgtggcgtcgcgccggcgggaccctcgcccagctctggcgtcgtcgtggccccgtcctccgtgcgcgccagttcgagccatgcccgcttgcgtcgctcgcactcgtgccagaggtcgtgacactcgggtgcctggcagcgctcgcgatcgagcatgaggttcgcgaactcgtccctcactgcgcgcgtcagccgctccgggccgacagcgtcgatcaaggcttgccattccatggacgctgtgatgaccgcatcgatcgaggcgtcggctcccaggtccgtcgccacggccaccgctgcgtacgctcgcagccatgtctcacgccatcgggaggggagttccagcgacgatcgggacctccgcatctcagagcgtcgtaggagcatcgcgagcagctcgttcacggcttccctggggtcactgatgtctgtcactgcaaggtactgctcgatcgcatctcggcgaacacaggagggccaacgtcggttctcagctcgcacggtgcacctgcctgatggatcggtcggtcgctgcggtcgagcgtcgttccgtcacggtggctctctctgcacgagctcgcgagtcatcgacgaccacggctggaccgctcgtgacgcagcactcttcgtcgtgcgcccagcaggcatgcgcccggtcggctcggcctgcctcgacgaccacgggtgcccttgctgggcgtgatgacggcgtcgagatgcccgagcccggcgaggctgatcgtgcccaggaaaccatgctttctcgtcgggtggccaaacgccggcagcgctcgatcgggatgcgggcgttgaggacgccctcgcctatcagccgcctgatcggtacccggtctttcacgacgatcaccctccatggtcgggcgttcacctctcaccggtgaagtcgttcgctcgtcgaacggcgtcgaccccccgacgacctcgcgtcgtcgtccaaggaggacgggatctgtcgagccgtgcgtggcgcatccgctgcatcgacgttgcgacctccgctggagatgcgggtgctctggcatctggcgtttcctgtcgtgagtgcacgctctcacgccttcatggcgaccgagatcaaaggggggcgagctgggttcgcccgagcgggcgtgcccgtccttggctggcgagtcagggggccgtcagttgccaatggcgtcccccgtcggtcgtgtgcagcagcgtgctgcatccatcgtgacagtccagtgactgtagccagcccgtcgtgggcgagacgaacacggccgagaaaccctggtgcaagagggacgggatgggcacgcgctcgacggaaccggtcgtgcgatgcacccggacgaggaacgagaacgacggcgtggcataggggctgagtgtggcccagaccgtcgtgggcgacgcgtagtcgatcgcgtcgatgtcgttggcgccgacgctgaggttcgtccaggagttcccgtcgttgctggtgtaggcgagaacgtcatcggaaggcggggcgccggtcgccgcggttgcgccgaggggacgcgtcgagccgatccacacgctctgggcggagagcgggtcgatggcgagcgggatcgtggacccggtgtggtgtagcgcggtcggcctgatcgggtcggtgatgggggagagatacgtcgcaccggcaccgaacccggtcgcggctgtggtctcgagggcgactccggtcccgttggcgacgaccgcagcgactgcgttggcgatcgacgagggcaccatgagggatggtcgctcaccggcacgatcaactgtgacgagctgaaggactccttcgggcgtctgcactgcgatcacgagcgccctctgccgcgcggtcgtaccgatcacgtgagcgttcgggcttgcgaggagcttcgagagcgccggagaactccatctcgtcgatccgaccagcacctcgagctggccgcttggcccgaccccgacgataccgaggcttccttgcgcgttgaagagtgagctgaccatcacgtcgggaaacgatcgcgtccagccggttcctggactgtagcgatagatgcctcgctcggagaccgcgacgacgctgccgttcgagagcgtgcgaaagttgtcgaactcgacaccgtgtgtcatgaaccaatgcggctggttggagacgaacgacggtgtcggcgtcgtagcaaggagcgggggcgacgcagggaagttggctccaggggtcggctggaagccgacgacgaggctcgatccgacgacctggaggctatcgggaaagacgccatcgagctgagggcccgggctcgagattgcctggaaggtggccgatccctgcgtctgggcaaagtatgcagtttcgccctgcgaggggctcgtcaccaggagatacgagctctgccgaccgaagtcgaagctcgcggcggttccagggtatcgaagtgccagcgtctcgagcaggtgccaggtcctgccaccatcggtcgtggcctcgacggtggttccttgcgctgcgctgagcaccacgtagccccgcgctggcgtcacgaagccgacgccgatgatcgtcgggcctgacgagaagtgatggagcaggcgaaagcgcgttccctggtcgaccatcgcgtagagatcgccgctctgcagtgaggcgacgaagccgtcgttgcggtcgaggacgtcgaggagagggtctggccctggaagccgtgcgaggtaggagaacgcgccgtctcggtaccggagcagcaccgggttccctccagtggccgatgtcgaggccagatagacggtaccggtagcggtgatcgagctttggaggatgtcgagcggaagctgctcgacagccttggtggctgtggttttgctcgccaccgcgggtcgcgaagcgatcgcgccacagcccgcgagggcgagtgacagggcgagcagcgggaggatctccttccgcggccacgagcgggatgttcgccccatcgcgtctcgaccactcgttggggaactcatgggttcatggtagctcacagtgcactcccggattgggggtccgcgaccagcgatgctcggtcgagttggggttcaaggtcgcgctcggtcgtgcccggggagacgccatgagcgtgcggggctcggtgtccctggcggcggagcgcccgggtggccacaggcacgttcctccaagtgcggcaccagcgagcgccttctcgtgtgtcgtcgcgaacggcctcgacagcctcgtccaccgggtctgccgcttgatgaaaccgacaggacgatcccatcgtgctggtcaatgtggccacaagggtgttcgtgccagcgcgcgctggctgtcgagcgggtcgtcgtcggacctgccgtcgccagtgcaagaaccgcacgagcggccaacccacggtgagctgtgcgcatccacccgcggatctcgctgtagttgatgagatgcatatagtatatggttgacatggagcgcatcatgaacccgtacaccccgggtgctggggatcgcccaccggtgctcgtcggtcgtgagcgccagctcgccctcgcagaggccatgcgccagcgcatcgaacacggcttctcggcaccaccgacgttcttcgtgggtctccggggagtcggcaagacagtgctgctccgggagatcgctgaccagtttcgacggcatggctggctggttccctacgcggaggcccgccgaggtgcttcggtggctcggatgctggtgacctacgtgcacgaagccgagaactctgcgcccgtgaagggacgccttcgtgaggctctggcccagttggtgcgccgcggtggttcagtggaggctcttggcgtgggggcgacgctggggccagagaccgtcgactcgacgacacgcgctgcccaggatctcgagcacatgcttcgcagccttggtgaggcggccaagagcgacagggtgggcgtggccatgctcatcgacgaggtccagactctctcgtccgagaccgtccgggagctcatctgggtcgtccagaaacttcgccaggacctacccatcgctctcatcggcgcagggctcccgcaccttgccagcgtcctcgccagcgcggtcacctacgccgaccgcttccgctacgagagtacggacaacctcgatgacacggacgtacgagctgcggtgcgtgggcccgctcacgagcgcctggtcgagtggagcgacgacgcactcgacctgttgtgcacgatcgccaagggctacccgtacgccgtgcagctgtgtgcctacgaagcctgggagcaggcggctcgcccgggcgaccctcggcagtgggtcgcgatgccgttgtcggcccagtgggcggtctcggagttcggggagcgcgttggacccccgtcggtcgagggccagcaggtgcatgccatcactcgctcgcacctcgatgccgcgatgccgcgcatcatcgaccagatgcgcgcgggcctgttccgctcacgctatgacgggctgaccccgaagcagttcgcctacgtcgaggccatgcttgcggagctcgagcccgactcgacggctcccgtctcggccatcgcccagcgcctccgcgcgtcgctgagtgcgctgtctcccgtgcgcgatgccctcattaggaagggtgtcatctatgcgccggggcgcggccgggtcgcctttgccgtaccctggttcgcgagcttcctggcagaggagatcgttgcgaccgagccgagcagctatgaagcgatccttcccgggcttcgtgctcgcggcgtcgacctcgagcctccaggcggttccaccggtgcccctcgatcgccgactccacctctgcagtcctctgactaaggatccgtaccgctcgattcgacgggtgtcgcggccgcgcggaggcatctgtctcgttcggccttgcgatggtggtcgcgtacagtcgggagtcgagcaacagtggagagaacaggtgatcgatgccgagaccgggcggctcggccccgtacgggtcgtcgtcgctcccgacaagttccgtggttcgctgacggcggccgcagcagcgcgcgcgatgagcaagggcatccggagccagatccctgactgttccgtcgtcgaggtgccgatggccgacgggggtgagggcacgctcgaggccctcgaggcggcagggtttcgcgtgcgaggcccggtgctcgtccatggaccctacggtcgccgcgtgcaggctcggtgggtccggcgcggacccatcgccgtggtgcaagcagccgaggctgtgggtcgtcgggccgtagggtcggatcggctgcgagcccccgacgccacgacgcgtggcgtcggtgagctcatctcggccgctctcgaaccaggcgtgcgcgaggtcgtcgtgagcctgggcggctcggtcacgaccgacggcggcgccggcatgttggccgcgctcggcgtcgagatcgccgatgcgctggggagacctgttggcgatgggggcgcggcactcgagcatgcagcctcggtgtcggtcgctcgggtggacccgcgcctccgggcggtgcgcatcgtcggcgccgtcgatgtcacgaacccgctgctggggccagatggggcagcacgcctcttcgcgccgcagaagggagcctcgccggtcgaggtcgaccagctcgaacgcgccctctcgcacttcgcggacgtcgttgccggttccctcggacgcgacgctcgcgcgttggccggcgcaggcgctgccggcggtaccggctttgcgctcgctggcgtgctcgacgcgatgctggtgagcggcgcttcgctggtgggtgagctcacgggctgctggagcgcgctcgatggggcatcgctcgtcgtgaccggggagggttcgctcgacgcgcagtcgctgcttggcaaggtgccgatcgaggtggcgcgccgagcgcgagctgctcacgtgccctgtgtcgccatcgtcgggcgttgcgagctcgaagcagccgacctcgccgaggccgggctcggcgaggtggtggcactggtcgactgggccaacgatgccaccgaggcgcagcgccgagctgcggcgctcatcgcgatgctctcggcgcgcctcgctcgacgctggtgcgggtagctgcgcgttggcgcggccgcctcgtcactcgccgatgtagctcatgacgtgcttgatacgcgtatagtcctcgaagccgtacatcgacaggtccttgccgtagcccgagtgcttgaagcctccgtggggcatctcggccacgatcgggatgtgcgtgttgatccagaccgcgccgaagtcgaggtcgcgagcgacgcgcatggctcgagcatggtcgcgtgtccagacgctcgatgcgagcccgtactcgacgtcgttggcgaggcgcatggcttcggcctcgtcctggaagctctggaccgtgatgatggggccgaagcattccgaacgcaccagctcgtcctcttggcggaggccggcaaccacggtcggctcgaagaagaaccctggccggtcaacgcggttgccacccgtggtgatctgggcgtagctggggaggcgctccacgagcccgcggatgcgctcgagctggttggggttgttcagagggccgaagtagacgtcctcctcgtccggggcccccaccttggtcgcggcggcctgtgcggtgagggcggcgaggaaggcgtcgtgcgcgctcgcctcgacgaggacgcgcgcggcggcggtgcagtcttggcccgcattgaagtagccggctccggcgatgcccgccgcggccttctcgaggtctgcatccccgaagacgacgaccggcgcgttgccgccgagctcgaggtgcacccgcttgatgtcctgggcggccgcgagagcgacttcgcgcccagcgcgcaccgatcccgtgatcgcgaccagctggggggtcgggtgggcgacgaggcgtcggccagtgtcgcgatcgccgaggaccacgttgaagacccccggtgggaagatctcaccgatgagttcggcgaggagcgtcgtcgacgcgggcgtcgtgtcggatggcttgagcaccagggtgttgccggccgccagcgcagggccgatcttccagatcgccatcatcagcggatagttccacggtgtgaccgcggcgcagacgccgatgggctcgcggcggatgaaggaggtgtgatcggccatgtactcggccgccgaacgaccctcgaggttgcgcgcggccgcggcgaagaagcggatctggtcgacgctcggcgggatctcctcgctgagcgtcagcgctcgcggcttgccggtgttgcggacctctgcctcgacgaggtcgtcggcgtgcgcctcgatcgcatcggcgaggcggaacagcagcaaggaccgctcggacggcgtcgtgcggcgccacgtctcgaacgcgttggcagcggcgcgcatggcggtgtcgacatcgacctcgtcggacgcagggctgtgaccgtagacgagacccgtcgatggatcgacgatgtcgagcgtctggtcggcgtgggcgtcgacgaacttgccgtcgatgaagttgcggaacaccgtcgtcatggcatcctcctgggtgtcgatggtggctgtccagtgaggggacgcttctagtcaactacatctgagccgcgcttgcaaccgattgcgtcaactttccatggcaattctgcgctttctgttgacgaagccaccaaaatcggtaagaatggtggcgcacgtcggttcctgggtcgtaccgggtcggggagccgacgtgggtggcgttcgggttgcacccagcggtcgcacacgaacgaactcggaacggagggaggtccatggcgcagcgtcgtgagccgtctgtgcgggccttccccatgattcgtggccagggcttcctcactgccgatcgagccgagcgcaacggggatggggagcgggcgcccgtccagctcgatgccatctcgaagcagttgatctccctgctgcaggtggatggacgcgcgtcctatgcggcgctcgccaagcaggtcgggctcagcgaggctgcggttcgccagcgtgtccagcgtctcgtcgagtcccaggtcatgcagatcgtcgccgtcacggacccgaagatggtcgggtttcgtcgtcaggcgatggtgggcatccaggccgtcggcgatctcgaggcgttggcatcgcagttggcggcgattcccgaggtcatctacgtcgtgatcgcagccggcagcttcgacctgctggtcgaggtggtctgtgaggacgacgatcatctgctgcacctgttgaacaccgagattcgtccactcgagggcgtgcgatcgtcggaggtgttcgtgtatctccggctggagaagcagacctacagctggggaactcgctagggacggtgagtccgtgtccgtcgcgtcgaggcgcacaccatcgaggtcgacaatgaagttcgacggtacgcgagtcggagcaagaagggaaggaagaggatgagcgagcagcacgacctgtcggacgtggcccgtcggcacctgtggatgcacttcacccgcatggcgtcgtacgacgagcacgaggtgccggtgatggtccggggccagggcccctacgtgtgggattcgaagggcaagcgctacctcgatgggctcgctggcctgttcgtggtccaggtagggcacggtcgtaccgagcttgcggaggccgcctcgaagcaggcgagcgagcttgcctacttcccgttgtggagctacgcccaccagccagcggtcgaactcgccgagcgccttgcggcattggcccccggtgacatcaaccgcgtgttcttcacgaccggtggctctgaggccgtcgaatctgcatggaagctcgcgcggcagtacttcaagctcaccgggcagccgaccaagacgaaggtgatctcgcggaacctcgcctaccacggcacctcgatgggtgcgttgtcgatcaccggcctaccggggatcaagaccccgttcgagcccttggtccccgggtctatcaaggtggacaacaccaaccattaccgctgtgtgcactgcagtgcggccgagacctgttcgctcgcgtgtgctgacgacatcgagcagcgaatcctgatggagggccccgagaccgtcgcggcggtgttcctcgagcccgtccagaacgcgggcgggtgcttcacgccggcgccggggtacttcgagcgggttcgggagatctgcgaccgctacgacgtgttgctcgtctcggacgaggtcatcactgggttcggacgactcggcgagtggttcggcgcgatccgctacgactaccagcccgacatcatcacctgcgccaaggggatgacgtctgggtactccccgatcggggcgatgctcgtgtcggaccggttgatggagccgttcttgcatgacacgacgacgttcctccacgggatcacgttcgctggacatccggtctcggcggcggtcgggctcgccaacctcgacatcttcgagcgcgaaggtctcctcgaccacgtccgtcgcaacgagccgctgttccgggcacagctcgacaccctgctcgatctgccgatcgtcggtgagattcgcggtgctggttacttctacggcatcgaactcgtcaaggatcgcgccacgcgcgagaccttcgacgacgacgaatccgagcgactgctgcgtggtatcctcaccccgacgctcttcgagctcggcctcatctgtcgagcggacgatcggggcgatccggtcgtgcagctctcgccgccactcgttgcgggcccggagcagttcgaggagatcgtcgcgatcttgcgggaggcgttcgagcgcgcttgggctgcgctgtgatcgatggcccctcggtggcccaattgtgtggcgaccgaggggccgatgcgactcactgggattcgacggggtctcgcctactacgcacgtgctgagctcgcggatgagccgtacgcgccccgggcgttgctcgggagcggatggcgagagtatccgcacgcggcagcgctcgcgctcgacgagctggtgctcgaacccgccccgcgcacgctgatccacgcggtcgatctcaccatcgctgcccccaaggacgtctcggtcgtctggggtctcgccgccgagccctttgccgaggccgtggccgaggcccatcgaggcgcggtggccgacgtcgtcacgtggctcgagcgccttgacctcgcccgtgtggtggacggggaggcggtccccgccagcggcgtgcgcggggtcggcgcgcaccatcgcttgtcgcgcgctggtgagccccacctgcacacccacgtcgtcctcgccaacgcgatcgaggtcggcgggcaggtagcgcccctcgaccatgggcgcctgcggcgagtgttgccggccctcgagctcgggtatcgggtcgagcttgctgctcggttgcgtcgtctcggtctcgtcgtggacggcgatggcctcgggcgatgggcggtccgcggcctcgatcgtcgggtggccgatgccttctcgaccaggcgcagcgaggtgctcgcccaggcgggctcgaccgcctcggcccgagctcgtcaggtggcggcactcgcatctcgacgagggtgggccgagggacccgtcgacctagtgaacaggcgcgagcgatggcgcgaggcggcacgacgcgagcgtcgcgacgggcccggcgagcgcggtgcggtcgctgcgaccgcccaggccaaccgtcatggagagccgatccgtatcgccgacccgttcttcgcggagttctcctggcaggcccgcgctgtgctcgatgccggccagggcctcggcgacctggtggcagcgagcctccgagcggccgtcggaccggctcgggcgcgcgggttgctcatcggcgctcggatccgggctgcggggagcgagctcgccctcgatggttcgctcgtgcgtcgctacggagcgctgccgctggccgatcgactggcgctcgcgggcatcgacctcacgcgccccatcgtcgaggtgtcgagtcgcgatgccgtgcggatggcggacgagctgcggcgtgcgaccgggcgagagcacgtgcgcgtggtcgcacggagcgatgccgaggccgccctgctccagcgcctcggggcgttccgcgatggccgccatcccgcccgggtcgtcgtggatgccgtccatcgtgccccgagtgacctgcgtgccctcgtgacgagtccggaacggaaccttctcgtcgaggtgcgtcgtcggcccgtcgtgccgtctcgatcctccctgtcgctccagcgtgacggtcgtcgcatcgagctctgcgccgatctcgagaccgcgctcgaacgctgcggcgcctccgtcgccgaggtgcttgggcgcggtgaggacgtgtggccggtggcggtcgtcccggacactgcgtacgcacggcagctccgacgcgtggtggcacgtgcgttcggggtcgatccgcgctccccggttcctggagagccggtcctcgtgccacggactgggcgaggccgcgtcgtcgacgtgtcgcgcgatcgggtgacggtcgagacggggggcgcccggatcgacgtcgccgcgagcgaggtggtaccgctcgccatcgcgaccgaggggagggctccgatcgccttggggcccgacctccagcggggggtcgaggtgtctgtagtcgtggcgccggagctcgagcggttcgtcgcgacttgccgagcgctcgggatggatccgcggcggatcgaggctgctccgccacgcgaactgctgaccgatccgaccgcccgagcgctgtggcgtcaagcccgcgggttgcatcgctcactgctcgggcggctcgagctcggcgagcggactcgtgaggtcgatctcccgggtctcgaccggggccggtggcgttgaggagtcttgcgaggcccctgcgatggcggtagcctcgtctcagagccgttgctctggtgcctggggagaggtcgatggttggcgtcgtcaccgcgtcgtcattgctcgaggtgacaccgccctacggcggcgtcatcgtgctcatgctcggcgtgcttgcctattgggtcggggtgccgaggttggcgcgtacgttgagcatgtccccgaagcgggttcgtctccgcgacgtcgcgacgcggcggcagcgactcgcgtggagtgcggcgcttgcgatcgcgatcgtcgacgagtcctggcccgtgctcgagctcgccagacgcatctcgctggtggcctatctcctccacaacctggtcatcgtgctcgtggtcgtcccactggcgctgctcgggttgccggggtgggtcgtctttcgcctcactgagcgtcgatgggtggacgccgtcttgtcgctcattgcccgcccgctggtggcgaccgtgctgttctgtggcgtcacgatcctgtcgatgctctcgcccatcgttgaggcacaagcgcgatccctggtggtcttcgtctacctccaggtcgtgctcgtcatcgcgggtgtcgcgctgtgggtaccggccctgcgcctgcaaccgggcgtggagaagctgtcgaccggcggtcgggttctgttcctcttcgctcagagtctgattccgtcgttccccgccgtggcgctgatcttcgcgaagcactcgttctatccgttgttcgcacgcaacgtccacatcgtcttcggggtgtcgggcgtcggcgaccagcaacttgccggtgcgttgtcgaagatcctcaccctggggatcctttggaccacggccgttgttatattggcgagggcccagacccgcgaagatcgcggggacgacccggagcccatcacctggctcgacgtcgagcgagagctgcgccgtagctcgtccgggtagccctcgggccagaaccgtgaggagcacgcgtgcagcttcgcaacgtggcgatcatcgcccacgtcgaccatggcaagacgaccctcgtcgacgccctcttgcgccaggcgggagcgttccgcgagggcgccgagaccgaggagcgcatcctcgactccatggatctcgagcgcgagcgggggatcaccatcttgtcgaaggcgaccgcgatcccgttcggcgacgtcatcgtcaacctcgtcgacacgcccggtcacgcggacttcggtggtgaggtcgagcgagcgctctacctggccgacggcgcggtcctgttggtcgacgccgcggagggcccgctcccgcagacccgcttcgtcctggccaaggccatcgagcgcggcctcgcgctcgtcgtcgtgatcaacaaggtcgaccggcaggatgcgcgcccgcacgaggtgctcgacgaggtgctcgaactgttgctcgagctcggtggtcccgacgtggatctcgacgtcccggtggtctacgcctcgggacgcgcggggcgggccgacctcgagttgcccatgcggagcgaggacctcacgccgctcatcgagacgatcctcaagcacgtgccggctcccgatgccgatcccgacggcccgctgcgcgcccaggtgctcaacctcgacgcctcgacctatctcggcagactcgccctcgttcgcgtgcacgccggtcgactgcgccggggccaaagcgtggctcgggtcggcgtcgacgggcgcgtgagcactttgcgcctcggcgagctgttccggatgcacttcctcgagcgcgtgcccaccgacgaggtcatcgcgggcgacatcgccatcgtcgcaggtgtcgaggacatcggcatcggcgagtcgctgtgcgaccccaacgatccggagccgctcgcgccggtgcacgtcgacgagccggcgatcgccatgacgttcagcgtgaacacctcgccgctcgccggacgggagggcaccaagctcacggcgcgcctcttggcgcagcgcttggcacaggagatcgtgggcaacgtctcgatccaggttcgccagacggagcgcagtgatgcgttcgaggtccagggccggggggagctcgcgctcggggtcttgatcgagctgatgcggcgtgagggcttcgagctcaccatctcgaagccccgcgtcctcacgaagctggtcgacggcgaagtgtacgaaccctacgagcgcctcgaggtcgaggtgccagaggatctcttcggagcgctcacgcaggtcctctcaccgcgaagggccgaactcgtgacgctggagcactcccagagcggctgggtgcacacggtctattggatcccggccagaggcttgctcggcgcgcgaggcgagctgctcacgcagacacgcggccaagcggtcatccatcactccgccgatggctacggaccgtgggtcggcccgatccgcccccgggtcgcggggagcctcgtcgccgaccgggctggtgtggccacgacgtacgcgttgctgtcgttgcaggaccgtggcacgctgttcatcggcccgggtgacgaggtctacgagggcatggtcatcgggctcaacgcgcgtccaggtgacatggacgtgaatccgaccaaggagcgcaaggtgacgaacatgcgctcgtcgaccgccgaggaactcgtccgtctgaccccgccacgacgcttgacgctcgatagtgccttggagctcatcggcgacgacgagtgcgtcgaggtgacgccgaaggcggtgcgagtgcgcaaggtccagctcgtcgggagggagcgcgccaaggcgcgccgatcaggcgagatcggggggacggaggcgtcgtagcgggagctcccgcctggtgagtggccgggtggcccccaggcggtacacctcccggacgaggtgggcggaaggtccgggcacctcgaacagcacgacgcagtacggcgctcgtgacctgggcacaccgagggtcggcccgacacgaccgggcacctcggcgaggccgcggaagtgggccttcgctggtgcgtggacgagcgccgcctcgagtggacgcacacagttggccgcggacgtcccgccggcggagcgcgctccaccacaggcgcagagcgcggccgcgagcaccaggctcgtcacgagctcacgtcgtggcattggttggcctcctggcgatccagaagtaggccgcccatccgatcggcagccagatccagtagctggcgagtcgatagaggatgacggctgcgagcatgggcaccggcgctcctccgaaggccacgagcgcgacggtgatggatccctcgacgacgccgagcccgcctggcgtgatggggaggttcgtcgcgagggcaccgacgacgtaggcactggccgcggccgccacggacacgtgggcatcgacggcggcgagcgcgacgaggagcgcgccgaagtcgaaggcccagttgccagccccgaggccaatggaggcgccgagccggcgcggtgggatgcgcagcggctgcagacggcgtgcactcgcggcgaggcgtcgccatcgcacgcgggtggcgagacgggtgaggagctcggcgacccaggccgacaggcgctcgagctgccacagggcgagcgcggcggcgatgccgacggcgacgatcagcgcatcgtcgagcgacgagagcacgctggacgcgggtgcgtgcaccacgagcgcgagtgcgaacagggcgatcagggtacccatcgcgaccaggttggaggcggcgatgaccgaggcggcggcgaggacgtcgacgtcggcgtcgtggagctgggcgaccacccagacggcgctcacaccggcgccgaaggggatcgagttggtgatcgacagggctgcgagcgagatcgcgaggaaccggacccacccgagtcgcgttccgctcgggaggaggacgtaggtcatgagcgcccacgccgtgtcgctggccgcctccaggacgaacgcgatggcaccgaggacggcgttcgcgtggaggacgatggcgaccgatcccgagagctgggcgcgctgggaggcgagtgcccaggctgcgaccgcgatcccgacgagaccgaccaggagccgccagtggtggcgaacgcgcgccagtcgggccggtggagccatcgctcgcgcaggctagtgcggcgcaggctggccgtagacttggccggcggtgccggggcggcacctcgggcgttgggagggcggcacgagcgagttcgacgtcatcgtggtcggggctggcgctgccgggctggcagcggcgtcttacctgcactacgcaggcttcgaggtggtcgtggtcgaggccgaggcaacggcgggcggtcggctccgcaccgacaccgtcgacggctaccggctcgatcgtggcttccacgtcgtcctcgagggctacccggagcttcgccggctcctcgcgccagggaccaccggcctcgttgggctcttccccggtgtcgcactgctcgcgcccggcgcgccggttcgagtcctcgccgatccgcgccgcgtccccgcgaccgtcgcgactaccgcccgcgagctctggcatctgcgtgggatcccgcgcgctcgccggctcgtcgagctcgtcacgcgtgccgatccgtcggtcgcggatctcgtcggggcgctgcccgagccgctcggtcgtcggctcgccgggcccttcgctcgtggggtcctgctcgcacccgagctcgacgtgcccctgtggcgtgcaggcgaggtggtgcgtgggttctggcgtggccgtgtcggcctgccacaggggggcatcgccaccctcgcggacatcctcgctcgggacctcgagggtcggatcaggaccgcgtcgccggtcgccgccgtcgagtccggtggcgtcgtgctggagagcggggagcgtctcggggcaggcgaggtcatcgtggccgccggtcccgaggccagcgctcggctcctcggggcccccaggctcaccgatggccttcgttggcgagcccagggctatgcgcacctgcgggtcgcgggacccgtgctcgagctcccggtcgtcgggctcggtcccatggacgagccgatctggaccgtctgtgaggtgggggccgcggacccgctgcgagcgccgatggatcgggacgacacgctcgtgacggtgagcttcgacccgacgctcgatccggcggacgtgcagagggcggcggccacgttggtgcccgcgctcggatcggccgagctgctcgcgatcgacgtggtggctcaggcgctcccagcgcttcgacgtgcgcctgcggttcgcatcgcccggggcgtcacgctcgcgggcgactggaccgcatctccgagtctcgacggcgcactcggatccgggcggcgcgcggcggaggcagcggcccgtgcgctgcgaggagcggggagtgaggatcgatgatgcgtgaggtcgaggttcccatcgaggcggcgagttcgggctcggtcagtgcccggatgcgctaccgcgatggccgtcgcgtgatgtgggtcgcctcgcgtcccaccacgcgccgtggggcgctctctgagcgcgacggccatcggatcgcgcgcgcggccgacctcgcgaaccggctcgggatccccctcgtgctcgagctgtcgacctcgggagcgaagatcaccgacggggtctcggcgctgcacggatgggggatcgcggcgagcgcgttggcacgctgctccgggcgcatcccgatcctcgccggtctcgtggggcccgccgtctcgggaccggccctgctgctcggggtcgccgactgggtggtcgtcgcccccgatgccttcgcgttcttgtcgggaccccaagccgtccgcgaggtcaccggcctcgacgtgtcgaaccagacgctcggtggctcgcaggtgctcctcgcccggtctggggtcgccttcgaggctgccgacgatcgtcggggggtcgaagaggcgatctggagtgtgctcgactacctcccggactccaccgatgaggtagcccgacgcatccaccccatcgatcccgatccgatcgacctcgatcggctgattccggacacgccgacggcggcctacgacgtccgcgacgtggtgcggggcatcgtcgacgagggttcgttccacgagctgagacaggcgtgggcgaatcagctcgtcgtcgggttcggccgcatcgagggccgcgcggtggggatcgtcgcgaaccagcccatgatcatggccgggacgctcgacatccaggcggcccagaagggcgcccgtttcgttcgtctctgtgacagcttcaacctgcccgtcatcacgatcgtcgacacgccgggctttctcccgggcaaggacgtcgagtggcgggggatgattcgccacggtgcagaactggcgttctcgtacgcggcgtgccagacaccgcgggtgtgtctcatcgtgcgcaaggcctacggcggtgcctacatcgtgatggactccaaggggatgggcaacgacgtcaccctcgcgtggccgtcggcggagatcgcggtcatgggggcccaaggtgccgtggagatcttgcaccgtcgtgccgacgaggaagcgcgcgccgcggccaaggccgagtacgaggaggtctacctgaccccgtggatcgcggccgagcgaggctacgtcgatgaggtgatcgagccgtccgagactcgttcgcgcatcgctcgcgcagtcgagctcctcgtgaccaagcaggagcacctgcggcccgccaagcacgccaactcgcccctgtgagtcgccgtggtcgacgtcgcactcgagcgcctcgtgaacgtcgtcacgcttctcgcggagcaccccacgccgctcgagcgcgacgagatcgtccgcaccgtgccggggttcccggctagtgacgctgcgagcgcgcgcgcgttcgaacgcgtcaaggaaacggcgcgcagtctcggcatcgagatcgagaccgtcacgttgcccggacgcagtcgtgtgggctatcggctccggcccacgacctggcagctcgaactcgacgacgccgaggtggcggcgctcgaggcggccctgggtgcggtgtgggtcgccggcgtcgagcccggcctcgcccgcatcgggctcgcggtgggggcggtgcccgcgcgtgggcgacggtcctcgctgctcgatgcgcccccggccatcgtgaccgcgatcgccgagcgcgccgtcatcgagatcggctatcgcggtgagcgtcgtcgcctcgccccggtcggcatcggcgcgagatgggggcacgcctacctcgtcgccgccgacgacgacggggtgatcaagacctttcgcgtcgatcgcatcgacgagccgatcgtggtgctggaggcccaccacgagatcgcgccggtcccgatcgacgaggtgctgcctcggcaccctcgcgagctcgtcatcgaccgcccggtccaggtcaccgtccaaggtccgccggagaggctcgcggccgtgggtgccgacccggagacgggttcccttcgtgcggccaatctcgacgtggtcctggccgacgtgctcctgcacgacctcgcgttggtcgggccccaactggcgcgcgagcgcttggcggatcgcctcgcgacggccgagcgggcgctcgccgcgacgccgaccgcgaaggtgcctcgggccggcgtcgagcgcacgaacctcgcgactcgctacgccatgctccagaccatgctcagggtgctcggcgagcggggtcgagcaccgctgtcggagttggcggcggtggcgggcacgacgcgagagctcgccgccgaactgctcgagacggcctcgctgtgcgggttgccgccgtactcgccggacgtcttgctcgaggtcctcgtcgacgaccccgacggcgaggtcgaggcgcggctcgagcgaacgccgccacggggttcgctcgcgatcgaggaggccgtgagcgtgggggcgaccctcgaggcgcttcgtgaggcactcggcggcaccttgccgccggtgctcgatcggctgcgtgcgcgcatcgccgagggtctcggtgtcgtgccgcggctcgtcaccgagcctggcgagcgtgcgtcgctcgtgaccgtgcacgaggcgatcgtgctcggcgcgtgcctgcgctttcgctatgccccgatcggtgcgccgagtggcgagcgccgtgtgcgccctcgtgaggtccacgcgctcgatggcgtctggtacctcgacgcggtgacgagcgacgggaggatccgcacgttccgcctcgatcgcatgagcgagctcgtggtcgaggcgggttgtgacatcgaggagtcggatcgatcgcctgcgacgacgaccgtctcgttcgtcgtcgacgtgccacgagccctcgaaccgctcgcggagtacctcctcgggtccgctgccgaggcggttcagggcggcgtgctcgtgcgagcgcactcgatcggatgggccgcccgggtcgtggtcgcactcggcgccacgccggtcgctggacccgcgacgctcttcgacgaggcgcgcgccgtgctcgccgcggcgcggcgacggctcgaggccgaccgtgacgactgagcctgctcgtcgccccgacgctcgagcggcgctggcgcacggcgcgcgcgtggtcctctcgacgcgcgacgaggcgttcggggtgcatgcggtcctcgtcaacgccttcgtgatcggcggcgatcctctcgaggtcgccgtcctcgcgcgcacgacgtcgcgcaaggtcgcgaacctccgacgcgacgggcgctgcgcgctctgtctcgtcgaagggacgagctacgtcactctggtcgggttggcgcgcgtcgacgccgatccaggcgcggtgacgcgggccgagcgcgccttcgccgaggcgttcggccggccgccacggccagcacccgagggctcgcgcgtgctggtcgccgttcgggtccagcgcgtgctcgccgacggtcctcggcggccggttcccgaaggccggtaggctcatcctcggccgatgtcgtcgtgaggcgggaggtagcgtggccaggggcacgagctcgctcgagcaacggggcgacgcatcgtcgtctgcgtcgagagacctggcgctccgactgatcgcgagcctcctgccgatcaagagcgtgctcggcgggcgagccgccctcggcgactgcggggagcaggcagcggggctcaccccgcgccacgtccacctcttggtggaggtgctggtgcgcggtcccctcagcgtgagcagtctcgccgagatcgcaggcgccaatctcgcctcggcgtcggtcgcggccagccaactcgaagccgctggtctcgtcgtgcgtaccgaggatccggtcgatcatcgtcgcacgctcgtgcgggccctgccgggcgccgaggcgttcgtggcggcgttccttgccacacgcgctgctgcgctcgagcatgcgctcgcccaactcgagcctggccacgcggagcagctcgtcgaactcctcgacgagctcgccaaggcactacgggtttcgatccgcgaggctcgcacgcccctgtcggcgcgatcgccccaggtcgacgagtgaatggttactgaaacgaaacaaagtagggctcgacgggtacgcgcggcgggtggctagggtgcactcgacgatgccatgtcggaacatgtggatggcgcgcgcggttgggtcactcgcgcagagcttcgagccgttcggccatgagctggggaggacagcgtgagtcgcttctttgatgccttgggccactgggtggtcaagctccggtggttcatcgtggtcgcgtggatcgccgccctcgtcgcgtcggtgtcgttgttgccatcgctcggttcggtggtgcagaacaacttccagaacttcctcccagcccagtcgccctcgctgcgtgctgcggcgctcgccaatcgcatccagaacgtcaacgagtcgctcgtcgtcatcgtcgtcgatcggccgaccgcgccgctcacgagcaccgatgcgacgtacgtggcgcgtctcgtccatgaggtgcgacacgtgccgagggtgctgaccgtggcggtgggcgcgatctcgcccacccgacaggcggagcagatcgaggtgctctcgagtcgatcgcagttctccgacacgggcacgaaggcgttggtggacgccatcgacggcgtcatcgcctcgagtcatcctccggctggccttgcggtgcacccggccggtgcggtcgccacggcggtagcccaggcgggccagaacaacacgaacgcgtccaacacccagctgttctcggtgctcttcatcctcgtgctgctgttcctcgtctttcggtcggtcctcgcgccgttcatcaccctcatcccggcgttcctcgtctcggtgttggccggcccgatcgtcgctcgcttgacgagcgtgctccactaccaggtgtccaacatcacccagctcctcatgatcgtcttgatcctcggagccgggaccgactacgggctgttcctcgtgttccgtactcgcgaggagctccagcgcggcttctcgggtgccgaggcggtgcagcgggcgatcgcgcgcgtcggtgagtcggtgagcttctcagcgttcacggtgatcgcggcggtgctgtcgttgatcacggcgacgttcggcttctacaaggggctcgggtggccgctcgcgatcgccgtgttcatcatgctcctcgccggcctcacgctgcagccagcactgctcgccatcttcgggcgcgctgcgttctggccgagccggccgcatggtcggggggtccgcgtgggctggtgggggcgcgtcgcccagcgcgtggtccagcgcccggccctcaccctcatcgtgggcgtcgtgttcttcggagccctcgcggcttttgcgcctcagaatgccccgtcaggattcgcgaccaccaccaccgcgccggcgggaacgagtgccgcggcgggcaacgccgccttgagccgctacttcccgcacgccagctacaaccccacggagctcgtgttccgcttccgcacgcccatctgggaccacctctcgacgctcgagaccctccagagcgccgtgagccgctcgcccctcttcacgcaggtgacctcgccgctcgctccggctggcttcccgatctcggtgacggagctcagtgcactgcacgcccgcctcggcgatcccgccaagctcccaccgacgccgatcggcggcatctcgcccgtcgtgtactcgcagtatcggtcgctgaagaacctgatcggaccgactgggcgcaccgtcgtcgtcgaggcgagcctcacggctggcgcacccgggtcgacgcccgcgatcaacgcggttcccgcgattcgcaccttcaccacccagctcgcccatcgcgtcggtgcaacgacgagcggggtcgctggcgaggcgccggcgtcctacgacgtctcgagcgcgtcgaaccacgacctcacgcacatcgtgccgatcgtcatcgtcatcatcgcgctgctgctcgccctcgtgctgcgctcggtcgtggcgccgctgttcctcgtggtctcggtggcgctgtcctacttcgcagccctcggcctcgctgtgatcgtcttcatgaagttcgatcatcagagtggactcatcttcgtcctgccgttcatgctgttcttgttcttgctcgcgctaggggaggactacaacatcctcgtcatgacgaggatccgtgaggaggcgcacgatctgtcgatgcgcgaggcggtcgtgcgcgccatcggcgcgaccgggaccaccgtcacgtcggccggcgtcgtcctcgcgggaaccttcgcggtcctcgcctttgcgtcgctcgggcaggccgagatcgaggagatcggcttcgggctggcgctcggcgtgctcatggacacgttcctcgtccgcacgctcctcgtgccgagctccgtggtgctgatcggtcgactggcctggtggccatccaggctcgctcgttcgggtcacctcgaggtgccgccgccgcgtgacgaggtcgatcgggtcggcctcgaggctgaggtgcgtgggacgctcgagcacgacgacgcctgagcggggcactgtgggttgggttcacgcctcgatcgacgcacccaccggcgtcgcgagcatcgtgctggatcggccggagcgccgtaacgccctcaacctgacgctgtggcgccggctcgcagaggtggcgcgcgaggtcgcggccgaccccgccgtccgggtcgtcgtgatcgagggtgccgggggtcacttctgtgccggagccgacgtcagcgagttcggtgatgcgcgagtcggggaggccacgctgacctacgatgcggcgacggaggccgccgcggccgccatcgaggcgatctcggtgcccaccgtcgcgctggtcgagggggcctgcctgggtggaggggtgtcgatcgccctcgctgccgacgtcgtgctcgctgccgcgagcgctcggttcggcgtcccggcggcgtcgttgggcacgctgtatcccgagggggcgctgggtcggctcgtgcgtcgcgtcggcgatcgacgcgctcgctggttgctgctcggggccgagcgcatcggcgccgtggaggcggtcacgatcgggcttgccgagcgggtggtcgacgatcgcgcgagtgggtacgagctcgtcgtccagatggcaaccctgtcgtcgatgacgcagcaagcgaccaagcgggtgctcgccgatcagcgtgtgcacggggagcttgctcggatcgtgttcgctgcccaggactatgctgagggccgccgcgcctttggcgagcggcgagcgccgcgcttcatgagttcgtgggaggcacgtcgggcgctcgaggggggatcggggtctctcgaggacccgtgagagaggggggaccgtgcgggttccgttgaccatccgcgacttcttgcgtcgcgctgtcgaggtgttccccgagcgcgtcgcggtcatcgacgagccgggcgtggtcggatcgctcgggacgctcacctaccgcgagttcgacgcgcgcgtgcggggtcttgcgagcgcgctcgcggcccgggggatcggggtcggtgatcgtgtcgggatcgtctcgcccaatgcggcgaagttcctcatcgcctactggggcgtgtcgggctacggccgtgtcctcgtccccatcaactaccggctcagtcgggacgaggtcgcctacatcgtcgagcactccggcacctcgctcctgctcgtcgacccggagttcgccgagacgttcgctggcgtcggcggtgtcgagaccatcgtgctcgacggggtcgacgacgctgcgctcttcgcggcagcggcggcggatgagccggggcctgcgtgggagccggacgaggacgcgacggcgtcgatcaactacacctcgggcaccacgtcgcgtccgaagggcgtggagctcacgcaccgcaactgctgggtgaacgcgacggtgttcggttggcacctcggcgtcaacgatcgcgacgtgctcatgcataccctgcccatgttccacgcgaacgggtggggcatgccgtacgccgccaccggcatgggcgcgacgcacgtcgtcgtgcgcaagatcgtcggcgaggagatcctccagcgggtctcggagcacggtgtgacgctcgcgtgtggcgcaccggcggtctgggccgcggtcctcgatgccgctgccgtgcgacgtgaccgtggtgagtcggtccccggacgggaccaggtccgcatcgtggtcgcgggtgcgccgccgccctcgcgcacggtcgagcgggtcgagacggagctcggctggcagttcaaccagatctacggcctcacggagacctcccccgtgctcacggtgaatcgacgtccgaaggagtgggacgatctcccgatggcggaggtcgccaagcggctcgccaaggccgggacccctgcgatcggcgtcgagctgcgtactgacgccgacggcgaggtcctcgcgcgttccaacgtcgtcttcaagggctactggcgccaacctgaggagacggccgccgcactcgagggtggctggttccacaccggtgacggtggcgtcaaggccggtggttacctgacgatcatggatcgcaagaaggacgtcatcatctcgggcggcgagaacgtctcgtcgatcgaggtcgaagacgtgctcttccagcatccggcggtcgccgaggttgcggtcatcggggtaccggacgccaagtggggcgagaccgtgaaggcgctcgtggtcgtgaaggacggccagacggtcagtgccgaggagcttcgggagttctgtcgagagcggctcgcgcactacaagtgcccgaccagcgtggagttccgcagcgagctcccgcgaacggcgacgggcaagctgcagaagtacaagctgcgccagccctactgggaggggttcgagcggcaggtgaactagagatcgtcgaggagtcggaagtcctcgacgagcggtatagcggcatcgagccgctcggccgcgcgggacgccgcggtccgtaggcgcgcgacgagcgtcgccgtggggtcgtccgccgccgtgacgccgtaggtggtgcggtactggctctcgtggcacgcgaggagctcggccttgcgtgcgatggcctcgtcggtcgtgggttcggcgtgatccggcgctggcgactcgtacagggccaggtagcgcggtcggtgggccgcgtggaaccccggctgccacgtgggttcgcgggcgtcggcgagcgcctggaaggtcgcggttgcgaccgcgcgatggtccggatggaggcggcccgggtggtcgggatcgtggacgagcaccacgtcagggcggcaagcgcggatggcggcggcgatctgccacgcgaggagcgcgacgtcgcgaaggcgcccgtcggggtgaccgaggaggcggaggtctgcgccgaggagcgctgctgcacgtgccgcttcgcgggcccgggtcgctgcgagctcggcgccgtcgatcgtcgtgtcccaggtgccgtggcgtccgtcgcttgcaacgaggatggtgatcgcacagccgtcgtcggcccagcgcgccagggtcgcgcccgccccgagttcgacgtcgtcggggtgggcgccgatggcgagcgcacgagccggggtggcaaggggggcctcgtggcgcaggtgcgcgccttggagggctgcggtgacgccggcggcttggcgagccggggtcggttgctcgttcgtcgtcatggcgatggtgccttcgcgcggtcgatcggcgggcacggtgcgtccggccagtggagggctgggtcgagcgcggtgagggtccgggcgaggtcgaggtcgtcgtccgtgtcgatgtcgagcaggaagcgcgtgccgaggagctgcacgcgtccgtagcgctcccgtagcgcgctcatgtgtcggcggagggaatcggggccaaaggcgaaggggaacgcggccgctggctcggggagccacagcgccacggtcccggtgagatgatggtcgggtgcgacggcaccgacgtcgccgaggtcggtggggagtgcgaagaacgggaggtcggccgggaccacgaggacgcgaccgtcgaggcccgccacggtctcgccgatggcagcgttcagctcgcgaccacgttggtgctcgatcgcgagcccgaggtctgcggccagctcctcgacgctcgggtcttcggcgaggacgaggacggaggccggctgcgaggcgctcgcgatgtgcgtgacgcacgcgcgaacgaaggctctgcgctcgtcgcggctgagtgtgtcggcgaggcgggacttcgcccgctcgagggagcgctggatgacgacgacgaccgatggctgcactggtggccgagtgtaggctcgctcggcgcatgctccaccagccatcgggtgatcggctcgtcgggatcgacgaggtgggtcgcggtgcctgggccggtcccgtggtcgtcggtgccgcgcgtggatcggtggcagccgccgccgccatcctcgcgcatccgcgcgggggggtgcgcgattcgaaggccctctcgcctgcggcgcgcgaggcggcactcggcgcgctcgaggcggcgggtctcgagctcacggtgggttcggcgagtgctcgcgagatcgacaagctcggactcacgggggccttgcgtcttgctgcgcaccgtgcgctcggtgcagcgagcgagctcgaggtcctgctggatgggcgtgttccctacgtcgaggccggtcgtgtgcactgtatcgtcggaggggatcgccgccacccgctcatcgccgcagcctcgatcgtcgcgaaggtgcggcgtgacgcgttcatggtggcgctggacgagctcgctgctggctacggattcgcccgtcacaagggctatggcaccgccgagcatcggcgtgcgctctcagagcacggagtgacaccgtggcatcggcgcagcttcgggccgatcggtgggatggttgagcacgggtgatcggcccctggcggagcacgccgagggcgcgcgccggggtgtcgctggtgtgcgacgcgctccgctgtggcgatatctgcgagtctgggggcgggaagggcccgtcgtaggcagtcctgtcgcgtggtgcgggtgaagcggtcgatgtgaccttcccgttggcgacgagcggcgagagctcgcagatcgtggccttggagcatgccgtcgtcatggcccggccacccgaggcgccctcccgggacgcagcgcttggcccttccctgcgtggggttgttcgtgcacctcgaccgaggaccggagctacgagcgtgcgaccgacgaatccgccgctcgatgtcggggtgcgtcgtgcccatgtcccacaaggttgtcccggagcacagccggactggtcgctgtcgtccgggcgctggtgaccaccttggcgagtgtgctcgtcgtgcgcgcctgggctgcgcgaagaccgagagcccacagcgcatcgagctcacggatggccagatggcgcacagcgcacggacgtgccgcgctcggcttgctcgtgcggaactgtggcgacgaggtcctgatgccgccggtcggctctgggcagtcggaagctagatctacggcgatgcagtcagcctcccgcccgaggagtgcgtctcgtggagggagctccctgcgctgcaaggctcgctccgcaagcccctctggccgagatcctcgcagaacggaggactcctgccatgggccagccagtccagtcgcgtgggtgaggtgcttgtcctggagcctcctaggctcgcggggcgatggagcgccgcagcctcgccgccctcggggtgttgtcagtgatctggggctgctcgttcctgttcatcaaggtcggtcttgccacgttctcgccggacctgatcgcgttcgtgcgaacgacactcggcgcctcggtcgtcctcgcaacggcgcgccttcgtgggtgggcgcttcctcgaggatggcggctctgggccaagctcgcggtcgcggcgctcgtctcgaacaccttgccgttcatcctctttggctacggcgaacagcacgtgagcgcggtgctcgcaggattcatcaacgcgacgacgccgatgttcacgttcccgctcgccgtcgcgctcaaactcgagcgcgtgtcggtcgggcgtatcgcgggtcttgccgtcgggatcgtcggcgtcggtgcggtcgtcgggatcgggaccggggcgatcagcggcgcgtcaggtgtcggggtgctcgcctgtcttgctgcggctgcgctctatgcggtcggcttcgtctacgtccgcatgacactgggactgaccggcgccaatcgcaccggcctcgctggaggccagctcgccatggccgcgctcgagaccggcgtcgtggttctcgtcatgcggcagggcatcgggaccgtgcatccgctcgcgctcgccgccgtggcgaccttgggtgtcgctggtaccggcatcgcctacatcgtcaacttcgcgctgattcatcgatctggggtcgtcggcgcctcgctcacgaccctcacgatgaccgtcgtgtcgacggtcgccggcgtggtcgtgctcggagaaccgcttcgctggtaccaaccgatcggcgcactcgccatcctcgtcggtgcgtggctcgtccagggcgcgcgtcccgtctcgaccaggctggtgccggcgaccgagtgaccaggggaggtccgacgggagctcgtcgtgtgggaggcgggcacgtctcgaacctgggctgcggtggacgggagcgtagcggtcgatgacgatcgggcgctgatcgagtggcggcgagtcttcggcaggggcggtgtctaggagtggtgctctacgtagcgagcgatacgcaggtgggtcgcctggcgccgacgaccatcggccagcgacctcggtgagtatccagggaccggttgtcggtcggcgatcgcggcgaggcgagttcccgtgtccatcgcgtgctgccaagcccgagcctgaccgagtgcggtgtaggcgagcgcgacgccagcggcgagagcaacgacgacgagaccggtccgtaggagcgacccgctgcggcgggccagcgcgccgcggaggtcgtggcccgagctgtgcaacgagcgcttggagtaggcaaaggtatggatgaagaggagcaccagccagatcccggcgagcaggaagtgcgcaggcgcgaggaaggtgtcggagaacgacgtcggcccggcgaacgtgagctcggcacctgagaggacgacgagcacggtgaccacgacgagcaggggagcgagcaaccggagcgggagccacggtgcactgcgtacgtgcgccggcgagctcgagcggtagaaggaggcgaagcgccacgtcgcgagcccgagcttcagtacgagcatcgggatcaggacgaccccgatgacgatgtgccagaagagcgcgatgcgcaggtcgagcgctgtgaggacctcgagcgcgctcaggacgagcaatgcaacgccgccgagcgcaactcccctcgcgaccgcgatcgctcggggcgactcgcgcgctcgttcctcgtcgagacggtcgaacgacgcgtgatcgaagaggtgttcgaagagcgagttctcctcgctgtagagcacacgacctcccaggcacgaacgtcccagcggcgcgatcgagcgacagagacgtccttggttcaagtatacggtctgggcaggtgtcgcgtcgggatcaaccctcggcgggcggtcgcaggtcgatcgtgaaggtcaagatgccgtcctcaagcttggccgtggcgtcggcaagtagcgagaagtcgaagtagtcgagttcggcctgctcgcggaagcgacggcgctccgggccctcgacgggtgggagcggccgctgtcgtacggcttcggcgcgttggcgaaagcgttcgacgatcgcggtcggatcgaagctcgcggcctcgtcgctcggcatgagacctcctcgtggtcggtgtcgacacggctctggaccacggcagcgaacctgcgggcatgccgggccgtggtggcgcgttagaccagtctacgaggggcgctgcgaatcggaaggcagcggccctcgtggcctgcagagtagactggcgtgggcgcctgccgaggcagggccactgcacggctcgcgggcgagcacggtgccagcggccgaagggccgcgcgaggagagagcgggagtggctcgtgaagaaggggcgtcatcgccggtacgaggaggcccgcaaggccaagcgtgggcttgcggcgccgctggttcgttgtgacgagtgcggaggcgatgcggttcacggccacgcatcgtggtgccgggcctatctcctcgaggaggagctgttcgctggccacgtcgatgacgacggtgagccagagccgtcggcgtggatcgagggggagcgcggggccgagtgagcgagccgcacgcggttccacccgagtcgtcggagatcgtctattcactgatcgaagacatcgacggcattgagatcgcggcgcgctatcggcgcggcgacgatcccctccttgtgtatctccacggatggggtcggtcgttggcggacttcgcgccgtacctcggccgaggtccatggtcggccgtggcactcgacctgcctgggttcggtcgttcgacgccaccgcttcgaccgatgggcgcgcggggctacgcggagttgctccgagagccgctcgccagcttgcggcgacgcctgcaggcctcacgcatgatcctcgtgggccactcgttcggcggacggatcgcggccgagttcgccggactcgcgaccgacgcggacgccctggcaggcgtggtgatcgtggcgagtccactgctgcgccctcagggtggtcggcctgcgctcggctatcgcgtggtgcgatcgctgcacgctgcccatctcgtgcccgccacggcgctcgagtgggcacgcgggcgttggggatcgaccgactaccgccaggcgaccggggtcatgcgcgacgtgctcgttcggacggtgaacgagcaacaccttggtgcgctcgagcgtgctcgggttcccgtcgagttggtgtggggtgcgctcgatacggcgtgtccggttccgctcgccgagcgcgtcgcggcgcgcgtcgcgggagcgaacctcgacatccgagcgggcgtgggtcacgacgtcccgcgcgacgctccggaggccgtgtggggcgcgatccatcgactcctcgggcggatcgagcctcccgtcggctgcgaggagcagctcagtgagtagcgtcgccggcactctcggaatcgtcatcgggctcgcctcctgggtgggggcgctccggtggctccgcgtcgcccaacgcgagcactacatcccgggtcgcatctggctcttcgtgcgactgtggttgcgtgagtccccggcgtccatcgtcattgcggtggtcgggttctttggggcggtgtctgcgtggagctcggcactgccgcggatccctcacctcatcgcaggagcggtcgcggcggccgcgagcatcgcggcgccgatcggcctcggtcttcgcgggcgcacgagcccgttggccctcacctggcgcctgcgtcgactggcgctcgtcgtcgtgatggtcgatctcgtcgtggtcggcgtcggtatcgcggttggcgagccgctcggtgcggccgtgagcgccggctggctctcgccgctcctcgtggatctcgcactgcgcatcaccgcgccgctcgagcgcaggctgatgggccgcttcgtcgacgaggcgacgtctcggctcaggcgtgttcgcccgcgcgtcgtcggtatcaccggatcgttcggcaagaccacgacgaagggctacgttgcggccctcgtcgaggggacgtatcgcacgctcgcgacgcccgcgtcgttcaacaaccgcgggggtctcgctcgcgccatcaatgagcatctcacatccgacgtcgaggtcttcgttgccgagatgggcatgttcggacccggcgagatcgccgagctcgtctcgtgggtcaggccggagatcagtgtcatcaccgccatcggcccggtccacctcgaacggctcggatccgaggcggccatcgtgcgagcgaagctcgaaatcgtcgagacggctcgggtggtggtgctcaacgtggactatccgcgcttggcgctggctgcgaacgcgctggagcaggagggcgcgaggcgggtcgttcgggtgtcggcgatctcgctcgaggcggacgtcgcggtcaagcccaacgacgagggcgaggtcgtcgtctacgcgcacggcgcgaagatcgccaaggcggcgctcgccgacgtcgtggccggcaacctcgcctgcgcggtcgccgtcgcgctcgagctgggggtggcgccggaggacatcgccgagcggctcggacgcatcaagccagcgcccaaccggctcgtcgccggcgtctcgccgacctcgggcgtcgaggtcctcgacgacacctacaacgcgaacccgatgggtgcgcgccgggcactcgatgcgctcggcgcgcgccgtgacggtggagggcggcgcgtggtagtgacgccgggcatgatcgagctcgggcgccgtcagtacctggagaacttcaagttcgccaaggccgcggctcaggttgcttcgcacatcatcgtcgtcggacgcaccaatcgacgagccctcgaggccggtgccgacgaggggcgggacgaacccggctcgacgctccaggagctacgatgggctcccgatcgggagcatgcggtcgcgctggtccgcgagatgctggagccgggcgacgtcgtcctgtacgagaacgaccttcccgaccactacccgtagagcgagcgcgggagcgctcacggctgacgagcagaaggaggcaacgtggccacgacgcgcgtcggcgtctgcttcggcggcccaagtcccgagcatgacatctccatcctcaccgggctgcaggcgctccgcgcgctggccgagagcggtgggtcaccggtcgcgatctactggtcgaaggaggggtcgttctaccgcgtcgagccctccctcgaggccgaggcctacgcgggcggggtcccggcgggggcgagaccgctcgagctcgtcgtcgggcgcgacggcggcttcgtcgagccgaggggcggcctgcgaccaaagcgcgagctgctcgagctcgacgtggtggtgaactgctgtcacggcggtccgggcgaggacggggcgctccagggggcgctcgatcttgcgggcgtgcgctacaccggccccagtgctcggaccgccgcactcgggatggacaaactcgcgttcgcgagcctgttgcgccaccacggcatcgcgtgcttgccgcgcgaggacgggcgccgcgtgaccttcgacggaccctacatcgccaagccgcgcttcggcggctcgtcgatcggtatcgaggtcctcgaggatcgggcccagctcgaggcacgcatgcagcgctcggagcatttccgcgacggcatggtcgtcgagccctatcgccccgacctcatggatgtacaggtagccctccggcgtttcccgaccccgaccctgtcggcgatcgagcgtccactgcgcagcgccccgggcgagcccatcctcacctatcgagagaagtaccagcccatcgggggcatggcgacggccccacgggagttgccggctgcgatcgctcccgagctcgccgagaccattcgctcccttgccctcagcgtgggcgaactcctcgattcgcggggagtcatgcgggtggattttctcgccagcaccgagggcgagtgctacgtcaacgaggtcaacaccatcccagggagcctgtcgcactacctgttcgtcgagccgaagatcccctttgcggcccagctcgaggccgacatccgcgaggcactcgagcgagcgacctatcggccgaacgtggccggggccgacggctcggtcctgcgctcggcggggtccatcgcggccaagctcgcctgaggaacacgacccctcgtcacgagtagggtgggccgctgtggcgaggggtcatccgacgaccggtctgcgggatcaacgcccgagcgtgcagcggcgcgtcgcggcgttgctcgtgtcgaacgagcgcctcgagcacgtcttccatccccactggtggcgactcatcgaggcgagcggcggtgggctcgtcgggctcgtcgtcgcggcgctcgtggctggcgtcggattcggaccatcgttgctcatcgcggccccggtcgcggtgggctcggtcctgtggatcgtgatcggggtagtgcgctggcggtccgaactcctgttgctcacggatcgccgggtcgtgttcacccgaggagtcttcgcccgccgcacgagcgagatcccactgaagcacgtgaacgacgtctccaccgagcaggggctcatcgggaggttgctcgacttcggcagggttcgtatcgtctcgggcaacgccaacggacaagaggtcgtgacctacctccacgggccggcgcgccttcgccaggagatttcgcgactgactcaagcgagcgagtcgacgccgactccaacggcgacatcgaccggggggagcctcgtcgagcagatccagatgctcgcgttcttgcatcgcatgggcgagatcagcgacgacgagttccagcgcgccaaggagcaggtgctctggggcgacggcgcgcgagagtccgaaggggacgtcgaaggaggaccgtgaccatactcgacccgatcgaggcgcgatggcgccgcaaccttgctgcgtgggccatcccacccgagatcgcgcgccacggcgacgcgtcgccgtggcggctcgatccggcgatgttcctgcccgatcccgacgcaccgctctcgccgtcgcatcgggcgacgcgtgcgttgctcgagcgcgccgatgaggggagcctgctcgacgtgggctccggggcgggagccgccttctggccggtcgtcgagtccgcgcggcgggtgatcgccctcgacgagcacgctggcatgatcgaggccctgctcgccgaggcgaggcgccacccgaccgtcctcgtcgagacccgggtgggacggctcgaggagctgttgccgaccatggagtccgtcgacgtcgtcacgtcacaccacgtcgcctacaacgtcgccgacctcggcctctaccttggcgagttggtgcggatcgctcacgtcgggatggtcctcgaactcaccttgcaccatccccactacggctcggccgccatgttcgaggcgctctggggcgttgcgcgcccgagcgagccgagcgcagccgacgtcatcgaggccttgtgggcgctgggcctcgagcctacggtcgaggtccactcgggcacacgacgccgagacgaccccgcggcgcgtcgtgaggcgctccggcgacgcctctgcctcggcgagcaggaggtcgcgcgcctcgacgagctgcttcgcgatccgggcgagctcgccaatccgtcggtgacgatcgtggtggacctcgatgagcgcaccgcttgagctctggtgggagcgcacggggcacggcgaacggggcgacgccgtcttgctccacggcctggccggttcgagcgacgacttcccggccgagctcgatgcaaggctcgggcgtctcgggttcgggacggtgcgcatcgatcttcgtgacagcggccggtctcctcggctcgacgccgacggtctgccgcgtgtgttcgagctgctcgccggtgatcgcgacgccgcgccgtaccggctcgtcgacatggcccgcgacgtggtgcaggtgctcgagcgagcgagcgtgtcacgcgcgttgctcgtcggcgtctccttgggtggcatggtggctcagcacgtcacggtgatcgcgccggagcgcgccgcgggtctgtgtctcgtctcgagcgcgagccagcccgacctcgcgagcctcgtcgatcccacggttctcgcacccctccttcgcgcgggtctcgcggccctcgatgccggtgacggcgactcgaggggcggtgccggcgctcttcgacagctcggcgcggtcgtcgccagcgacccgtggcgtgaggcgatcgcgcagtgcgcgccggcgacgctgatcgtccacggtgccgccgatccgctcatcggggttcgtgctgcctttgacacgtgggccgagctcgagcgggcacggctcgtcgtgatcgccgagcgcggacacgaatggacgacgtcggcgtgggaccttgtgtggccgcacctggctcgcttcggtcggagcgttcgatgagtgggccgctcgctggcgttcgggtcctcgagctcggggggatcggcccggtcccctttgccggcatggtgctcggcgacctcggcgcgacggtggtacggatcgagccaccgagcggggccggactcggtgccgatgcgttggcacgaggcaagcacgtcattcgcatcgatgccaaggaccccgagggcagggcgctcatccgtgagctcgcgagccgtgcggacgtcttcgtggaggggtttcggccaggggtggtcgagcggctcggcatcggtcctggcgagttgtgcgctgcgaacgaccgcttgatctacgttcgcacgacggggttcggccagagcgggccgctcgcggagcgggcggggcacgacatcacctacctcgccatcgggggcgccctcggagcgacgggatcggcggatgcgccgccgctgcctccgctcaatctgctggccgacttcgggagcgggggcatgctgagcgtcgtcggggcgctcgccggcctcatcgagcgcgagcgcagcggtcgggggcgtgtggtggatgcggcgatggtcgacggggtcctcctcaccgagaccatggtgctcgccatgatgagagagggtgcctggcggcccatgcgggaggcgaacctgctcgacggcggggcaccgttctaccggacctaccgctgcgccgatgggcgctggatcgccgtcggcgcgctcgagccgcagttctttcacaccctgctccgcgagctcggcctcatcgagcgcttcgacccggccgcccagtacgagcgcgctcgctggggcgagctcgcgtcgctgctcgcggatgcctttggctctgcaccacgagccgtgtgggaggagcgcttcgccggtctcgatgcctgcgtcgccccggtgctcggcctcgacgagctcgcgagtgctccccagcacgtcgagcgacgctcgttcgtcgaggtcgacggccatctcgagccggcgccggctccccgattcgatggcgaagcggtcgagagtcgtccggggccctcgcgcgacgcggtcgccgcgctcgtcgcagcagggctcgagccggagcgggcgcgcgctgtcgtggggctcggcctcgtggtgtgagatgttctacctcggctatcgcgacgagcggccggtgttcgcggccccgaccagccacgtgctcgtgctcggcccgcctcgctccggcaagaccacgcggttggtcgtgccgaacgcccgtgccttccctggtgaggtggtcgtcacctcgaccaaggccgacgtcatcgaaccactcgtcgtctcgggccggaccgtgttgctctgggaccccgagggcgacgccgtcgaggcggccggcttgcggcgcgtcgcgtggagcctcgtggacgcggccaagcgctacgaagacgcggtactcggtgtcgacgcctacgtcgaggcggcactcggtcgcgcgagcggtgccgagcgccattggcacgaccgcgcccgtgcgctgctcgcacccctcgtgcgggcagcggcgaccctgggtgggaccatcgacgacgtggtcgcctgggtggaggcgcgcgacgtctccgaggcgctcggcgaactcgacctccagggggagcgtcgggcgctgagcggacttgcgagcgtgctcgcctcggaggagcgcgagcgctcggccatcttctcgacggcccacgccgcactcgctgcgtaccgactcggagaggcgcccgcgcccgagcgtttcgaccccgaacgcttcgtcgggtccggtgccgccctcgtgctggtcgccccgagtgcgagtcagcggatcctcgccccgatcgtcgtcgcgctcctcgagcagctacgacgggtgtactacgcgcgcgctcgtcgcggggaaccagggcgactcgggctcgtgctcgacgagctcgccaacgtggcacccatcccgtcgctcggctccatcctgtccgaaggggtctcgcaggggatctggctgctcgctgcggtgcaagatctcgcgcaggttcgcgagcgctggccggccctcgagcgcggactgctcacgctgttcggtaccgtggcggtgctcggcggtgtcggcgacgcggggaccctcgcggtgctgagcacgctcctcggcagcgaggacgtgctcgaggtcgcggtccacgagggcgccaggggtcgctcgaggacggttcggcgaacgcggcaagcgagactcgaaccggccgcgctccgcagcttgccccgtgggtcggcgctgatcgtggagttggcgggatcgagcgggatggtcgcgttgcgaggtgacccgccgctctgaggggctactcggccgggggcggatcgaggacctccgggaagtcgcgctaccatgccttcgtgccgttcttgctgcggatcctcggtcgggtccgcgcgtctcaggcgcggctgctcgccacgctggccgtcgcgagcgtgctcgctggggcggtagcgttctcgctcgccgagcacgtctcgctggggatcggcctctactgggcgatcacgacggcgacgacggtgggctatggggacgtcacgccccacaacaccgcggggcgcatcatcgccgtcgcggtgatgctcacggcgatcccgctcgcgggcggcgtgttcgccgtcgtcgcggcccagatcaccgcgagtcgcctgggtaggctgctcaccgtgaccattgcggagtcggatacgggattcgtcgcgctcgtcggttcgcaccgagccctcggccgtatcgccgaagagctggttcgagcgggcgagcgggttcgcatcgtcgcctcccagccgatcgcgggtctcgggatccgcgccgagcagatccaggccgatccgaccgacgagggatcgctccggcgtgtccacctcgagcgagcatcgcgcatcatcgtcgcaggcagcgacgacgccgagtcgctgctcgtcgcggtcctcgtccgcgagctcgcgccgacggtgccggtgctcgtcgcggcggcatcggccaaggtccgcgaggcgctcggtgggctcggcgtccaagcgagcatcgcggtcgatgagctgctcgcccacacgctggccaaaggggccgagacgccgcacgccgggaacctgctgctcgagctcgtggcgagcgagcgcgtgcggctcgtcgaactcccggtgaccgatgcgctggtggggatgaccctcgacgacgcgggcgatcgactgggggggctcgtcatcggtcgcgtacgcggcgatcgggtcgagctcgccgtcgggatcggctccgagtcgcttgccgctggcgatcgcgtcgtggtggtgagcgagcgtcagccctccgctccgagcgaacctggcgcgtagaagcgctgccagttcgccgtcgagggcgcgacgagaccggtggggccttcaccgaagaggcgcaagatgttgcgcgtcatggtggtgaggatcggagcgggacagccgctcgtgtccgccccacacggagcgagcgctgggatccagttgttcgtgccgctctcgaagacccccgccttcgaggtggggctcgtcacgtaggtcgtgtcggcgtagtaatgcgccccggagaagccgatcacgaccggtgagtgggcgaggatctcgacgcccggtgggttcggccgcgcagggatgtagccgtcgaagtcggtgaagagcacgttgggcaccgtggcaccgttcgtgaggccggtgcccgcatacagccacgacgatgcgtccgtcacgacgagcgggaaatgctgggtgttgttgaaaccgatgtaggagtccccgacgatctcggaggccggtgcgtccgccggggcttgtccccaccagttctgggtgacacgggcgttgtcgacgccatagagcgggtcctcctgcgggtcgcgatagttgacgacctcgaggttgggtccgagcgggctcgcggcgaggcggaccttgcggaggatggggctcgccccgaagaacaccaggttgacccctcgtccctcggcctggagcaccgcctcgcgcatgcgcagcgaccactcctcgtcgtggccgagcgagaggagaacgcgatggttggtgagcagggctccgtgggtggccagggtgatgtcggtccagtaggtcacgtcgaggccgtggcgctccatgagctcgatgagggggagttcgttggtgatgaaggtcgccgcgccgttgccgtagccgtagggccggtcgaacgagactacgcgtgagcgatcaggaggggggtagcccggcgcggtcgacgcgccctgctggtagaggtcgtagccaccgaaggggttgaagacctgccaggtgaagaccgcgttcatgaccacgtaggcggccttcgacgatggatcccagaccgtgagggggacgtagctcgcagctccgttggaggcgaccagcttgaggaggtagtcgccctgcacgaaggcgggggtgatcgcgaactgggtcgctcgttgccaggagcactgcaccatgtagaggggcgcactcacgggacaggcgggctcgacgtggccggcgaggaccccagagtgccacaccaggcgagcgccggtcccgtggtaccagcccatccggaacgcctcgacggtgaacgtgggcgcgttcgtcgacacgtacaggtcgaccatttggccgagacgggcttggggacggttggagtagccctcgatgaaggtgttggcgggttggaggccgatccgccacgccgtggtaccgggcttgtcgttctcctggatcacccagcgagcctcgacgccccaggggccgaggaaggtggccggctgcgcatgtcgtcggcgatgtggcgtggtcggcgtggtgtggggggccgtccgtggatgggcaacgagcgcgatcgcgccaccgacgagcgccgcgatgaccacgacgatcgtcgcgatgacgaacggattgcgccctgctgatcgcgggcgtcgatccgagcggctgtgcatcccaggcatgcaacctccccggggctcccctggggggccaaggctagccgagccaacctgtggggccctcggcgcctcaggtggcgggtatggccatgagtcgcttgaggacctcgggcccgagaccggtgacgatgatcgaggggtcgtcctcgacgtcgccgcgctcgagccggtagtgcacgaggaggcgttcgcgcccctcgacgagggcgatgctggtgccgacctcccgatagccgaccttctcgctcacgcgacggctcgcgaggttgtcggcgtgggcggtggtctcggcccgagcggcgccgaggtggcgaaaggcgagcgtgagcaccgcgcggcgcatccaggtgccgatgccgcgtccctgcgcagctgcggtgagccatgagcccgtcgagacggtggcaaggctcggccaccctcgggcgaggacgaggtcctggacgccgatcggcccctcggtcgggtggaaaacgacgaagggcagcgttgcgatcggcgtcgcctcgttcgcaccgacggtccggagccagtggcgaacgacacggctcgccacttcgtcagcgctgccccgggtccacgcggtcgagaagggcatggcgtcaggtgcgtggatgccctcaccggctcgctcggcgaggcgggcgagttcgtccatggtgggggatgcgagtgtgacgacgggggtgcggatcgccacgccgagctccggcgcgaagtgcaccaggggatggttcggatcgatgggcacgtcgccagcctagggtacggctaggttgaggctcgggaggaggcgacatgctcatcggagtcactgccggcctgatcggtgaggcaaagccgcgctacgtcggtctgcacgacggctatctccgtggcctcgcgcgagcaggcgcggccgcggtcgtgtggccgagcacgctcggggtcggcgatccggccgacgtggcggcacgggccaaggagctcgtccagagcgtcgcagggatcgtgctcaccggtggcggcgacgtcgggcccgagcgctatggcgagtctgcgcgcaccgagcggctctacggcgtcgagccggcgcgtgacgagctcgagatcgcgttggtccacgcggcgctcgatgcgggtgtcgcgctgctcgcggtgtgtcggggagtgcagatcctgaacgtggccctcggcggcacgctggtccaggacctcgaggaggcgggctatcgtcgccacagcgtgcccgagcacgagtacgacgtcgcccacgacgtgctcgtcgagccagacagcgtgctcgcgagcctggtcggaacgcactacggcgtcaactcgctccaccaccaagcggtggagcgtccggccgaaggggcccgcgtcgtcgctcgctccgaggacggggtcatcgaggcgctcgagggacgggggttcctcgcggtccagtggcatccggagcgcatgctcgacagcgatgagcgggctcaaggcttgttcgagtggctggtcgctcacgggagccggtcatgagtctgcgagccgtgatcttcgacgtcgacggtacgctcgccgagaccgaacgcgacgggcatcgagtcgcctacaaccaggcgttcgcgcagttcggtctcgacattcactggagcgtcgaggagtacgggcggtggctccaggtcgctggcggcaaggagcgggtcgaggcctacctcgccgagcatcccgacgccgctcccaacggggtcgatctcgatgcgctccacgaggccaagaacgccgcctacgccgcgatcgtcgccgctggcggcatctcgttgcggcctggagtgcgtcgactgctcgacgagctcgcgagcgcgaaggtcgccgtggcggcggcgtcgacgacgacgttccccagcctcgacgcgctgttacgagccgagctcgggccggactggcaggatcgtttcgccgcgctcgccctcggcgacgtggtggtgcgcaagaagcccgatccggggatctaccactgggcgctcggtgcgctcgggtcaagctacgacacggtcgtcgcgatcgaggacaaccgtaacggtttgctcgccgccaagggtgcgggccttgcggtggtggtgacccgatctctctatgcgaaggacgaggatctgcacgaggcggacgtgctcgccagctcgctcggagagccagcgtcccccgcaacgatcgttgtcgacggcgccccgcacgagggtgtcgtggacctcgcactgctggagcgactcgtcgagcgtgggtaggtgcgcagcgcgcgagcagcgcgcgtggctgctcgggtcgtgaggggccggctgcggatcgctggatgcctgggtgtctcacccaggcggtgtgcgtgccgactgcaagggtggcacgggctcgtgggccttgtcatgctggctgttctcgtggtcgggtggatgctccggcctcggcgcgtcgtggtcgacggcctctccatgcgcccggccctcgaacctggcgatcgtctcgtcgtggggcccgggcgcgctcgggtggggaggatcgtcgtcgtcgacttaggcggtggacggcccctcgccgtcaagcgcgttgcggctcgagtacgaggtgccgtgtgggtggtcggggacgatctcgctcactcgaccgattcgcggagcctcggatggatcgcacgaggacgcatccacggcgtggtctggtggcgctacgggccgagcgatcggcggggccgggtcgcgcctgcgccatccagcgactccacagctgggctaccaaccatccccagcacgattacctaaggtgaagatcaccaaccccccacacccatccaacgaggcccgcagctgcgggcctcgttggcgttgcgggccagcgtggatgcccgactcctacgcactccacaggttccgtgcctgccatccccagagcacgggcctaggttgaccattacaacccccccacacccacccgaggaggcccgcagctgcgggcctcctcggcgtctggcgacgatgtctcctggcgacgatgctgcgtgcgggtgtgactgttgtgaccagatcggactcttgacggctcgggcgagtagctgactcgcaggtggcgtccgagcggagagagcccctcgatcaccccgatcgtcgcctctcgaggaggttgtggacgagagcgccggcgagtccggcgccggcgaaggcgcccgcggctccgatgacgagcaggagtggcccggcgccggctccgagcccagcgatggcggcgctgacgcgagctgcgccaaggaccggtccgttggtggcgacgacggcgaggtccacgagccagccgatgagccccgcaagaccggcgagccacccgcccaccacgaggccgagggcagccccgacgacgatcgagagccaccacgcgccgacgaggttgccgagggcacagatgacgatgcccgcagcgaagatgacgatgcccgcagcgaaggggagggggcgacgcgtcatcgcaggcccaccaaggtccaggtcgcgatgggatgggtcaggctcgcggtggtgaagctgaggtagcgaccgttccaccacagcgggatcaggttctcgtaccacgcagacagggggttctcgctctcgccaccagggaggatgccgagcgacgctcgtccgaaggcgacgatcatcctccagctcggtccttgctccgacaagagcccgccgtcggcggcgttgacggtccaggcgtcgccggacgatccgcgtggcccgtaggcgagcgaggccacgcccgtcagcgaggggaactcgcggcggtggatgcgacgccactgccaatggccgacgctcccgaggtggctggtgagccaggtcgcggtctgggcgagggcggccgtggcgatcgcagagggtgaggggtgaggatcgccgggcgtcgcgatcgcggtgggtgtcatggtcccggtgtcgatcgcctggaggtcctcgagcagtggatcgttgagctggttgatgacaaggatgctgcccgtgggttggtcgagccgagcgctgcgccagagcggaccgaacaggtcacggatgtcatagccgagccaggtccaccagacgctcgccgcttgcgacgaggctcccatctggtcgttccaggaggcgaggaggtggagcgccgcggctgcactcgtgccaggcgcggcgtgggcgtggtgcacgatccacggtacgagctgggtggcgaggtagtccgtgaccgaggtttgcaggtgctcgaccgcacgcacaccgagatgcggggtagtcgagagtacatgggcgatctcgtcggctcgaaagccgttcgcgtagaagtcggcactcgtgccgaggtagtaggggtagccaggacccacggggcgctggttcgccgagaagacgaagcctcgtgccgggttgttggactccgggacggcatcgaaggggatggcaccgatgggctgttcggtgccgttgccgttcatcacgagccaggggatggcgcgacggaactggaggtattccccggctgcgatgatgccgatctgcccttgggcatcggcgaaggcgaagttctgcgcgggtgccttccatccgcgaagtgcctgttcgaactcgccgagcgtctgcgccttgatggccttgaggagggccgggaagtccagcgagacctggtcgccgagccagtccaccgcgacgggggtgccgcggagcgagatcactgggccatcgacggtgaccggcaccgtgatggtcaccggctggcctccgtggatggcgatggtgtagtgccggtaggtgtaggggcgccacgtgccgtcgaagcgataggcgccggggtgtgagggggaggtggtcatgcggtagaagtacgtcgcctgtgtctcggcgtcggtgaggctccacgcggtcgtcggggtgcgcccgatcaggacgatgggcaggcctggcgccgcgacccctgcgaagtggtagccaggtgcattggcactcagccagagccagatcgacgggagtgtctggggcaggtgcgggtcgccagcgaggatcggcgcgccggtcgtggtgtgcgtggctgcgatggcccagttgttcgagtcaccggcttggtggcgggcccacgcgggcacgccgctccaggcccgctcgatgctgccaagggccgatgtgagttggtgtgagacggggaccggcgggtcgagcggcgtgatgccgcttgccggatagggcccggtgtcgaaggggctctggggatcggcggcgagcgtggggaacaatgccttcacgcgagcgagcccgaggcgcgcgaccgcacgcgtgaggtcgacgggctgctgggtgtagtcgagctcttcggcgaggaactcttggacgagcatgctgtcgacgggctgccagggcgctggcgtcgtaccgaggaggaggtagggcgtcgacagggcatgatgggcgatctcccagctgcgtgcggcgttcacgccggccgtgaactcgtcgaggatcgcgcgatcggcgggaggcagcgccgcgaggttcgcctcggccgcggctcgcaccccgaggcgtagctggaactcgtccgatgcaaggtaggtgtgtccgagcagcgctgcgagcgtgccgcccgcctctcgtcgcagcaggtccatctcgaacaggcgtgtacgaccctcggcataccccatcgcgtaccagaggctcgcatcgctcgtggcactgaccccgatgaaacccgtcgacgtaaagccgatccgcgcggtgcccgggaccgccatctggaacgaggccgacgtgggcatccctgcccgtgtggcgagggcgagtacccctgtcgagggatcgagcacgctgccgagcgcgggaacgcccgcgaccccaaccgcctcgatgccgacgaccccagcgagcacgaccgctgccgcaacgacgcgtccgatccgcacgtgacctccccccgcgtgcgacagtagcagtcgaacgccaagggggctcgtcagctcacgagctcggtagcaggggtcccgacgccgcgttcgggtgtgcgcattcttgctggagggctcggacgaggtggtcctcgctcacccgtcccacctcgccgagggtcgcagcgagcggctgataaccgctgttcgcgccggccgcgatgttggcgaggggttcggcacgttcgaggagcacctcggcttgcgaggcgagcgcgctgcgcgtcgcacccgaggccgtgttcgcccgttgccagagggcgatggaggagcgcacgagtcggcacgccgctgtcgcgttcgatccggcgctcgcgccgcaggccgcaaggagcgctccaccggcgaccgcgaccgccgctaggcgcagtgccttggtgggtcccacgagcccagcctaccgagacctgctggcggtgctgggccccgggtaggctcggacccatggcgaccctgttcggtccttcatcggcggtgtgggtgctccatggtgatgctgccggcctgatcgggggtttgcgcgcactcgcggtccaagcgctcgagcctcgagcactcgcgggcgtcgatcagttctcgaggttccagaacgatcccgatcgccgactggccgagaccgtcgacttcgtcgacgtcatcacctacggcacgctcgaggaggtcgacgccgccatcgagagggtccgacggctccatgagggggtgcgcggcgtcgaccctgtctcggggatgcccttcgacgcgaacgaccccgagcttctcgccttcgtgcacgattcgctcgtcgcctcggtcagcgtggcgtatcgaaccttgcaccctggcgctccgacgtcactgctggatacctacaccaccgagatgcggcgcttcgccgagcgcatgggcgcggacctcggtctcgtgccagccgacttcgcggggtgcgtccgtctcgtcgagtcgtggccgaccctgaccgtgtcgcccgccttccgccgcgcgttcgaggtcctcgaggcgctgcacgtcgaggggcccgtgcagatggtgtggccagccgtgatgcactgggttcgccactcgctgcccacgtgggtgcgggtcgcgctcgaggtggaggaggatccggtcggtgatgcggtcgcgtgggtcctgctcgagctcgccacgcggatcgggcgggtgatcgtgccgccgtcgcctcggcgtctcgcggcgctcggggtcgcctaggtggacgacgccctcttcgcgacggacttcgacggcacgctcctcgactcgaccggcgagccggtccgacggagcgcggacgccttcgccgcggcccgacgcgggggcctcgccgtcgtcccggtcacggcgcgagggccgcggtcgtcgctcgcgatcgcgcggacgttgcacctcgggcctgtgtgcgtctgttcgaacggcgtgctggggctcgacgtgcgcacgggtgacgtcatctggcgccacggtctcccgccgggcagcgtcgccgagatcatctctgcggtggcgagggagatccccgaggctcggttcgccgtcgagacgcgggagcagttcctcgtggaaccggcgttcttcgagccgcagtggcgacggttcgcggtcgcgacggtcgtcgctcggcggggcctcgccgccgccgaggtcctcaaggtcgtcgtgcgcgcgccccaccggcgtggggacgagctgcagggtcaactgcgtggcgtccttggaggcctgtcgctgatcccgggctccagcgactggctcgacatcatcgcccatggggtgtcgaagggctcaggcatcggtctcggtgccgaggtcctcggcgtcgacctcgagcgggtgggtgctgtcggcgaccatctcaacgacgtcgcgatgttccatacggtgggccgcgcttacgcggtcgccgacggtcatccgcgcgccttggaagcggcggatgagatcgtgtccgcctgtggtgacggtggggccggcgaggcgctcaggcgcttcgttgacaccattgacctgccaatgtctcagcgccttccaaggcgcgaacggtagcgtgacgccgaacaggagggtgttcgggtgctgtcgcgcatgatcgatacgatgctcgccgatcgctcaccggctgaggagtacggcgcatcgcggcgagtgcgggccgtggcgcgcatcatgtcgctgctcggggtcgtcctcttcgtcggcctcgccatcgagggtgtcaccattctcttcatcggtcagctgatctccatccacatcctgatcggcatggtgctcatcccggtgatgggctacaagatcatcgtcgccacgtatcgttttgcgatgtactacctgggtgtgagcgatttcaagcgcgccggacctcccgagccgctgcttcgtgccatcgggccgttcgtggtgctctcgacgatcgtgctgatggggtcgggtgtggtgctcgcgctgctgcctcctcagtcggtcgaggtcgcgacgtggcgagcactacatcaagagtccttcatcgtgtggtttgcgttgatgaccatccacgtgctcgcctatgcgcgacgagccttcgggaccgcgaaggacgacgtaacggagcggcgctatcggtcgctcgtgggtcggcgagggcggctcgtgagcgtcgtcatcgcgctcgcgctcggcgtcgtgcttgccgtcgtgatgatccctgcgatcggcccgtggtcgcactacctcgcatcgttgggcgttcgctgagcggcgcctagcgtggagacgtgccagaagccgctggtggtgtcgaccaactcctgacgctcgcgagggaaaccgccgaggcctgtctcgcaagtgtcgaggcgacctcgaccgactggtcgtccacgggggatcgtcggggacagcatcgcggtgacgtcgttgcggaccaggcagcgctcgaactgctcgatcgcccctggctcaacgtcgtttcggaggagtcgggggtgctcgatcgaggagccgcgctgacggcgatcgtcgatcccatcgatggctcgaccaacgcgtcgcggggtctcttcccgtgggcgagttcggttgcgatcgcggacgacaagggccctctggtgggggtcgtgagcctgtgccgaggcggcgggacctactgggccgtgcgcggggcgggagctcgcagggatcggcggccggtcagctcgagtgccgcatcgagcgtgcgcggcaagctcgtcgcctgcaacgggacgccacgggcgtggctcgggtggggacagttgcgcgcgtttggctcggcagcctctgagctggccttcgtcgcagaaggcagtatcgacgctctggtggacttctcggaagggcttgcgatctgggacatcgcagctggcgtcctcatcgcgcgtgaggccggcgcggctgtcgtgagggcgaacggtaacgaggtggacctcagcccgacggcgccgcgacagcgaatcgtcgctggagcgtcgacttcgctcgcgaccgagcttgtcgccgcccttgctggggtcggcttggagcggcgatgacgctggcatgggtcgatcgggacgacgatctcgccctcgcgctcgacgcgatccgtcgttatcaggccgaacttggcgaggacctgtgcttccaagcacctgacgacacgatcgaagctctgcgtgggcattacggtcctcctggcggtgtggcgctgtggttcgacgggggacgggcggtcggcgtggtgtgcgtgcgcaagctcgacgagcatcgagccgagctgaagcggctgtgggtcgtgcccgagtatcggggtcgcggttggggccgagcgctcgtggaggcggcgctcgagcgcgcgcgggcagctggctttcgcgagatcgtcctcgattcgctcgatcgtttgcagcctgcactcgagctctatcgaagccttggattcgtctcggtcgagccgtacacgaccaatccgcttcccggagccgtcttcctcggccgtacgcttttcgagcgctagggtgaccaagccgagctcgtgcgaagacgttgcggctggctctctcctcgcaaccaggtcaacaggccgagatgttgggcggatccgaccggtgccgcgtggcggacaagggaccgacttcttgggcgaagcgtggagcgctccgcgcgcgaatcgagcgatgcgtcgtcgatcggcgtgagctcaggtcgcttcgtgagcgcagctggctctcggaggacgtcgaggaggaccgtcggagcgaggctgaggtggctgatgaggatgtcatccgcacgcgcgagctctgcttcgaggaccgtcagtgttcgtcgtgcgaggcgtgcgcagggcgccgttcgcgccaccggaactgatgccgtgtctccagctgggcttggcaggagggttcacgtgactggcgccccaatggggagctggcgatggacgctcattgtcggagcgtgtcgcgcactcggtcgaggcgatgcgcggcggtggagactggcggcacgacggacgcacctgccaacgattcctcgagtgcatccggggagcgtggcaccgacggtgtgccaatacgaatccatcatgaactgagcccttccatgtccacgatgttcgtgctcgcgagcggcgagtgcttacgacgaaggttcttcgagtagttgttgtacgtctcggctctgccattcgccgtaggtgatgcccagtccctcaactttccagctggtgcgtccattgtcagcgcggcccgctaccatcgatgatgctgccgaaggggaggaaaacacgcagttacgggtgaaggtacgagtcgtgccgtcggggctcagcgccagtgttccatcgtccacgagcctctggtgcagcggcttgtaggagctatcgtctgcgccttgccaatccttccgcgcggtcgagccagccaggaccgtgaactcgccgtcgatctcctgcgcggtcgcactgatacccgcgcgcttcagggtgtagtgcaacaatggcgatgccgggtagggcgcttcgatcgtcgcctgaccggcatgatcggctgccgccatgaccgaacggctcgcagttgatcggaggaggttgactccgaggaccggcagcacgatcatggcttgggctatgaagtactccatgtccgagacatcggcttcgggtagttggggcggtggcggcgcggtggcattgtccaaagctgctcgatgtgcctgttgagcgagcgtgatcagtcgtgactcgaggtagcgggcgtgagccttcgtgaggtttgtgtccttgctcgtcaggacgatgactcggtcccagaagtccttgccgccttggctctcggggcgagcatgttgggcgagccgcttgctgacgtcgtcgccctcgccgatgtaggcgacggtgcctccgagacgcttgggatcgtcccccagcaagatgtagatgccggttcgccccgtctcgggtcggcgaagaaggttcgccaggtccgagcggggtgcagcgacgacgtgccccgtccagttcatgatctcggcggtgagtaaccctcctggcgtcccgtcggccaagaagatgcgaatcgacttcccggcggtcacgtgagggcctcgtgtgctggttgtcgagtacgtcgtgcaagcagtgtctgggcgaacacgaccggtagcgtagcattcctcgcgctctgtgaggaggtggcgtgatcggctgagatggtgagcaatgacgccgtgtcggtgcgtgcgatacggccgctcgtggttcactgtggcatggccggcgaccggtgcggtgcgtgcggtgggtatcgcgcgtgcgcagcgtcgcagtgcatgaggggcccgacgacgacatcgcggcgtcgcccaggagtcagaagttctccgcgctcagcctcatcagcgctcgacgggaccagcgagcagtagcgtgaggaggtcgggtctcacgttgagggtgggctcggtttctttgtccggccagagcctgtcgagcaaacgaggcaagcccgtagggctgagatccgcgagaaggagctcaggtggacgaatcaatctttgtcattggatcagacggtaggctcacttcaatccagaagaatacctatgaacgtgaggctgaactccagcagcttatcaaggatcatccggaactcatacctgcgatgggtggtagcggagaaggcgaacccatccgctggctactggtgcgacgggaagcggggataccgcgagaggatggcggctcagattggtgggccatcgaccacatcctcgttgatcaattcgcaatcccaaccttcgtcgaggtgaagcgagcaagcgacacgagggttcgtcgtgaggttgtagctcagatgctcgactacgttgccaatgctaccgtttattggcagcccggcaccctcgaggggtggttcaatgctcagcatgacgatcccgagcagcggctcttggatttcttggacggatcggaactcagctccggcaagttctggtcgagagtcgacgacaacctccggtctggtcgagtaaggtgtgtcttcgtcgccgattctgttccagactcactgattcgtctcgtcgagttcttgaacgaacacctgcgacgtaccgaggtgtacgccgtcgagttgcctcagtatgtaagcaccgaccaactccctggagtgagggtcattgtcccaagggtgatcggcgataccgtccgtgcgagtgcgaacaagcgggagggacaatcggttccgaagcggcagtgggatgaggagagtttccttgccgccctccgagagcgtagcgatgcggccagcgtgacactctctcgtgagatcctcgaatgggcacgcgcccatggtgtccgagtgatctacggtaatggcaaggttgatgcttcaatgatgctcgtcgtcggacccaagccgaacgggtatgtctttgcgacggtctggagttatggctcgatcgagatcgatctccagtacatgaggcgttcgccagcgtttcgggaagacgagagtcgacgagaggtgatccgcagactgaatcacattccaggtgtcgcgatcgacgagttccgttactcccggcgtccgaatgttccgctaactgtgttcgctggggatccggcgcgaaacgagctcttcgatatcctctcttggatcgtggagcagctgagatctcctcttctgtagagacgcgccgtcgcgagctgtcaggtagtgaggcgagccacccttgtgtggtggtttgatggcaagtgttctgcagggcgggtcacgtcgggtccgttgcttgcggatcaaggcaagccggctgcctcgataggacggcggatggctcggactttcgctctggcgggcgctgccgtcggagatcccagaacgggccgacataggagcgaacccgtacgcaggtcgacgtggtgagggtccgaggaagaggacagagctctgtggtgggcgctaagggactcgaacccctgacctgctggttgtaagccagctgctctgaccacctgagctaagcgcccgagagacgtcagcgtagcgggcgttcgggttcggaggcggagtgccgggggcggtgtcccacccgagtgagcgccgtggcgatcacgctcgcgacgacgagggcgacgccgatgcccatcgatagcgaagccactgcgagtccgagcgccaccgagaccaccgccgcaaccaccggctccaaggtcccgatgatgttcgcctggagcgcgacgacgcggtcgagcgcggtgagatacagggcgaagggcagtgcggtcccagcgatcgcgacgaatgcgacctctgcccagccggtcccatcgagcgagcgaggccacgccatgatcaggaccggggccatggggatcgcgccgagcacgaacgcccgtgtcacgacgcgcggggccggctcggctctatacaggggcgctggcgcgaggttgtagagcgcggtgaccactgcggaagcaagcccccatgcgatggcggtgagaccgacgtgctcacccgggctgatgccgacgaccaagccgaccccgccgacggcggcgatcacgatcacgacctcgatcaggctgggtcgttgccaggcgcggagggttccccagagcaggatcaacacggggctcgtgaactgcagcagcgtcgcggtcacggccgagccggtcgcgaccgcgaggaagtaggtcgcttggacgccgagcaggccgaccagcgcgaacacgaggagccgacctcggagcgctcgggggccgaggctgaagctgtgccggatcgggtcgtgacggagggcctgccaggcgaccagcaacgctgccgagacgatgatcctgctcgcgaccagccacagcgcggtgacgtcggtcgtgtcgaacaggcgctgcgcgacgacaccggagatcccccacagcgtcgcggcagcgaccacgctggccagcgctcgacggtcttcggtcgtcacgaccccaaggctaggtcgtgggtatggacgcttgcctcgcgtgccgtacgatagggcgagccggacgaggaggaaggatgccccaaccgagcgcgtcgttctcggtgacggtgcgagtcgagctcgacgatcctcgagggatcgccgaggtgacccgcgttctcaccgagcgtggtgcggtgatcactgcgctcgacacgatcgagtcgcgcgcgggccacctcgtggtcgacgtgacctgcaacgcggtcgacgaggtccatgccgacgaactccacaaggcgctcgatgccctcgagggtacgagggtgcgcgcgatgagcgatcgcaccctcctgctccacctcggtggcgtcctccaagtggcctcgaaagtcccgcttcgcacgcgtgacgacctgtcgatggcctacaccccgggcgtggctcgagtctcggaggcgattcgcaacgatcctgctgccgcgcgcaacctcaccattcggcgtaacgccgtcgcggtcgtcacggacggatcggcggtcctcgggctcggcaacattggtccggcggctgcgttgccggtgatggaaggcaaggcgatcctgttcaagcgcttcgccgacgtcgacgcttggccgctctgtctcgcgacacaggatccggacgagatcgtgcgggccgtcgagatcatcgccccggtcttcggcggcatcaacctcgaggacatcgccgctccgcgatgcttcgagatcgagcgccggcttcgcgagcggctcgatatcccagtgttccacgacgaccagcacggtacggcgatcgtggtgctcgcggcactgctgaacgcgttgcgcgtcgtgggcaagcggctcgaggacgtgcggatcgtcatcgtcggactcggtgcggcgggggtggcgatcgcccgactgctgctggccgagggcgtgcgcgatctcatcgccgtcgacgtcgacggcatcgtgactccagacgatcccggcctcgatccggctcgacgtgagatcgccgaggcctcgaatcctcgcaacatccgtggtgacctccctgaggcgatggagggtgccgacgccgtgatcggagtctcacgacgcggcgtgctgaaggcggagcacctcgagcgcatggcgccgcgttcggtcgtgttcgccctcgccaaccctgaaccagaggtggatccagagatcgcgcgccgcttcgccgaggtcgtcgcgaccggtcggagcgacgagccgaaccagatcaacaatgtgctcgtgttccctggcttcttccgcggcctcctcgacgcgaacgcgcgcgagatcacgctcgccatggagcgagccgccgcgcacgcgctggcggccatcgtggcgcccgacgagctctcaccggcctacatcgtcccaacggtgttcaacccgagggtggcccccgccatcgcgaaggcggtggccggggcgatcacggacagctaaagcgttcgacgcccttcgatgccgcgaaggcgagccgtggcgtgccgttcgtgagtcgaaagcccagcgacaccatctcgctgggcggattgtcggaggcctggaggttcggatcagtgaggccgacgaccgtgaagccctggttcggggacgtaaaggtcgggttggagctctcgcatccgaccgtcgcgatgaccgggcctgcgatggtgtacggcgtactcgtggtcgtcccgggcggactcgggatcgcctcggcgtggcggaggccgctcagcaccgtctcgaagtagaagatggtgttcggcggatccttgacgagcggtgatggcggcaccgaggcgaggatcgcgacgagctggggcccggccgtacctggtttgaaggcgtacacgccgttcgggacgttgccgaccatgttggcacacgacgccgaaacgatggcgagtggtgtcgtgccggtcacgtagccgacgaccgttccctgctgcgtgggcgggccgctcaatgggtggcagtgcggggccaaccccgggtaggtgagcttcgaccacgctacgtctgcgaacgcagcctcggccgctcggtcggacggtgtgaggacgaccggggcctcgcgaggggcgcgaggggtgggacgtgcgctgatgccgacgctcgactggccacaggccgcgagcgccacactcgtgcctaggaggctgatcaccgctcggctcctgcgtcgattcatggtgcatgtcagcgtagtcaacgggtgctgagcgagcgcgaggctcccgggtgcgcgacccgaccatgggcctggctcggctaccgggcgaattggaggggagtgcctgcgacaggtgccgatcggcggtagcctgggcccagatggttgtgcctgcaccagagacacgagcgagaggctggagtccgagcgagccgcggtggcggatcgacgagttcctcgccgagaacgtgcagcttcgacccgcgacgaggcgacgctaccgcgtcgtcctttccaacatccaggctcgagcggcgtcgctcggggcggcatcgccggctcagctggacgctcacgtgttgcggcggctccttgccgctcctgggtcgaacgggccgtacgcgccggcgactcgcgatctcgagcgggtcgtgctgcggcgctacctcgtttgggagggaagtgaaggggcactcgctctcgcggcgcagctcgctgcgtttgccaggcggcgcccacggcccttgccgcgcggcatcgacgagacgacgctcggatcgaccctcgacggtctcgatgctcgggcggatgcgcgtgcgatggcgatcctcgagctggcctatgcgacggggttgcgggcgagcgaactgtgtgcgctcgatcggagcgacctcggtccgggcgaccggtggctggtcgtgcgggccggcaagggaggtcggacccgccgggttccgatcggcgaggctgcccggacggcgctccgggcctacctcgccacgcgcgacgacgatgccccggcactgttgctcggagcccgcggggctcgactctcgccgcgggggctacagcggttgacccggcgctatctcgatgtccacccgcaccagctgcgccatgccttcgccacgcacctgctcgatcacggcgccgatgtgcgatcgatccaggagctgctggggcatgcgcgactggcgactacggagatctacacccacgtgtcgcgcgagacgctgacgcgcgtctacgatgcgacgcaccctcgagcagggcgaggagaggcatgagcgacgacgaggtgatcgagtcggcgtggcgccgcttcaagcacgacggtgacctcgaggcgcgcaatcgcctgctcgagcactacgcgtccctcgttcgcttcgtcgcctcgcgcgtcgcggtcgggttaccggcgagcgtcgaccccaacgacctcgccagctacggcaccttcgggctgatcgacgcgctcgagaagttcgagccggagcggggcatcaagttcgagacctatgccatcacacggatcaagggcgccatcatcgacgagcttcgcgcgatcgactgggtgccgcggtcggtgcgggccaaggcgaagtcggtcgagcaggcctacgccgcgctcgaggcacggctgcatcggccccccaccgatgccgaggtcgccagcgagctcggcatgagcgaggacgaactgctggcgatctactccaagatctcgttcctcggactcgtcggtctcgacgaggtggtgatgtcgggcgagcgcggtgagggtatgacgctcggggacacgcttgccgatcgtcgtcaatcggccggtggcgcattcgaggagcaggagcgccgtcgcatgctcgccgattccatcaatcagctggccgatcgcgagaagaccgtcctcgtgctctactactacgaaggtttcaccctggcggagatcggccggatcctcggcgtgaccgagagtcggatctgtcagatccactccaaggccgttctggctctgcgaggcaagctcggcgacctgatcggctagggagccttgccgaggcgcctaagctgtggggccgcacgttcgtcgtcgatactcgggcactcgaacccacggtcggccacctgagccgcatggagtgcccgctgatccaaccgttgggaggttgaaccgtggctgagcgcccgttggtaacgatgtcgcagctgctcgaggccggtgtccacttcggtcaccaaactcgtcgctggaacccgaagatgcgtgagcacatctacgagcggcgtgggggcatccacctcatcgacctacgtcacaccctggagggcatcgatcgctcgttccgcttcgttcgcgatctcagtgctcgtggcggcaccatcttgttcgtcggtacgaagaagcaagcccaagacgccgtgagtcagtacgcgcgccttgctggggttccctacgtgagccaccgctggctcggcgggatgctgacgaacttcggcacgatctcgcggcgcgtcgcgaagatggcagagtacgagcgcatgcgtgaccagggcgacttcgaggcgatgccgaagaaggaggcgcttctcttgtcgcgcgagctcgccaagctggagctcaaccttggaggcattcgcaacctgacgcgcttgcccgatgcgatcttcgtgatcgatacgcccaaggagcacatcgcggtcaccgaggcgaatcggctcggaatcccggtggtggccgtggtggacaccaacgccgaccccgacctcgtgacctacccgatgcccgggaacgacgacgcgatccgcgcgtgcgagctgttcacccgcttgatggcgaccgccgtcatcgaaggccggcagcgtcagcaggccaagccggctgcctagagaccgcggccacgaacgaaggaggagaccaggtggtcagtgcgagcgatgtgcaggccctgcgccgtgcgacgggcgcaggcatgctcgatgccaagaaggcgctcgaggaggccgatggcgacgtcgagcgagcgacgcgcctgttgcgagaacgaggcctcgcctcggctgccaagcgcgtcgatcgagacaacgccgagggagcggttgcgctgtcgctgctcgaggaccgggcgggtgcgatcgtcgagcttcgctgcgagacggatttcgtcgccaaggcgcaggatttcgtcaacaccgccaacgagctggcggcgaccgtcgcgaccgatggggagcaggccgttgccaagttcgagagcatcatcgaagacttgcgcctgagcctcaaggagaacattgcgctcggtcgggtggtgcacttcgcggccggtgacggcgacgtcgtctcgggttatctccacgtccaggcagaccgcggcgtgaacgccgtgctcgttcagctgcacggcggcacggccgagctcgcccacgacatcgcactgcacatcgccttcgcccggccgcggtacctgtcgcgcgccgacgtcccagccgaggaggtcgagcgcgagcgtgagaccttcgaggtgcaggcgcgcaacagtggcaagcccgaggctgcgctcgccaagatcgtcgagggtcgcctcgacggcttcttcaaggagatctgcctgctcgaccaggccttcgtgaaggacgagaagcgcaagatccacgacgtgctcgcaggtgcgtcagtcgttcggtttgcgcaggtggagatcggtcgctgatcgtgggggcctcctggcgacgggtgctgctgaagatctccggcgagtcgctggccggcgaggatcgagctcaatcgatcgacccggcgatcttgcagcagctcgccgaggaactcgtcgagctgcgcacggtgcacggcgtcgaggtcgccgtcgtcgtcggcggcgggaacttgtggcgcgggaccgacggtacccagatcggcatcgatccgccgacgtcggacaacatgggcatgctcgccacggtgatgaacgcgcttgcgctgcagagcgcgatcgagcggctcggtcagccggtgcggctccagagcgccatcacgatggccgagctcgcagagccctacattcgccgtcgggcggtgcggcacctcgagaaggggcgcatcgtcgtgttcgccgccggcaccggcaatccgttcttcaccactgacaccgcagccgcgctgcgggccgccgagatcggcgcgagcgtcgtgctgaagggcacgcactcgggtgtgagcgggatttattcgtccgatccccgggtcgacccgtcggcggtgcagctggagcgggtcggctacatggaggtcatcgagcgcaacctcgccgtgatggacatgaccgctatcaccttgtgcaaggagcgggccatcaaggtcgtcgtcttcgacgtctcgttgcggggtaacatcacgaaggcctggcgtggccagatcggaacgttggtggagtaatggctgatccagtcgatatcgatgcggagcttgcggccttcgaggatcgcatggccaaggcagtgcgccacaccgaggaggagttcgcgaccgtccgtacgggtcgggcgcaggcggccctgctcgatgggatcgtcgtcgagtactacggcgagcgcgttccgttgcggcagttggcgtcggtgacgacgcccgatccccacagcctgctcatcgcgccctatgaccgcaacgcgatgggcgccatggagcgagccattcgcgattcagacctcggcgtcaacccgacgaacgatggctcggtgatccgtatcgcgatcgcgccgctcacggaggagcgtcgtcgagagctcgtcaaggtggtgcgcaagcgcgccgaggaggggcgggtggcgatccgaggcgtgcgccggcaggccaagcagcacttcgagtcgctccagcgccaaggctcgctcacgacggacgacctcgccgacatcgagcgcagtctcgatcgcctgacggcccgctttgtgggcgagctggatcgagcgctcgaggtcaaggagcacgacctcctcgaggtctaggccggccggtgagcgaacacgacgaccgggccccgcagtcggagcctacgagcgagcctcgaggcctgtcgcccgagcccgaacgacagcgagagcgcggggcccacgcagggcctgagaacggtacgcctcgcgagggcgcgagttcgacggatgcgggcgtgacagaacccctcgcatccgcggtgccacctggccccgttcggtcgtcgggccgtgacgaggggagcgacgacgacaccgtggccctccccgattggcgagagccaccgaccggtgacgttcctcgggtcctcgaagaactctcgggcatcccggtgcgcgatctcggaggacctcgtaccggtgagttgccctcgatcgacgacgaaacagttccgtggtcgccaccgtcctcgacccaaggtgagcgatccaagctcgacgacgacgcgcgtccacgccgagaaccgtccgaggctgcgactccccgagcgcctcgccatcatcggcgcaggcgcgatggcggcgagggcgaggccacgactcaggacgcgggcgtcgagcggcgcacggcggccggctcgcgtcgtcgagggggcgttcgcggcgcgacgcccggcgacgagcgatcccacggcggccccgcccggtccaaggcgctcagcaccctcaccggcattgcgctcgctgcgatcgtggtcgtagccctcgtcctggggcggatcccgttgctcgtcgtcgtcgcgctcgcgctcgagctggctgcttcggaggccttcagcgtgctgcaccgcggcgggctcctcgaggcgcgcttcctcgggctcgccggggtcggggcactcatcggagtcgcttacgcctacggtccggccggtgatggcggcgtcgtcgttgcagctttcgtcctgggcgcagcgtggtatgtcctcggaccactgcggcgtcctgcctacgaggggctctcgcacacgctgggcgtggttgtgtgggtcgggctccttggctcctatgcagcggtcctgctccgaccggcgacgttccacgggcacggcgagctcgtcctcgtcgtcgccatcgcgacgacggtggccgacgacaccgcggctttcttcgtcggatcggtgctcggtcgccatcggctggcgccgcggatctcgcccaacaagacgatcgaagggcttatcggcggtacggtcgcagccatcgtggccggcgcgctgctcgggatgatcgccccgctcagcgtcgtggaaggagcgatactcggactggtcgtcgcggtggtggctccgctcggcgatctgctcgagagtgccttcaagcgccagtttcatgtcaaggactcgggggcgctgctgcctggccacggaggggttctcgatcgcatcgacgcgatgctcgtcgtgctcccagccagctactacctcttcgcggtgatgcatctcaggtagcctgcctaggctgactgtcgtgccgagcgtcgccatcgccggggtcaccggttccgtcggccgccaagccggtgcggtcgtctctcgcgacccggaacgttttcatgtcgagaccatcgtcgctgggagcgatgcgggcgggctcatcgagctcgccaaggagctacgccctcgggtcgtcggtctcgcggtcggtggtgaccgcgagcgagtgcgccagagcctcgatgcgtccgtggaggtggtcgtcggtcgcgaagcgctcgaggcgagcgcagcggccgacatcgtcgtgaacgccgtgagcggcttcgcgggtctcgccgtgactcgagctgcgctgctcgctggacgcaggctcgcgctggcgaacaaggagtcgctggttgcagcgggggaccttgtggccggatggctcgacggtggcgacggcgaactcgtgccggtggactccgagcactctgccatcttccagtgcctcggaggctcgcgcgatggcgcagaccgtgtcgcgtcgctggtgctcacgagctctggcggacccttccgtacgcgatcggcggaggcgctgcgtgacgtgagcctggaggaggcgctcgcccacccgacgtggtcgatggggccgaagatcaccgtggactcgtcgaccctgttcaacaagggcctcgaggtcatcgaggcacactacctcttcgaggttccctacgaccgaatcgaggtggtggtgcatcccgagagtgtcgtgcactcgatggtgcgctttcgggacgggtcggtgatcgcgcagctgtcggagccgaccatggagttgcccgtggcggtggcgctctatcaccccgagcgcgcgccgtacgcgatcggctcgctcgatctcacccgacctcggtcgttcggcttcgagcccgtcgacgacgctcggttccccgcgttgcgcctcgcctatgacgccggtcgactcggaggggccgcaccgtgttggttgaacgcagcgaacgaggtcgcggtggccgcgtttctcggaggtgcgctgcgctggatcgacatctatcgcgtggtcgcctcgacgctggagcggttcgagccgacgacgttcgcatccgaggaggacgtcatcgaggccgatgcgaccgcgcgtgaccacgctcgacgcatcgtggaggaggtaactcgtggctgaggagatggaggcgccaaccctccaggaggctcgaagcttctccggtcgcaggctcgccgagctcgtcgtcgtgctcgtcgccatcatcgcgatcgcccagcacgcccatgcactcggcaccctcgccgtcgtggcggcgatcgtcgcgatggtcgtgctgcacgaacttgggcactacctggtcgcgcggtggtcgcgcatggaggtgaccgagttcttcgtcgggttcgggccgcggatcttctcgtggcaccgcaaggggatcgagtacggcctgaaggcgatcctcgtcggtggctacgtccgcatcaccggcatgacgagcgcggaagaggtcccgcccgagcgtgaggcgcgcacctatcgctcgtcgaccttcccccgacgagtcgcggtcagcgtggcgggctcggtcatgcacttcgtcgtggcatttggcatgctgtggtacctgttcagtggggtcgggacctacgcgagtcggggcgtggtcatcgagggggtcgcacacatcccaggggtggtgaccccggccgagcggatcggactgcgtgctggcgatacgatcctcgccgtcgacgggcatcggaaccctacccttgctgccttcgcgtcgtcgatctctcaccatcccggcacccctgtgcgcctcgttgtcgagacgcccggcggtcgagtcgtctcgcgcacggcggtgccgatccccgcgaccatggtggcgagatacgatgcggcctatcactccctgggttcccaaggcgtgctcggcgtggtggttgcgcctccagtcgaacgatccagtctcgtcggtggggtcgtgccgtcggcgcgcgcgctctggtcgctcgctggtgcgagcgtgagtgggctcgtgtcgcacttcacgccccatgggatcgcgacctacgtgtcggaggtgacgcacccctcggcgaaccccacctcggcaaagtccgcgtctcgcttcgagtcccccgtggggatcgtgcagctcgcgtccgacgcggtcgcggccggaaccggcgccgtgctcgagctcctcgtgctgatcaacgtcttcgtcgggatcttcaacatggtgccgttgctgccgctcgacggcggacacgtcgccatcgcgatctacgaacgcatccgatcgcggcgaggtcgtgcgtaccacgccgatgtcctcaagctgatgccgatcacctacgctgtgatagcggtgatcctctttctgggtgtcaccgcgctgtatctggacatcacgcatccggtgcccaacccgttctcgtagcgaggaggagagcaatggcgcgtcctcagatcgccctcgccccacgacggcccacccgccaggtcatggttgggtcggtacctgtcggcggaggggcgcccatctcggtgcagtcgatgacgaccacccagaccgccgacgtcgagggcaccctgacgcagatctacgccctcgccgctgctggcgcagacatcgttcgggtgacgtgcaacacccgtgacgcagccgatgggctcgcgcgcatcgtgccccgctcgcccgtgccgatcgtcgcggacatccacttccacgtggagatggccctcgcggcactcgatgcaggggtggccgccctcaggctcaaccccggcaacctgcgcaagcgcgaggagatccagctggtggcgcgcgaggcgaaggatcgcgccatcccgatccgcatcggcgtcaacgccggttcgttgcacccggagtttgcggagcgcttcgggggcgcaactccggaggcactcgtggagagcgcgctctacgagctcgcgctcttcgaggaggtcggtttcgacgacgtcgcgttctcggtgaaggcctccaacgtgccgctgatgatcgcggcctatcggctgctcgccgagcgtaccgatcatcccttgcaccttggcgtgaccgaggccgggccgccgccggcggggctcgtgaaggccaccgccggcatcgcgacgctgctcgccgagggcatcggtgacacgattcgctactcgctcaccgctgaccccgtcgaggaggcgcgggcaggacggcagttgctcgaggcactcggcctgcgagaacgcaagaacctcgacctcatcgcgtgtccgagctgcgggcgcgcccaggtggacgtgatcgggatcgccaaggacgcccaggcacggctcgaggagctcggcctgccgatccaggtggccgtcatgggttgcgtggtgaatggtccgggagaagccagggaggcggatctcggtattgcgggcggtcggcacaagggacatctgttcatccgtgggcagatcgtgcgggtggtccccgagcaggagatggttgacgcgctcgtcgaggaagccaagcgactcgttgccgagggcgtcgaggcacggctcgcggccgcagctcccggagcggccgaggaggcagcccgcgatcgcatggccgaactcggtggcgaggagggctcggccaagcgctagccttgggcgccatgcgcgcctccgacctcgtcttcgccacccaacgggaggacccacgcgacgccgaggtcgcctcgcaccgtctgctcgtacgcggtggctacatgcgggcgctggcgagtggggtctggagcctgttgcccctcggctttcgggtcctcgagcgcatcggcgcgatcgtggccgaggagttcgaccgcgcgggcggcaaccagctgctccttccggcgctgcacccggtggagctctggcaggagaccggtcgcaacgtcaccatggacgacgtgctcatgcgggtggattcgaagctcggctccttggtgctcggtccgacgcacgaggaggcggtcatcgccgccgtcgggccggacctcgcgagctaccggagcctgccagccttcgtctaccagatccagaccaagttccgtgacgagccgagagcgcggttcggcttgatgcgcacccgtgagttcgtcatggccgacggctacacgttcgatgtggaccgcgagcacatgcgtgtctcctaccagcgcgtctacgaggcttacctgcgcgtgtatcgccgactgggcttgaaggccgtgccggtcgaggcggacgcgggcgcgatcggcggggacgtgaaccacgagttcatggtgccctcggccatcggggaggatcacttcgcgtcctgtcgtgcgtgcgggtaccaggccaacgtggaggcggctcggcgtggccgggggcccgatcgagtgctgccccccatcgagcagccgagggtgtatgcgacgccgggggctccaggggtgcgcgaggcgatcgcggcactgcgcgccgagggggcacccgtcgacgatgacgggatgctcaagtgcatggtcgcctacgacgacgcgggccggacgacgctcgtgctcgtgcccgggcagcgcagcgtgaggctgccacggggttggcggcttgccggtgaggaagcgttccggcccgaaggtccgttcttcctcggctacgtggggccggtcgggatgcgagaagccggcgtgcggatcgtcgccgacccgatgatccgagagcgtccgtggtgggcgaccggtaacaacgccgagggcgagcacgtcgtcggtgtgcgcgtcggcgtggacttcgaggtcgacgactggatcgaggtggtcgaggtcgtcgacggggatccctgcccgcgctgtggcgctcccctggcgctggttcgcgcggtcgaggtggggcacaccttccaactcgggcagctctattcgtcgcgcatgagccgggggaccttcgtcggcgaggacggggcgacccatccgttctggatgggctgctacggcatcggcgtgagtcgtctcatcgccgtcatcgccgaggagtaccagcgagacggtggcctggcgtggccgctcgagatcgccccgttccaggtcgccgtcgtgcctgccggcagcagtgacgacgtcgcggcgaccgctgcgaacatcgccgaagagctcgaacggatggggcgccgggtgctgctcgaggatcgggggctgagcttcggcgtggcggccagggatcaagaactcgtcggtgcgcccctgtgggtggtcgtcggtgcgcgttcgctggcgcgtggcgaggtcgagcttcgcaaccgcgtcgatgggcggacgctcaccgttcagcttcgcgatgtggcccaggcggtcgacgccgaggccggtcgcatcggcgagcgcgccgactgagcgctatactccctccgggctcgttgcaggggccggggtgacgtgggcttcggcccacgttttttcgtcacctgcgcggctcgctcggcgaggggaggggacatggcggacagccacgcactatggacggcgctcgacgagcgactcgccggtgcggcgctccaggtcgccgacctcgtggtgcggccaggttccgtcgcggtcttcgtcgaacacgacgatgcgagcgcgccgagcctggacgaactcgagcaggtgtcacgggacgtggtcaccgtcgttcgctccgagcttggagacgtggcggtcgaggtgtcgagcccgggcctggaacggcgactgcgcaggatcgagcaggcgcgtgccgtgctcggccgaagcgtcgcgatccgacgcgagggcggtcggctcgggggtgtgctcgtgggggtcgagggcgacgagctgatcgtcgaggtcgacggcgagccgcagcgcatcgcgtggggcgaggtgcgcgaggcccagacgacgtggtcgttggggaccgatggtgcagacgagctggatccggagcgcagcgggaggaacgatggccgttgagaacccagaggtgatggacgcgctcgaggtgatcgctcgggagaagggcctgtcggtcgagacgctcctcgagtcgctcgccaacgcgctcgctgccgcctacaagcggcggcccggcgctgccgaggaggcctacgtcgagatcgatcccgcgagcgggacgatccgggtgatctgccaggagctcgacgagaacggtaccgtcgttcgcgagtgggaggacacgcctcgcgacttcgggcgcatcgcggcccaggctgccaagcaggtcatgctgcagaagatccgcgaggccgaacgcgagcagaagtacgaggagtacgccgggcgcgagggggacgtggtcacggggatcgtgtcccagatcgacccgcggttcacgctgctcgacctcggcaagatcgaggcgatcatgccgcactccgagagcccgtcgaacgagcgctactcggtgaaccagcgtttgaaggcctacatcgtcgaggtgcgacggtccatcaagggtccacagatcgtcgtgtcgagaacgcaccccggcttggtccggcgcctcttcgaggtggaggtgcccgagatcgcgagtggtgtcgtcgaggtcaaggccatcgcgcgcgagcctggtcatcggaccaagatcgcggtgtggtcgaacgatcgctcggtcgatccggtcggagcctgtgtcggtgctcggggatcacgcgtccacaccgtggtgaacgagctcttgggggagaaggtcgacatcgtcccgttctccgaggatctcgcggagttcgtcgagcgggcgatcgtaccagcgcacgccctctctgcgaccgtcgagggtcgcgatgcgctcgtggtcgtgcctgacgatcagctgtcgctcgccatcggccgcgagggccagaacgcgcgccttgccgctcgtctcaccggcacccacctcgagattcggccccagagcgaggtcgagggccgccaggagggtcagccatagcgcccccgcaacggatgtgcgtgggttgtcgggcccggcgttctgcgtcggacctcgtgcgggtgcacgtggtggaggggcgcctcgcggtcggggcggggcctgggcgcggtgcgtggatctgtccgcgggaggcgtgcctcgagcgcgcgctcgcgcatggacggctccgacgagcgctgcgactcgccccgtcggacggcgagctcgtcgacgagggcgtgcgccaggcctggcgagcggcgatcgctgggcacggcgcgtcgagcgcctaggctcgaagtgactcacgtagtgctgtcggcgctcgtgggcagacaggtgcgcgggcgtgggtccgcatcggttcggaggcaagggcaaccagttggcgcgcaagctcagagtgtacgaaatcgcgaaggaactcggtctctccaacaaggaggcgctggatctgtgcctcgcgttgggcgtggacgtgaagaaccactcctcgagcgtcgaggaggcccatgcagaccggatccgacgtcgcgcgcagcgagatcatctcggcatctacgccgaggcaacgaccccccaggtggccccgccgagcgcgccgaccacgccaccgagcgttcgtgagcccgagccggtggcggctcccgagatatcggagccggtcgtggcgagcgcacccgagcggcgccccgacctcgccgcggtgatcgccgaagaggcggccaagcgcgaagaggccgagcaggctgccatcgagaacgcgggtcgagcgccggagcaggcggcgccgcgacgtcagggcccgctctcgccatcggggaatccgatcccaccacccccgggcgggcgaccgctgtcgccgtcgggtaagccgatccctccgccaccacgtccacaaggtccacgcgacggacgcggccgaccggctcgcgaggggtccgggcgccctgtgggcgggtcgcgtccgggtgccgggcgccccggaaccggtggcgggcgccccccgatggggggtgggatccggccgccggcccgcggtggcggcggcgtcagcacgccccgattcgggggcgcagccggtgcgttcgctggccgtcccggtggcggtcggggccgtggcgtgcgtccgaacaagagtcggcggcgcatctcgcgcaaggagttcgaggagctcgagccgacccgagcgacggcctatgtcccgtcgaacgatccggtccctgactacgaggtcatcatcgagcggggctcgacggcccaagaggttgcccccaagctcaaccgctcgccgggcgacctcgtgcgcttcttgctcatgcagggcgagatggtcacggcgacccagagcctcaccgacgagatgatcgagctgtacgcggcggagctgggcgcgaaggtgcgcctcgtcgatcccgggcaagagcaagaagcgcagctcgccgccaagtatctcgatgtcgatgagaccctcgatccgacggccgaggtggtccgccctcccgtcgtcacggtcatggggcacgtcgaccacggcaagacgttgctgctcgatcgcattcgccacacgaacgtcgtggcgggcgaggccggtggcatcacccagcacatcggtgcctaccaggtcgatgtcgaggggggtcgcatcaccttcatcgacacccctggtcacgaggccttcacggcgatgcgtgcgcgtggcgcgagcgtcacggacatcgtcatcttggtcgtcgcggccgacgacggtgtcatgccccagaccgtggaggccatcaaccacgccaaggcggcgggcgtgccgatcatcgtcgcgatcaacaagatcgaccgtcctgacgcggatccgaatcgggtcatgcagcagctctccgagcacggcctcgtgcccgaggcctggggtggcgacaccatcacggtgcaggtgtcggcgctgcagagtctcgggatcgacgagctgctcgagcaggtgctcgtgctggccgaggtcctcgagctgcgtgccaacccgacgggtcgggctcgcggtgtggtgctcgagggacacctcgacgtcggtcgtggtccggtcgcaaccgtgttggtgcagggcggcaccctgcacgtcggtgatcccgtggtcgccggccaggcatggggcaaggccaaggcgctcatcagcgatcggggagagaaggtctccgatgccggcccgtcgacgccggtccaggtcctcgggttctcggaggtgccgagcgcgggtgatccgttccgcgtgacggccgagatctcgcacgccagggagatcggcgaagcgcgcgagcagcggctgcggttggcggcgaacgccaaccgggcggtcggcgcacagggcgtgcggctcgaggacatcttcgaacagatccaacaaggcgaggtccctaccctcaacctcatcgtcaaggccgacgtccagggcagcctcgaggcgctctcggatgcgctcgcgaagctctcgcgcgacgaggtgcgactcgagatcatccacaaggccgtcggtgggatcaccgagaacgacgtcacgctcgcggcggcgtcgcacgcactcatcatcgggttcaacgtccggccggatcgccgagcgcgtgaggccgccgaggtccgtcacgtggagatccgtacctacgagatcatctaccaggtgatcgaggacatcgaggcggccgtggtcggcatgctcaagccggagttcgaggaggtggtcgtcggcgaggccgaggttcgcgaggtcttccggatcccgcgcgtcggtgccgtcgcagggtgctacgtgcgcaacggaaccttgacccgtggtggccgcgtgcgattcctccgagacggggtcgtgctgtggaaggggacgatctcctcgctgcgccgcttcaaggaggacgtgcgcgaggtccaggccgggttcgagtgcggcgttgggctctccgatttccaggacctccatgcaggcgacatcatcgaggcgttcgagctgcgtgaaatcccgcgggggtgagcgtgggcagacgcgcaacccatccgtacgcgcggaccgaacgggtcgccgccgtcctccaagaggtgatcgctgaggcgctggagcgcctcgtcgatcgcgacgagcggctcgccttcgtcacggtgacccacgtcgtcgtgagcagcgatctgcgccacgccgacgtgctgatcgcgtcgggaacggcggagacgctcgaggcgctggacgacgctcgcggagagctccagcgtgcggtggcacgggaggtgcgcctcaagcgcacgcccgccctgcgcttcggccttgacgcgcaacttgccgccgtcgaggagctcgaggcggtgttccgccgcgtccacgaggcagcgacggatgatccagggcatctacctcgtcgataagccgagcggcccgacctcccacgacgtcgtggctcgagctcggcgtgcgttcggcacgcggcgcgtcggtcacgccgggacgctcgatccgatggcgagcggactgctcgtgctcggtgtcgatcgcgcgacccggctgctccgctacctcgaggcccagacgaagcgctatcgggccgtcgcgctcctcggcgttgcgaccgataccgacgatctcgacggtgtcgtcgtcgatcggcgaccggtcgaggagccgacccgcgaggccgtggtgacggcgtgccgtcgcttcgtgccgggttacgaccaggtgccaccggcctacagcgcgctgcacctcgacggcgagcgtgcctacgtgcgggctcgccggggtgaggacgtcacgttgcctcgtcggcgggttcgcatcgacgagatcgaggtgggtgcgatctggcgcgatggcggcccaggggagccccagggcgttcgcgtcgagctcaccgtcacctgtggccccggaacctacctccgctcgctggtacgtgacctcggtgaggcgctcggcacgcccgcgacgctcgcgtcgcttcggcgcgagcgtgtcggtcggctggaggtcgcccaggcggtggggctcgaggacctcgagcgagcgacaccggtcccgcttccgctggcgctcgctggtctcggccgtgtcgaactcgacggggtcgacgccacgaggttcctccatggtcagcgcatcgaggcgccgtcgggtctcgacgagggcgacgtgctcgtcggtgccgagggttcgtggttgggggtggcgagctgtgacggccacgtgctcgcaccgcgcgtggtgctcgtcgatgcgggagttgcgcgggcatgatcgtggttcgagagctcgatgaccctgccttcgtcgtccccagttccgtcgtgaccatcgggaccttcgatggtctgcacctcggacaccagcgactcatccgcgtcgcacgcgacgtcgcgcgtcgagcacgcctgcccttggtcgtggtgagtttcgatcgccaccccctgcgcttgctcgcacccgagcgagtgccgccgctcatcatgacgccactgcagcgcgatcgtgtgctcgcgtctcagggcgtcggcgtgctgtatctgctgcacttcggacccgaacgcgctcagcaggcgcccgcgtccttcgccgccgaggtgctcgcgtccaggctcggtgcgacccacgtcgtcgtcggcgccaacttcaccttcggtgcccgaggggcgggtcgccctgccgacctcgtcgccatgggtcgcgacctcggcttctcggtcgacgtcgaggagttggtcgacgacgacggcgaggtggtgtcctcgagtcggatccgtgcgacggtcgcctcgggggacctcgtcgaggcctcgcgcctgctgggccgtgcttacgcggtcgaaggtgtcgtcgtcgcgggggatggccgcggtcgagaactcggcttcccgacggccaacgtcgtcgtctcttcgtcctatgcgagtccgcccgatggcgtctatgccggatgggcgtggaacgactcgggtcgctgggctgctgcgatctcgctcgggacgaggccgacgttctacccgaccgacggcctccggctcctcgaggtccacctgctggacgccgacgtcgacctctatggtcagtcgttggaggtggcgttcgactcccggctccgagggcaagtcgccttcgcgggtgtggaggagctgatcgcgcagatgcacgccgacgtcgccgaggtccgtgtgcgcgtgggagacctcgagggcaggtaggctactgcctggctgtagcatcatcacgtacgcctggagcgtccaggcacgacacacgaagggacagtgaccaacccatgggttccaaggcggagacgatcgcgaagttcgggcgcagcgagcacgacaccggttcaccggaggttcaagtcgcgctgctgaccgagcgcatcgcccacctgaccgagcatctgaaggttcacaagggtgatcaccacacccgtcgcggcctcatgatgatgatcggtcgccgccgccgactgctcaactacctgcgttcgcaggacgtcgagcggtatcggaccctgatcgcggaactcggcatccgccgctaggcgccgcacgagcgacgaggcgactgcagccggtccctgtctctcccacaaggagcatccatgtcattcatctcggttgagcgtcagctgaccggggtaccctcgccgttgcgcttcgagacgggcaagcttgccctccaggccaacggagctgtggtcgcgcgcctcggcggcaccaccgtgctcgtgaccgccactggggccaagcacgtgcgcgagggtatcgacttctttccgttgaccgtcgacgtcgaagagcgcatgtacgccgcgggcaagatccccggttcgttcttccgccgcgagggtcgtgccacggaccaggcgatcctgacggcacgcctcatcgaccgtccactgcgaccatcgttcgccgatggctttcgcaacgaggtgcacgtggtggcgaccgtgctcggtgccgacctcgtcaatccacacgacgtgctcgccatcaacgcggcctcggccgcgctcatggtgtcggggctgcccttcgaggggccgatcggcgcggtgcgcgtcgcgctcgcagccgatgggagctggattccgttcccgacgttccagcagggcgatgcctcgagcttcgagctcgtcgtcgccgggcgcaagacctcggacggtaccgacatcgcgatcatgatggtcgaggcgggtggcaccgaggcgacctggggcgcattcgaggcgaacgccgccatcccgaccgaagcgacggtcgcggaggggctcgtcgctgcgaagcagtggatccgcgagagcatcgagctgcaagaggagctggtcgccaagctcgatcatcggccgacctttgcgtggacgccgatgcgcgactacgaagaggacgtgctcgtccgcgtgaacgaggtcggtcgcgagcgactggccgcggccaacgcgcacaccgacaaggtgacgcgccaagatgccctcgacgccgctggcgatgccatctgggctgaactcgccgacgagttccccgagcgcgagcgagaggtgcgggctgcgatccgtcgggtcaccaaggagatcgtgcgcgagcgcatcacgcgcgagggcgtgcggatcgacggacgcgacacgacgaccatccgtccgctcctcatcgaagtgggactcatcccgacggcgcatggttcgggcctcttccagcggggcgagacccaagtgctcaacatctgcacgctcggcatgccgcgcatgaaccagcaactcgacaccctcggggtcgacgaggaaaagcgctacatgcaccactacaacatgccgccgtttgcgaccggcgagacgggcttcatgcgaggacccaagcgtcgcgagatcggtcatggcctgctcgccgagcgcgcgctcgtgccggtgctgccgccggagtccgagttcccgtatgcccttcgcctcgtgtcggaggtgctgagttccaacggttcgacctccatggcgtccgtgtgcggctcgacgttgtcgctgatggacgcgggcgtgccgatccgggcggccgtggggggcatcgcgatgggcctcatcgcccacgacggtgtctacacgaccctgacggacattctgggtgccgaggatgccttcggtgacatggacttcaaggtggcaggtacccgggagttcgtgaccgcactgcagctcgacaccaagatcgacgggatcccctcggaggtgctcgcggccgccctcgagcaggcgcgccaggcccgcgtgtcgatcctcgatcagatgctcgccgtcatcccggcgccgcgttcggaggtggccgagaccgctccgcggctcatcaccttccaggtgccgctcgacaaggtcggtgagatcatcggcccgaagggcaagaccatcaacacgctgcagcaagagacgggtgccgacgtctcgatcgacgacgacggcgtggtcggaaccgtggtcatcggtgcgcgtgacatcgaggcagcgcgcgaggcggagcggcggatccagctgatcctcaacccgccgcaggccaccctcggcgaggtctacgagggcaaggtcgtcggcatgaccaagttcggcgccttcgtcaacgtcctccccggcaaggatggcctcgtgcacatctcgaagctcggacgcggcaagcgcgtcgagcgcgtcgaagacgtcctcgagatgggccaggtgctcaaggtgcgcgtcgacgacatcgatccgtcgggcaagctctcgctctcgatcgtcgacgacgagaacggtgagactccagcccacgctggcgcgtcccatgccggctcgtcgcacgccggcgcgtcgcggacctcggggcgtgagggctccgatcgtcgccatcggcgtgacgagcgccccggcaacgaccgtcgtggatcgtcgtcggctccggccaacgccgtgtcgttcgaggaccgcttcgagtcggagatccagcgcgaactcggcgacctccagtaggtgagccccttcggggcgactcgtcgtgtgtccgagcgccggccagcagcagctggccggcgctctggcgtctgggggcgccatcggcggcagtaccgatcatgacgttctcgcggagggcagcgactggggtgtgggacgggcacggtcctctcgggtgggtccgctagggtccagcccatggcccctcccatcgaccacccggttctcgacgtcgccctcgccgcgctcgatgcggggaggcaggccctgtggcgcacggattcgcgagcggtgctggcgacgaagtcgagccggtcggacccggtgaccgcgacggatcgagcgatcgagcgcgccgtgcgagatgccatcctcggcgtgcgtccccacgatctcgtcgtcggcgaggagttcggttcggccggtgagccggggcggctcaggtggctcgtcgacccgatcgacggcacggtcaacttcacctacgcgatcccgtatgcagccatctcgatcgccgcgctcgacgcatccggcgcactggtgggggtggtgtgggaccttgggtcagacgagacgttcatcgcggttcgcgggcagggcgcctggctcggcgacacacgcctcgccgtgcgaccatcggtgccgctggccgacgccctcgtcggcaccggcttcgcctacgacgcttcggtccgcgccgtccagggccgagtgctggcggcgatgatcgatcaggtgcgcgacgtgcgccgcttcggggcggctgcgctcgatctgtgctggacggcggctggcaggttggatgcctacttcgagaccggcttgaagccatgggacgaggctgccggtgctttggtggtgcgcgaggcgggaggcctcgtggcgaccgacctcgtgggcatcggcgacgacgcgctgaccgttgcgggtccgccagggctgttcgaagagctcagcgagcgcctcggcgaggttctcgccgacgtcagagggccggtcggggacgtgtccgcctcctaggctttgcgccatgcgtgtcggggtcctcggtgctggcggtcgagtcggtcaggtgctgtgtcgggagattctggaccagccggacctcgagctcgccgtcgccgtcgatccgaggttggccggcatcgacctcggtcaggtgatcggtcggccggccggtggcttggtggtcgtgggcgacctcgaggcgtgcctgcgtgctggggtggacgccgtcgtggacttctcggtcgcggaggctgcgcgacccgcactcgtgcgcctggccgaggccgccatcccggctgtggtcgggacgaccggcttcacgcccgaggacatcgaggtcatcggtcgggcgtacgaggcgtccggagccggctgcatcatcgcggccaatttctcgatcggtgccgtcctgctcgagcgctgcgtgcgcctcgtggcaccgtacgtggactcgatcgagatcgtcgaggcgcaccacagtgccaagcgcgacgctccttcgggaacctcccgcgagctcgctcgggtggctcgtgaggctcgcgaggcagccgaggcggggcccctcgtcgcggatccgaccacgcacgaggtcctcgctggcgcacgaggtgcgctcgggcctggcgacatccgcatccatgcgctgcgcgtcgagggtgcgatcgcccatcacgaggtgatcttcggccttcgcggacaaacgctggccgtgcgtcacgatacgctggatcgcagttcgttcgtccccggtgtgctgctcgcgctgcgccgtgtcggtgaggttcgggggctggtgctcgggatcgacgagctgctctgagaggaacgggaggttggccgtggcaccaacggtggcgttcggaccggagatcacggcgatggcgacgccatttggcaccgatggcgcgctcgacctcgcggccgcagagcgcgttgccagatggctcgtggaccagggatcgagcgcgatcgtcgtgaccggctcgacgggtgagtcggcaacgctcagcgacgacgaacgggccacgctgtggcgggtggttgcagccgcggtcgacgtgccggtcatcgcgggggcgaccaccaacgacacggcgcactcgctccggctcgtcgacgccgccgagcgggccggggccaagggaatccttgccgtcgttccctactacaaccgtcctccccaggccggtctcgtgcgtcacttcggccagatcgcccgagcgacgagcttgcccgtgctgctctacgacgtgcccgcgcgcaccgggcgtcgactcgagcccgagacgacgcgtgagctcgctcggacgtcgacgaacgtggtcggcctgaaggatgcctccggcgacctcgcggcagctgccgcactggtggccgaggcgcccgatgggttcgtgctctactgcggcgacgatgccctcgtcttgccctacctcgcgatcggggcggtgggcgtggtctcggttgcgggtcactgggccggcccgctccagcgggtgatgatcgaggctgcgcgctcgggggactgggagcgagcccggcggctgaacgcggcgctcgaggcgtcctatcgcttcgagaaccagctcgcctacccgaaccccatcccgaccaaggcgatgctcgccgcattgggtcttgccgagccggtctgtcgatcgccgctcatcgatccgacgcccacgctgatcgacgaggcgcgcagcgtcctcgccgatctccacgcacaggccgacaaggaaggcatcgagcttcgtgtcaaggcctgagctgcacattcgcttcctcggagggctgggtgagatcggccgcaacgccgcactcgtgagtgtggacggacggggggtgctcatcgacttcggcgtgatgttccccaaggccgacatgccgggggtcgacctcgtgctgccgaacctcgcgggcctcgacgacgtcgagctcgaggcggtgatcgtcacccacggtcacgaggatcacatcggcggcttgcccttcttgctcgccgagcatcgtgtgccggtgtggggctccgaggtgaccctgggcttcgttcgcaatcgactgcgcgagcacgacctcggggatgtggaccttcgcatcctcgccgatggggcgcgcgtgtcggtggggtccttcgaggccgaagccatcccggtgacccactcgatccctggtgccgtcgccgtcgcgctcacgacgccagccggggtcgtgctccataccggggacttcaagatcgaccacaccccgctcgatggtcgtcacatggggctcgctcgtatcgcggcgctcggttctgatcctgggatccgcgtgctgctgtcggactcgacgaacgccgacgaagacgggtatgcccgttcggagcgagcggtcggaccggcgctcgaggacctgttcaaccgccacggcgcggctcgtgtgatcgtggcctgcttctcgtcgcacctgcaccgtatccagcaggtcgccacgctggcacgcgagcatggtcgacggctcgtgctgctcggtcgctcactccagcgcaacgtccagctcggcatcgatctcggtctgctcgatgcccgactcttcgagcgcacgctcgatccgcgcgaggtgcgcgagctcgaccccgcgagcgtggcggtgatcgcgaccggatcgcagggggagcgcatggcggcgctccaccacctcgcgttcgatcccgctcgctggttcgccgtcggtggcgacgacgtggtcgtgttctcctccgacgtgatcccgggcaacgaggcagccgtcaacttgctcgtgaaccagttcacgaggctcggcgcaaccgtcgtcacctcggcacgcgagctcgtgcacgcgaccggtcacgccaagcaggaggagctcgccctcgtcgtcgagctcgcccgccccgactacttcgtgccggtgcacggcgagtatcggcacctctccgctcacgcggcgctcgcgcaacgcaccggtgccgtcggtcgtggggtgatcctcgcccgggacggggccgaggtcgtcatcggcgacgacggtgccgagctggctgacaccccatggggcgagtacctctacgtcgacggtgtcgtcggggacgtctcgcgcggggtgctccgtgagcggcgcaacctgtcggaggagggcgtcgtgatcgtcggggtgacgctcggccccgacggggtcgcgctcggtgagcccgagctgacctcggtcgggtggatccacgacgagcgcgaggaggagctcctcgcggaggttcgggcgatgctggtcggagcgctcggtgacgagaagccgcgttccgaggacgcggtcgccgagctcatccgcacccgggtccgcgcactcgtgcgcgagcgcacgcggcgacgccccctcgtggtgcccatggtgacgaggatcgacgagggctagggcgtggctcctcgatcgcggcgcccctcatccaccaagggccgttcccatggcgcgggtgctcgtggctccggcgcgcgtgcgcgggacgcgaaggcgactcggcgacgtacgagtcccgaggcactcgcgctcggggcggtcgtcgtgggtctcgcgggcctcgtcgtcggctactcggggctcttcggggtcgtcggcacgggcgtcttcctcgcgggccgagcggcactcggtcgcgcggcgtggcttggttggctcgcggtgatcgtggcaggcctgcgcgtgctcgtgcggcgcgagcggccgagacggcgtgcgggcgtcggcctcgccctggtcgtggttgcggtcgcagcgctggttggcgaggcgatgcgggtccaccccgaagcgtctcgggcaggtgggctgttcggcggcgtggtcgctcgagccctcatggcgctcgagggtcgcaccggggcgatcgtgacgacgctcgtcgtcatggccgctggtgccgccctcgccggtgagctccgctggcacgtggtcgccgagcgggtcgccgagcgtctgcgccacgtgcccgacgaggagccgtcgaggaccacccgtgtggctcgtcagcgacccgagcgtgccgcgggctccgtcatcgaagccaccttctcggagctaccctccgatcccgtcgaagccgtccccgagcgccaccccgacctcgacgaggatgcggggatcgctgtggctgatgcgtcgtcgtccgcatcgctcggtgaacccgaagcgttcggctcgccggacgacacggcgacaccgacaccgatcgagctcgtggcgccgcgggcttcggcctgggagcgtcctcggcgatccatcctgcgccgaggcgcgcgcgccaacctcgaccgcggtgagctcatccggggaggccaagtcctccagagcgcactggccagccacggcgtcgcggtgagcgtggtcggtatgaccacgggtccgacggtgacacgctacgagctcgagttggccgagggcgtcaaggtggcgagagtgcttgccctccagcgcgacatcgcctacgccatggcctcggctgacgtgcgcatcctcgcgccgattccggggcgcagcgccatcggtatcgaagtcccgaaccgggtacgcgaagtggtgaccctcggcgacgtcctcggtgacgtgccctcgagtgctccggtgctcgccgtgccgctcggtcgcgacatcgccggtcgcagcgaggtggtcgaccttgcccgcatgccgcatctgttgatcgcgggcacgacgggttcgggcaagtcgtcgctcgtgaactcgttgctcgtctccttgctcatgcgcgacacacccgacgatctgcgcctcatcttgatcgatccgaagcgggtggagctctcgcagtacgcgggcctcccgcacctgctcacccaggtcgtggtggatcctcggcgcgcggcagccgcgttgtcgtgggcggtggccgagatggagcgacgctacgacgtgctcgcgcactggggggtgcgcgacctcgatggctatcgcgatctcgtggctcgcgtccaggggaacgccgaggccgtcggggacgatgaggacgcgcccgcgccgctgccctacatcctcgtcgtcatcgacgagctgaacgacctcatgatggctgcgccgagggaggtcgaggacgcgatctgtcggatcgcgcagaaggcgagggcggtcgggatccacctcgtggtcgcgacccagcggccctccgtggacgtcatcaccggggtgatcaagaccaacatcccgtcgcgcatcgcctttgcggtggcatcccagacggattctcgtgtcatcctcgaccagccaggtgccgagaagctcgtgggcaagggcgacctgctcctcgtcacggccgacagttcgcaaccgcaccggctccaggctccctgggtgtccgagaccgagatcgctcacgtcgtcggggcctggcgccgccaggggcgccccgagctggtgggcgagctcgagcagggcacccccggcagtcgtgagagcgtcgtcggcgacgaggacgtgctcttgcccgaggcgatccgtctcgtcgtggagtcccagagcggctcgacgtcgatgctccagcggcgactcaaggtcggcttcgcgcgcgctggtcgtctgatggacctcctcgaggcgaggggcatcgtcgggccggccgaagggtcgaaggcgcgccaggtcttggtcgggttggacgagctcgacgcgaccgccggccgcgtcgacgaccccacctctcaggttccacctagcccaccacggtaggctgctcagcatccccgctacgtgcgcgctcgtgctgtgcgcgcgtgagtggcgggtctggctgagagcggaggacagcggatggcgtcgcggaatcggaggaggctcggagcccgcagtcgaggttacggtcgacggcggagcgtgcgcctcggacgcgtcctcatcgtggtcgtggtcgtgattgtgctcgccggggtggtgcagatcgtgcgtggggtcccacagccgagctacagcgccgtggtgccggcgacggcgaccatccccggctccgcaccgaacgtgccgtggccgagcggcggcgaggcggcggcggagatcgttggcgtcggcaggatcggcacctacgggccgacgaccccgcagacgatcgcgtcggtggccaagatgatgacggccctcttgacgatccgtgatcacccgctctccctcgggcagcaagggccctccatcacgatcacgcccgaggactaccagatctacctcacggacaaggcccagaacgactcggtgatggccgtcgcgccgggcgagcagctcagcgagtaccaggccctcgaggcgctcctcatcccctcggccgacaacatggccacggtgcttgcgacgtgggacgccgggagtgagtcggccttcgtggcccagatgaaccacgaagccaaggtgctcggtctcaccgatacgcactatggcgatccgagcggtctgtcggcggcgacgtactcgaacgccagctcgcagctgcgtgtcgcgaggctcgtcatggcgaacccggtgctcgcgagcatcgtgtccaagccccaggcgacgctgccggttgcgggtgtggtctacaacgtcaatggcgaggtgacccaccacgggatcatcggcgtcaagacgggctccatcttgacgggaaacttcgcgatggcctgtgcggtgcacgtagggacatcgacctacaccgggctcggtgtcgtgctcgaccaaggcggcgtcgcaccacttgagaccgcgctccacaacggcgtgcggctcgccgagttcgaggagcagctcctccggccggtcacggtgctcagggccggtgaggaggtcgggtcgctcgcggtccccggtcacggctccgtggccgtgacggcgactcgaggggtgacgctggtcgggtggccaggcctgctcgtgcaggtcacggtccatctccaccagcacctctacggcgcggccgcgcacgccgtggtcggcagtgcaacggtcaccttgggtgaacagcgcatgacggtcccgttggtggcgagttcggcggtggcgtcgccgtcgctcctgtggcgcctgacgcatctgtaatggtcgcaccccatggcccgtggcgcttcgcacgggcgcccggctcgaccgccaacctgggccccgggttcgacgcgctcggactcgcgatcccgttcgagactcgtgtctgggcgcggccgaactcgcgcttcgtcgttcgactcgccggtaccggagggagcgagcggctcgacagcggtcacctgatcgcgcgggcactgtcgcaggtcgcccgcgagccggtggagctcgtcgtcgcctccgacatcccgctcgcacgcggcctcggctcgtcgggatcgctcgcgctcgccctcgcggccgcgctcggtgcgaccgatccgctcgccgcggcgatcgtgctcgaggggcacccggagaatgcggcggcctccgccctcgggggcgcggtggtggcggtcggagggggtggggacgagctcgtgctccggcgtgtggcgctcgatgctcggctgcggctcgtgctcgtcgtgcctgagcgtcgcctcgcgaccgccgaggcgagagcggtcgtggcgcgcaccctctcgctcgaggacgccgtcttcaacctgcagcgcgtcgccgctctcgtcgcgagcctcggtgatgtggaggcgctcgcgccgttgctcttcgaggatcgactccaccagccctggcgcgagcggctcttcccggaagccgtggtggtccgcgacgcgctcatcgaggcgggttgtcgcggtgcggcctggtctggggctgggccgagcctcgtggggttcgtcgaggaggagcgagccccccaggccgccgaggccgtccgggcttcgttggtgcgcgtcgcgatcggcgccagcgtgcacgtggtcgcccccgatctccggggcctcgtcgtcgggagcgagccgccgccaccggcactcgcggaagggcctgcggtacccttcgaggcttccggactcggctagcatggactcgatgtcctctcctcagcgcgtggccgtctatggtccgagtgcgctcgcaacaccagcgaacgcggtcagcgtggtgcggttgctgctcgccccggtcatcgtggtcgtgctgctcggggcaccggacggctgggttccgctcgcgctgtgggctggggtcgccttgtcggacaaggtcgatggcgtcctcgcacggcgccagggcgtgacccgagcgggcgcgttcctcgacccactcgccgacaaggtgctggtgttctcggtgctcggtgcgctgtggctcctccatcgggtgccggcgctgcccatcgtcatcatgggcacgcgcgagatcgccgtgagcgtctatcggacccaggtactcgccgggggccagagtctgccggctcggttgccgggcaagctgaagatgctggtgcaggtgatcgcggttggcgtggcgctcgtacccgggtttgcgctgcacgacgagagcgtggtcacgaccctgttgtggggcgccacggttctcgccgtggtgagcggcgtgcagtacttcgtcgacgcccgctcgatccagtcctgagcgcgggtcccgtggacgtctgtatcgtctcgatcggcacggagctcttgctcgggcagatcacggacacgaacgcccggctgctcgcggagcgactcgcttctgcaggacatacgagccgcctacgtgtgaccgtcggcgacaaccatgcccagatcgtgtgggcgctcgcggagggacttgcgcgggccgacgccgtcatcacgacgggtggtctcgggccgacccaggacgacatcactcgcgaggcggtggctgcggtcgcgggggtgccgctcgagcgcgacgagcgcgtcgcggcgaggatcgaggcgatctttcgcgatcgagggcgtcccatgcccgagaacaactaccgccaagcgctggtgccacgtggcgcccaggtcatcgagcagcgcaagggaaccgcccctggtctcgtcgtccccgtgggatccaagctcatcgcgtgcgtccctggcgttccctacgaggcggaggacatggtcgacgaggtgctcgccgccttcgccgctcacgatccgagcccgggcgtgctcgcatcgcgcgtgctgcggacctggggtctcggtgagtcgcgcttggccgagctcgtggccccacggttcgatgcgctgtgggggacgcccacgacgctcgcgtttctcgcctcgggcatcgagggtatcaaggtgcgtatcaccacacgcggcagcgaccccgacggcgtcagggcgaccctcgatgccgaggagcgtaccctcagagcgatcctcggcgactacgtgttcggtgtcgacgacgactcgctcgagcgggtcgtcgcgcgtgcggtcaccggccgacaggcccgagtcgcggttgccgagtccctgaccggagggatgctcgcgagtcggctggtctcggtccctggtgcctcggcgtggtttcgcggtggtgtggtcgcctacgattccgccatcaagcacgaggtgctcggggtccgggccgaacgtgtggtgagcgaggctgcggccgtcgagatggcgctcggtgcggcgcgggtgctcggcgccgacatcggggtggcgacgacgggcgtcgccgggccggatccgctcgagggcgagcccccgggaacggtctggatcggggttgcgatcgggcagcgtgccgcggcgcgtcaggtccgtctgctcggcgaccgcgagcgggtgcggacgtatgcggtcgcgagcgcgttggacctcgtgcggctcacgctggaggggtcgccccgaggtctgtcgctggaggagcactcggcatagccgatcatgcgttcgcatgtcgtcggctcgtgctacgctacgcatgtatccacgaggggaggccgtatggatcgcgacaaggcgctcgagaccgccatcgcacagatcgagaagcagttcggcaagggctccatcatgcgcatgggggagcaccccgagatggcgatcgagtccatcccgaccggcgcgatggcgctcgacctcgcgctcggcgtgggcggactgccccgtggccggatcgtcgagatctacgggccggagagctcgggcaagtcgaccctcgcactccacgtcgtcgccgaagcgcagcgtcagggaggtcggtgcgcctacatcgacgcggagcacgcactcgacccggtctatgcccaggccatcggtgtcgacgtcgaccagctgctcatcagccagcccgactacggtgagcaggccctcgagatcgcggacctgttgatccgttcgggttcgatcgacgtcgtcatcgtcgactcggtcgccgctctgacgcccaaggccgagatcgagggcgatatcggcgattcgcacgtcgggctccaggcgcgactcatgtcgcaggcgctccgcaagctcaccgccaacctctcgaagaccaacacgctcgcggtcttcatcaaccagctgcgcgagaagatcggtgtgatgtacggctcgcccgaggtcaccccgggtggtcgtgcgctcaagttctacagctcggtgcggctcgacatccggcgtgtggagtccatcaaggacggcgcggagatcgtcggctcccgtgcgcgggtgaaggtggtcaagaacaagtgtgcgccgccgttccgccaggcggagttcgacatcgcctacggcaaggggatctcgcgcgagggatcgctgctggacgttgcggtcgagatggggctcgtgaagaaggccggagcctggtacacctacgacggtgagcagctcggccaggggcgcgagaacgtcaaggccttcctcgctgcgaacccgcagctcatggccgaactcgacgtcaaggtgcgcgagcgggtggctgtggaccgtggagtcgccctgacgcacggcatcgtcgccgaggccgaggcgatcatcgaggactagcccctcctggggcggtggtcgggcgcgtagactcgtccccgcgatgccaagcagctacgtagtgcgcaccttcgggtgccagatgaacgagcacgactccgagcgcattgcgggcgtgctcgaggggctcgggctgacgcgtggcgacgatcccgcggacgcctcggtcgtggtcttcaacacctgcaccattcgggccaacgccgacgagcgtttcttcggtcaggtgaaccagctgcgagaggcacgtcgtcgcaatccgtcgatgcgcatcgtggtcgccgggtgcttggcgcaaggagaaggcgcaggactgctggagcgcgcgccccacgtcgacgtgatcgtcggcacgcaccaggttggccgcctcgctgagctcctcggtgcagccgatggggcggaggcggtggtggacgtccgtgagcccgagccgggcagcgtcggtctcgacgaccccacgccgtggggcgaggcggtgagcgaggagccctggcgagcgtgggtcacgatccaggtggggtgcgacaatcgctgcgcgttctgcatcgtgccgagggtgcgcggaccggaggcctcacgcccattcgatgcgatcgtcgccgaggtgcgcgaactggccgcacggggcgtgagcgaggtcaccttgctgggtcagaacgtgaactcgtacgggcgcgatctcgtgctcgcgatgcgtcgggccgaggacgagcgcgagcgggctcaggttgcgagtcgttcgggggtcgccttcctcggccagggcgtgcccagggtgcgtccgctgttcgcggatctcgtgcgcgcggtcggggcggtgccagggattcggcgggttcggttcacgtcgccgcaccccaaggacatgcgtaccgagaccttccaggccatggccgagaccccgacggtgtgcgagagcctgcactttccgctccagtcggggtcggatcggatccttgccgccatgcaccgcggctacagtgcggatcgcttcctcgccaagctcgccgaggctcgtgccacgatcgacgatctcgccgtctcgaccgacatcatcgtcggctttccgggcgagacagacgccgacttcgaggcgacgctcgaggtcgcggccgaggcggcgttcgatctcgcctacacgttcatctactctccccgcccgggtaccgaggcagcggccctcgtcgatcggttcgtcgacccggacgtggtgcacgagcgcttcgaccgcttggtgcgcgtcacggagcgctcggcggcagcggcccatcgtgccagggtcgggcgagacgaagagatcctcatcgaaggtccgagccgcaaggatccccggacggccaccgcgaggacgcgtcagcacaagctcgtccacattccggggctcgatgcgcgcgcgctcggggggcgctatgggcgcgcgaggatcgtcgacgcgcgggcacactatctgatcggcgagatcatcgacgtcgagcccggggagtcatcgctcgtcgtgccgtgagcgaaggtccgctcgaagaggagttcgccgcgtaccaggtctcgaccgatcccagcctcggtccacagccggaaggcaccatcggtagcctcgagtggcgtcgtgggctcgtcggcgccgtagtgcgacgagggtgcgagatcgcctggtcgatcgacgccaggcaggcttgccagggcgacggcgtgagctcggccgaccgcggtctcgtacatgccgccgaccagggcgtcgagtccttccgagcgggccctggcgaggatggcgagcgtcggctcccaaccgccgaggcgcgcgagcttgagattgagcgtcacccgtgcgccgagcgcgagcatcgtcgtgaggtcgcccggcccccgcagcgactcgtccaggcacaccggcgtgagggccgagcgagcgaactgggccaccgcgaccggatcgtcagggtcgatgggctgttcgagcagactgaagccgagccgatcgatggccgagagcgtgggatccgaggggtcgtcgaaggcaccgttcgcatcggcgacgaggtcgatcgtggtcggggtgagggtacgcgcctcggcgagcaggccgagcgacgtgtcgcgctcgatcttgagcttgatgcgccgatagccggcggcgatggcgcgctcgatcgcgccgaggacggcgtcgggctcgtcgatcccgagcgcgatccccgtcgggacggggtcgtctcggccgccgagcagcgcccagagcgggcggccggctcgacgagccgcgaggtcgtgggccgcttgcgacagggcggcgcgagccgcgcgatgcccgcgaatggtgtgcacgctccgtgcgaccgcctccggccggactctctcgaggcggggggcgagaaagcgctcgagcgcgaggagctcggtggcgagcgtctcggagtcgtaggttggctcctcgagcgcggcgagctcgccgagaccgtggacaccctcgtcgtcgacgagctcgaccagcacgcgcgccccgacgtggacgaccccatgggcgctgcggtgggggtcgcgttccagggagacgcgccagatgcgcagtccttcgctcatgcccggagcctacgtggccgacgtggctagcctgacaggagtgccgggacgtctcgcgatcgtcggcccgaccgggtcgggcaagaccagcctcgtcacgcgtgcggttcgtgacggactgctgcgcggtgtcgccgtcgtgtcggccgacgcgttcgccgtgtatcgaggactcgagatcacggcctgggctccgggtgacgatgaccgcgctgggatcgactaccacctcctcggcacggtcgacgtcgccgaggaggtctcgctcgcgtggttcctcggtgcactcagtgtgatcgaggccgagcgggccggtggcggggtccttctcgtcggcgggacgtcgctgtgggtccggagcgcggtgaacggcctcgcaccgccgccccaggcgcctggtcttcggcggtggttggaggctcgcgcgaccgatccccacggcgtcgccgcgctcgtgtccttgctcagagtcgtcgatcccgccgcggcctcggggatcgacggacccaacgcacgccgtgtggtccgcgcgctcgaggtggcgctcgcgagcggcggtgcgcgcagcgtggctggagaggcgctccgcgccacggcgccggcgcgctacgtgcagatcgggcttcgccgtggcgaagcagcgctgcgtcgggccatcgaggctcgtgtggaggcccagctcgccgcgggctggctggccgagatcgaacggatcgggccgatcgcctcgcgcacggctcgtcaggcgatcggcgttcgcgagctcaccgaggtcatcgagggccgacggacgctcgctgaagctcgagcggccatcgtccgacgcacctggcggctcgtacgacgtcagcgggcctggctcgagcgcgatccgcgcattcgctgggccgacagcgtcgacgaggccctctcggcgatcgcgggagcggtggaggaggcggcgtgaggctgaccaagctcgtcggggcgggcaacgacttcctcgtgaccaccgatccggacgagacggcgcggctcgagccgagcgtcgtcgtggccctgtgcgatcgccgcaacggcgtcggtgccgacggggtgattggtctggatgcgcacgacgccatggtgctctacaacgccgatgggtcgagggccgagatgagcgggaacggcctgcgctgtctcgggcacctcgtcaccgaggagcgaggcgtgggcgaggtggcgttcgagaccgacgctggccggcggatctatcggcgcgtcgggcgtgagggaggcagcgtcctcggggcgaccaccatgggtccggtcagcgtgcgggcgaacgagcgcggttggttcgtcgacgccggcaacccgcacgaggtgcgccagctcgcgagcccgcaggagcttgcgagcctcgacgtggcgagcctcggtcgttgcgcccaggcgcactaccctcagggggtgaacgtggagtgggccgtggtgctcgcgccggacgaggtggtgatgcgggtgttcgagcgtggcgtcggtgagacggaggcctgtggtaccggatcgacggccgtcgcggtggcgctcgcgtccgcagggctcgtcgagcgcacgtcggtgcgggtgcgcaacccgggcggggcactcacggtcgaggtcaccgagccagagcctgtcctcgtgggtccgagccgcctcgtcgcctccgtcgacgtcgacgtggaggcgcttcgcgcgtgacgctgatcgagcgctcgttccgcgagcgcatcttgctcgtcggcgtcgtccaccatggcgagcgtcgcgaagcggtcgaggactcccttgccgagctcgccgcgttggtcgacaccgcgggcgctgacgtcgtggatcgagagctcgtgcgtcgtgacgcggtggatccggcgacctacgtgggctcgggcaaggctgctgaactcgcggagcgctccgaggccctcgacgtcgacaccgtcgtctttgacgacccactctcgccggcccaacagcgcaacctcgagcggatcctcggacgcacggcgatcgaccgcacggccgtcatcctggacgtgttcgcgcagaacgcccgcagcgaggaaggacgtcgccaggtggagctcgccctgctctcgtaccggttgccacggcttcgcggtcggggggtggcgctgtcgcagcaggtcgggcgcatcgggactcgaggtcctggcgagaccaagctcgaggaggatcgtcgtcgtatccaggctcgtatggcgcaactacgccgtgagctcgaccagctcgccaggcgtcggttggtgcagcggcgagcgcggctcgcgtcgcgccaggcgcaggttgccctcgtcggctacaccaacgtcggcaagtcggccttgttgcgggcgctgtcgggtgcggacgtgctcgtcgagaaccggctgttcgccaccttggatccccggacccgtcgggtggcgctcccgggaggcgagacgatcctcgtcaccgacaccgtgggcttcatccgcaagctgccccacgagctcatcgagtcgttccgttcgacgctcgaacaggtggccgaggccgatctgctcctgcacgtcgccgacgcatccagtcctgacgtcgcggcccagatcgctgaggtcgaacgcaccctcgccgagatcggtgccgatcgcgtgccgcggctcgtcgtctacaacaaggtcgaccttcggccgatcgacacgctcgctgctggcgtccccgaaggagtcgcgatctcggccgagcacgacatcggcctcgacgacctgcgtgctgccatcgccgcggcgctcgatgcgatgcggcgtccgcgtcgctacgtggttccggctgggcggggtgacgtgctcgcgctcatccatcgcgagggtgccgtcgtgcgagaggaggtggatgcggagcgggtgctcatcgacgcggtgctcgacgatgcctccgatcggctggtccgccgggcgctcggagaggcgccacctgagccgctagggtgaggcggtgtcgcagcgcccctcccgcgtcgagctcaccgcgctcgcagccgatcggcacccgttcgtcgtcgatgcgtccatcggctcgcccgtcgatccgcccccagcgttcgtcccgcacctgctcgcgtgccagggggaggagcgtgcgtacccgccagcggcagggacgcccgcactcgtggagtcggcgacgcgctggttccacgcgctgcggggggtgacgctccccgacggcgcggtcgcgccgaccatggggtccaaggaggccatcggtacgctggcgtggttgcttcgggagcgccgacccgatcggggggtcgtgctcatccccgggcgcgcctaccccacctacgccgagggagcgcgggcggccggctgtgagatcgtgcgggtcccggacgactgctcgggtgctcctgccttcgacgccgtggctgcgtccgtgtgggatcgcacgttggtcgcgtgggtcaactcgccgtcgaatccgaccggtgcggtctatgacccggggccggtcgtcgccctcgcccgcgagcacggtgcggtgctggcctcggacgaggcctacggcgacttcgtgtggtcgggggaggccccgagcgcgctgcgcgcggggctcgagggcacgctcgcgctcgtgtcgctctcgaagcgctccaacctggccgggctgcggctcggtctcgtggcgggcgaccccatgctcgtggacgaggtggtcgcgcgccgacgcgcgctcggcctcttggcctcagggccctcccaagcagtggcggccgaggcgctcgccgacgagggtcacgtcgccgagcagcgctcgcgctacgctgggcggctgcgccgcttggcccgggtcatcgaggcggtcgccgacgtcccggtgcgcgtacccgatggcggcatctacctctgggtccgcgctcccgacgacgacggggcggcgttcgccaggtggctcgcgacgcgcctcgggatcgtcgtcgccgacggtgccgactacggcgatcgtgcgttcgtgcgcattgcggcgacggtgaaggatcgggcgatcgatgccctgtgggagcggggaggagtgcgatgaccgaggacgcgcgtgcggccagcgtgcatggcgcgttcgcacatggcgaaccgatcgataccgcggtgctcgtctcggtgttcgaggacctcgagcgcggcgcgctgcgggtggcctccgtcgactgggacgagggccgggtggtggtgcacgagtgggtcaaggaggcgatcctgctctcgttcggccactggccactcgtggagtccgaggccggcccgctcacctgggtcgatcgcatcccgctgcggcgcgatctcgccgaagcgcgggtacgtgcggtgcccggggcgatcgtgcggcgagggacctatctcggcgcgggtgtcacgctcatgccgagcttcgtgaacgtcggcgcctcggtcggtgagtcgacgatggtggacacctgggccacggtgggctcgtgtgcccagatcggcgcccgtgtccacctctcgggaggcgtgggcatcggcggggtcctcgagccgccgcaggccgctcccgtcgtggtgggtgacgacgccttcgtcggctcgcgcgcgatcgtggtcgagggctcgatcgtcgggcggggcgcggtggtggccgccggggcggtggtgaccccgacgattccgatcatcgacgtcgccaccggcgacgagcttgagcgcggcagggtgcccgactggtcggtcgttgtgcccggcacgcgagagcgccgttggcccggtgggaccttcggcctcgcggctctgctcgtgatcgcgcggctgcccgagggggagcgccacgagaaggccgcgctgaacgacctcctgcgcgcgcacggcggagccctgtgagggacccggtcgagctcgcggcggcctacctcgaggttccctccgtcaccggcgacgaggcggcgctcgctcggctcgtcggtgagcacctcgatgcggcggggcttcgagtcgaggtggtggcgggctgcgtcgtggctcgcaaccacggcggggactcctcggcgacgctgctcgtcggccatctcgacaccgttcccggtgagctccctgtcgccgtcgacgaactggtgttgcgtggacggggtgccgtcgacatgaaggcagggctcgcggtcgcggtggcgctggcgtgctcggagccctccgtgcccgtgaccgtcgtcgcctatccgggcgaggagggtccgatcacaggcaacgggctcgcgcacctcgtggccgagcgccccgaactcctcgcgggtgctcgcggcgtgctcctcgaacccacgggtgggttcctcgagctggggtgccaaggggtcgtgcgcgcgacgctccgactgcgtgggcgtcgagcccacgttgctcgagcctggatgggccgcaacgccatcgatcgggtcggcgaggcgctcgggacgcttcgcgccctggaacgtcgcgaaccccagatcggcccggtgcgctaccgcgaggcgatcgaggtcgtcggggtgcgtgggggcgttgcatggaacgtcgtgccggacctcgtcgagatcgacgtgagctatcggttcgcccccgacctcgatgctgcccgggcgcgccagcgcctcgaggaggccgtgcgtcccgtgatggacgacggtgatgacctcgaggtcgccgaggccgtgccgggcgcggtgagtgacctcggtcggttcggcgcactgcgcagcggcgcgttcggcgtgcgtgccaagctcggctggaccgacgtcgcccaactcgtcgcggcgggcgtgccggcggtgaacttcggaccgggggatccagaacttgcccacacggatcaggagatggtcgaggtggccgaggtgcgccacgtcgcccaggcgctgtggcggtggttgcacgcctaggacgatggttcgcctcttccgatggcgagtgaggccagacctcggactcgcgatgcgggtcgaggtggaggtgaggaggcccatccctgggcgaagggtcgctctcgagcacctccgatgcagtgtctgagcgcagccggtctggcccgccgtgtgctcgggcgtggtggggcaggcagatgggcgtgggcctgtggcgcccgacgccgtaggtcggggtgaggtgccccagatttcgtagacacccaggttacttcacgcgagcctcctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatcccgtgtcgggcacagaaggccacaactcgatggtcgctgaactgactccctcggtcggtgtgccagatgaccccctgcgcgtgggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccggcgatgccgcgcctggccatcgctgctgccaccgtgttgtggctcgtcaccacgccagcggcgaggagtgccgccgtgatccgtcgtgcgccgtaggtgccagaggatgcctggtggaccgcgaccactcggttctcgaggtcgcgtcttgcacatgcccgacgcgacggtgctacctgggtgcgtcgccatcggtagtagccagcccgggagacctcgagtaagcgtgccatccgtttgatctcgaagcgagcgtactccgcctccatcagcgcgaatctctcttgcttggtggcttcgcggcgaagtacgcggctgcttttcccaggaactcgttgtccttgcgcagctcctcgagctccctgcgcagcctgatgagctcggtgcgctcctgcgccgtgaggggcgggctgccagtggcgtttgctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggggcggctcaggggaccaatgtgcgcgctggtcgggtcgaggtggcggcaggcatgaggttgcgatggccacgactggatcgagggggacgagatcgtctgtcagttgcgctgcttcgaacgcctcgagcgcgttcacggtgaccttcggcgcctcggtccccgttgcgtgctgtggaggtgctcgaggacgcgatcggcgccgtccacggcttcacgatgccggggacgcgcatcccgtgggtcgattgcgcgccgtggtgatcggtgtcgcaaccgagtccgccgttgccgtgagctcggcaccctcgtgtgagtgctcgctgctcatcgcgggcacctaggagaggggcgcgtgtcgccaggcgagccgggccagcgagggctgccgcgggtcggcaacgtgaggcgctcgagggggcgagtcggtcgagagcgccctggttcgtgtggcccggctgggtgtcggtcttctcgtgggggtgcgcgcctcgtgcggcgagctctggtgcttcccaaccgggagcgccggacgtggctgagcgttcgagagcccgcacaccgtgtcctacgggagctgcacgagcggcgggccagcaggtcacctcgtactcggccgcccgcgtgggcgagcgaggtggccgcgatggcaaggtcctcgcggcgattggcgccacgctcggaccccggccctctccgctcggtgccgaacccatcgaaggtcgcacgatgctgcgcgtccatccgagccgaccgccacacgggtgtggtcgtcctcctccttcggcgctccttcggcgttggctggcccagcaacggcggcgcgatcgcgaccgaggcgcgggtaacgttcgcccgaggccagaacgaggagggtcggagcgatgttggagggcacggtcgtgacggtgctcttcgaactgcacgctgaggggctcggctatcgcgagatcgcccgccgcacgggcatctcccgcaacacggtgcggcgctacctgcgcgacggcgcgagcgcgggacaggtcactcgtccccggcgccgctccaagctggatcccttcaagcccgagatcgatcgcctggtggcggacgggctcacctcggccccggccatcacggaacggctcaaggagctgggctacaccggcaaggtcaccatcgtgcgcgattacgtgcgtaccatccgtcagggtgcatcgcgcggggcgtgacccgcgccgccatgcgagccaagggtttcggcggtcgtcgtcgtatcgtgttcgcggaggggatggccggctcccgaagccgagtccatctcgcatgtgaggcccggcggtagggtcgtgcgggcgccatgtgcatctgtgggggatcctcgtctggtcgacaggccccggtggcgtgcggcatcgtgcgcttcgtcgggtgcacgcagcgggagggcggcagcccgaggcgttcggcttgcgggcgtggtccttgcagcagccgggtcggcgcagctcgcgtgtcgtcaacgctgtggtgcgggtgccgtcgcgctggtgcgagcgcgttcggatctcctcggatctcgtcgacgaacaccggtgctgggtcttgcgcccgtcggcgcgaggcgtcgtcggcccgacgcacaatcctcacggcgcggccggacgctctggcaccgctcaggcgatgggggcgttcatggggaactggagggcgaagcggcctcgtggcgcgtcgcatggactgctcgctgggcgatgggatcggttggcgatgtcctcgtggtcctcgagcaggtcggaacggtgcaaggcatgccgacccgtcggacacagcacctgcagcggcagggctaagccaggggcgcgagcacgtacctggacgctccttggcgagcagccggcggcctggtcagggtgcctggttggcgaactgtgcgtcgacgacctggctcattggcatcggcgtgtggtagtcgaggttgccggcgccgaggtagaccgactgcatggaggagagcaccgacgattggggtgcgagggttggggagaagacgttcggcggctccgagcgcagcagcgagagcgattcgccggtcgccttggcgatgatggcgaggttggcggcgctggtggcggccgacccttggaggtcttgcgcgcccttggcgagcgcgtcgaagaagcgttgggcggccgacgtgtggatgaagctgcccccgtagatgatgccggtgacggcgatcccaacgggagcccctgcaagcaccgtgccttggtgctgcgcgacggccgcttggaggaacggtgtcgccatgtaggccgcagcgacgccgccgttcgcgagagcggcgccttgttcggggaagttgacgttgaccaaggtgacgcgagcgagcgagaggtgtgccttctcgagcgcgagcgcggtgaggtaggcgcccgcggagccctggccacctgcgaccgcaatgcgctggccggcgagctgggagagcgaggtgatgtgagcggccgccgaacccaccaggccgttagcggcggcgcccggcgcctcctcggccatggagccaacgacgcggacgtcgaggccctggtggatggcgttgaagaggccggcgctgaagccgccgaggacgacctggacccggttcgtcgccgccagcgtgatcgcgctctggccgttggcgacgacttggaggttcaccttgatgtgctcggcggcgaagtagccgtgtgcttcggcgacgaagagcggtgcgaagagggggagcgggacataagccaccgtcaccgtggtgggggcggtcgatgaggtggtggtcgacgaggtgctcgtggtcgagccacacgctgccgctgtcaatccgagagccgctgtgagcgcgagagcgcgacgatggcgacgttgcatggatccccccttggtgcaagctgaggggatgctagcgtgcccgccgtctggtccagggcagcacgagccgttcgacgccaacgacgatcccggtcgcgacgacgccgaggagggcgatcacgacgaggccgacgtacatgtcggcaggttcgaacagctgccacgagttccagacgaggtagccgagccccgagttggccgcgacgaactccgtggccgtcacgaccaccagcgcgagcgcgaccgcgacgcgaagccccgtgaagatgccgggtgcggtcgcgggcacgagcacgtgcacgaagcggcgccagcgcgtggcgccgtaggcttgtccggcctcgaggagttctggcggtacgcgtcggacggcccccagcgtgttgagctcgacgacgaagaacgtcactgccgcgacggtgatgatcttcgcggtctcgcccaggccgaagatcaccagcagcaggggcaggagcgcgatctggggtaccgcgtagagcgcggcgaacagcggtgagagcgccgagcgcagcggacggacgaccccgagagcgaggccgacgacgaccccgaggaccgcgccgatgacgtagccgacggcaaggcgcgccgtcgtgatcccgagatcggcgccgagggtgccgttcgtggccaagctgccggcggtgcgcacgatgtcgctcggcggggtgaagatccgggtgtcgatcgcgtgtgtggaggcggcgatctgccacgccaccagcagcacgatgggggtggcgataccgagggccacgtcggcggcgcgagctcggcgagcactgcggcgtgcgccgcggacggcgagttcgctctgggtggtcacgagggggctcccatcgaggctcgcacctcggtctcgaggcgcgaccagagtgcgtggcgcagcgaggtgaacgcctcggtgtcgagcatcgcttcgtcgcgtggtcgtgggagtgggacgtcgaagacgtcggcgatgcggccgggcctcgcggtcatcgcgacgacgcgatcgccgagccagatcgcctcctcgagcgagtgcgtaacgagcaccatcgtgaccccggtctcctcgtagaggcgtgcgaggtcttgctggaccaccaggcgcgtctgggggtcgagggcgccgagcggctcgtccatgaggagcagcgcggggtcggtgacgagcgcccgagcgagcgagagccgttggcgcatgccgcccgagagttcgtctggccaggcatcggcgacgcccgcgaggccgaggcgctcgagccagcccatcgcccgccggcggcgctcggctcgtccgatccccgccatgcgcaggccgaaggcagcgttgtcgacgaccctgagccacggaaacagcgagtggtcctggaagacgaaggcgatgcgcgaccggaccgaggggtcgatctcgagcgttccggtcgtcgcggcggacaggcccccgatgatcctcagcagcgtggacttcccgcatcccgagggaccgatgatggagaggaatcccccggggggcacctcgaggtcgacgccaccgagggcctcacgcgcgcgtcctcggtcgtcgacgaagaccttgccgatcccggccgccttgacgagcgccgtcgctgtcgcgggcgcttcgtggggcgcctcgttgcgatgatcccccatggtggaggggatgctagcggacggcggcgccgtcgtaggagcgcagcacgccgacgacccttccatgcaggtggcaggtctcgttccacggcatcggcgcgagcgagggatcgtcctcgttggccccctcgagccacaccgagctcccgttgcgccgcaggatcttcaccgtgccgacgtcgtcaccgacggaggcgaccacgatgtcgccgtcagcggcgacatcgctcggggcgacgacgacgaggtcgccatcgaggatgccgacgtcgaccatcgagtggccacgcacccgcagtgcgaacgcaccgggcgcggccatggatgcgggcaccgcgaccgacgtctcgacctcgacctctggcaccacgtggtagccggctccgacctcggcgagcaccggtaccgcagccgatggcgcccgtcgggcaacgctcaggctgcgagccttcaacggtgagcgcacgaggcgtccgtcgcgttcgagtcgacgaaggtggtgctggacgcttgccggcgacttgagaccgaccgcatcggcgatctcgcgtaccgatggagcccaacctcgctcctcgacgacctgggtgacgtaggccagaatcgcctcgcgcacctcggggttctcgcgtgtcatgctgcgccctcctctcctgcagtgtactcaaacgcacgttcgcacgcaaccgatgagcgatcgcgcgttcggccaggtaggctcgctggaagagcccgagtgaggtggcgtgcgctgtcccttctgcggcaccaacgaagatcgcgtcgtcgagacgcgggtcgctgacgacggcgcggcgatccggcggcgacgcgagtgccttggttgcggtcgacgcttcacgacatttgagcgcatcaccgaggcgcgtgtcttggttcgcaagcgctcgggccagctcgagccgttcgaccgcgacaagctgcggcgcggggtgcaggctgcgctgaagaatcgccccatcggtgccctcgagatcgagcgcctgttggccgaggtcgaggaggcggtgcgggcggtcgacgaggtggagtcggcggagctcggtctgcgggtcctcgagggcctccgtcaactcgatccggtcgcctacgtgcgctttgcgagtgtgtaccagaacttcaccgatgccgacgactttcggcgcgtgctcgccgacctcggtccgaagcgcatcgcgaaggttcgccccgagggccaggcgcgatgacgttgatcctgacgaggaggtagtgatcatggcgggacgtatcgtcacggcggagctgaccatcgcagcccctgccgacacgatcttcgacgtgctagcgcgccctgcgctccatccggtgctcgacggctcgggcaccgtgcgcggtgtgctcaccggccctgagcgcctctcgctgggcgcccgcttcggcatgcggatgcgcctcgtcgtcccgtacgtgatgtggaatcgcgtcgtcgcgttcgacgagggccgcgagatcgcatgggcgcacctgggtcgccacatctggcgctaccgtctgacgccggagggtgagcagctcacgcgagtggtcgagtcgttcgagtgggacgatgcacccctgcgcctcgtgtacgagatgaccggcgtcccggagcggaacgcgctggcgatgcgcctctctctggcgcgtctcgaggcgctcgtcacgggagagaggcgggcggagggcggccagagcgcctgagtcgccctgatgccgctcctagcggactggggggagacggaggccgaccgctctgaccggctcgtccgcaccgaggaagagctcttcgacgtcggggccgcactcgcccgactcgaagcggcacgactcgcggcctcgactccactcggcgaccatgaggaggcgaagcgcaccgcgcgcgagcgcacccgggcgccctaccgaggcatgctggagcggctgctcgaacgggtcctcggcgagcgggtggaggtcgcgctcgacgaggaactcgacgttctggggatccgacgcccaggccgcggccaagggctcctcccctgagccagctgtgggccggcaccggggagcggtccgtgctctgcgtgcgtggtcgcgacccgcctgagcagggggcgtcggttctcctcgacggcgtgcttaccctctcggacgcccagcagggccgccggttcgtcgccgagctcgaggcctcgccgaggacggccaaggaatcgtcttcacggcgtaccccgatcgctacccggcatgggcccgcagggtcggaccgccgcccccgtcaaccacgccaccaccgcacggtcggggcgcctgtcccgctctgagctcgtcgaggcgatctggctcgagctcggcgtcgcgggccggctgctgccccagctgcgggaggagagcttcgtggcccaggagggggccggcgcggcctgcgctagcggtcaacaggggaatgttcactacactaagtcgaggacgtggcggggaatggctcgacgttgcggcaacgcgagctttccgtgccacagtgcgctcggggaagccgaacgggcccgtcttgggtgcggggaggagtgccgccatggccgagagtcgctcgttccgacggtccttcggacggtcgctggggtggtggctcgggttcgctgcggccgtcgtgggcgcaggtgcggggggctacgcgctcggggcgacgtcgcaaccaatgcgtagaggggcgcccagtacctcgcgcgcgcaccctcgtactacgacgacgccccctcctgcgcagtcggggtcctcggtgccgaagggcgtctcgggtggctcgcaggtgcctggcgcgacggggctctacgtggacggcggtgctggtaccccccactatgtcctcgcttggcacctcggtcccgacggcgcgatcagtggcgccgtcgactacgtgtaccaggatgggcagacctcggttgtcttcaccttcacgggccagctcgatggctccgacaccgtcgcgacgctgacgccccacacgatcccccaggggaccggctcggcctcccagccgcccgggacggtaccggccgcgatctcggcgaccctgtcgacgtcctcgatccagctcggggagtgcaccacctacctgcatttcgcgccgaacgaggctgcgtgcacattcctcgcatcctctagcctgcagtgaccggcaggccgtccgggttccctccctggaggcggcctcggccaggagctcgatgcccccccgtccctgagtgcggaccccctcaaggtcaccgagccgctcgaggccacgcacctgctggggccaggcggggttgcaactgttgagacgtaactgtgttctcacaagggatccgaatgtgtgcaggttcaattcgaccggtggtgaggtgccccagatttcgtagacacccaggttacttcacgcgagcctcctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatcccgtgtcgggcacagaaggccacaactcgatggtcgctgaactgactccctcggtcggtgtgccagatgaccccctgcgcgtgggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccggcgatgccgcgcctggccatcgctgctgccaccgtgttgtggctcgtcaccacgccagcggcgaggagtgccgccgtgatccgtcgtgcgccgtaggtgccagaggatgcctggtggaccgcgaccactcggttctcgaggtcgcgtcttgcacatgcccgacgcgacggtgctacctgggtgcgtcgccatcggtagtagccagcccgggagacctcgagtaagcgtgccatccgtttgatctcgaagcgagcgtactccgcctccatcagcgcgaatctctcttgcttggtggcttcgcggcgaagtacgcggctgcttttcccaggaactcgttgtccttgcgcagctcctcgagctccctgcgcagcctgatgagctcggtgcgctcctgcgccgtgaggggcgggctgccagtggcgtttgctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggggcggctcatggcgaggcctactaagcgagtcgcagatccccgttactccctaggggatcgatgtgtgggaagcggcttgcgtagggtgaccgccccccaaatcgagtccactctcaatgtgagaccccatatcttcaggctgccgctcgctcgtcctctcgggcgccgatcatctcgagcgcgtagaacttccggctcctcgccgaggccgcgaggatccgcggctccggtggcgacgtcgagctcgattgagcttccccccatttgcttgacagtctgaatttaggccacggccgcctccgcacgggcccaggagagctcgtactcgacgggcggtaggtacccgaggctcgagtgcagccacagggacaacaggtgttgcgacgatcgattgcaatcacccaccacagccatcgatgccactccgcaagcggaacggcctagggacggcgtcgacgggccgcgagccgcaacttgatccgatgtccggaagcggatcctcggctgcggctgccgactcaggtggccacgacctcaaccgatggtgcaccgcggagtcggcggtcggtcgtcaccagcggtacgccgcgggagacggccagttcgatatagatcgcgtcgaccagccgaagctcttggcgacgggcccaggtcccgaggaggagatcgtggacgggatgccgctcgatcggtgctgcggccagctcgcgaagcttgacctcgacggtgcctgcatcgaggctgtctgctcgatgcaggcgtcccagggccgacaagacttctgcgtcgacgtgcgccggtgcgtgcaaggcgtgaccagcgatgcgacgccgcaccgcacgaccgagctcattgtccagcagaagatcgaccagagcggatgcgtcgacgacggcctcagccatgccgcgtcggtgcttcgtccctcgcggcgtcgagcgctgcaagcgcgcgctcatgtgacactcgcgcaatcgggctcgccagcgttgcaagccaggcatctgtcgagcgcgacgccaggcttcgccggaccgcctcctgggtcaccgcagacaaattcaagccggccttcctcgcttgtgccgcaagatcgtccggcaggtacacgttcactcgagccacaccacacaatatacacacttgcgctacggtgcgctccgcaagccgatcggtcaccgacccgactacccgcgacgcttcgcctgctacgacgacgcacgagcctggtgcgagcgcttccttcgctggtaccaccacgagcaccggtcacgtgcgggatcggactccacgccgtggccgacgcgcaccacgggcgtgccgtggagctccgagcacaccgggcagcggtgccgttgaccgcctcccagatggctcggagctcgctgacgagcaccaggtgctctgggtcctcgcttcggtctttgcggtgtcgccaggggtcgtacgcctggcgagagactcgatgactcgtgctagcgctgctatcgagaagccattggcctcctggcgggcaatcggagtggtagcggctcactgccccccctccctcaccgagtgggcgatccctcgctccgccagctcgagttccatgatgagctgtgtgacctgacggcgcagccgggtcagctcttcgcgctcggcgcctgtgagaccttcgagctcacctcggtcgatccgctcctgacgcacccagttgccaagggtctgctcattcacgccgagttcgcgggcaacgtcagcgatggttcggtgctggtcgagcaccaacgctgcggcatccttgcggaactggctcgggtaacggcctcgtcgtcgacgaacgggggcctcgcgcggtggtggattcggtgtctggctcatcccttcctcctagagcaggtgtcgctttggagggggaggccacaccgtcctgccgcactcgacgcttgagtacctaccgccgttcgagtacgagctcacctgggcccgcgaggaggtggccgaggcctcaacccagactgtcaagcaaatgggcgaaacccagagggccgtcgagggggccctggacgggcgcgcggcgtagcctggcacctgtgtccatcgacctgcgctccgatacggtgacccagcccacagacgctatgcgtcgtgccatggcctctgctcgttgtggggacgacggctacggcgaggacccgacggtccgcgaactggaggagcgtgcggcggggctcctcgggatggaggcggcgctcttcgtggcttccggcacgatggccaatcaagtggcgctgcgaaccctcacgacgccaggttcggtggtcgtggtcggggcccgggcccacctgtgccagttcgagcgtggcgcgagcgctcgtaatgcgctcgtgcagctccacaccctggccgacgacgacggagcgccgacggccgatgcggtggccgatgcggtggcgacctatcgtgcgattggggttcagccagccctcatcgcgatcgagaacacgcacatgccctcaggcggaacccctctcgatccggtgcgcaccggcgctcttgccgatgcggcgacggcgacgccgctctacatcgacggcgcacgactctggaatgcttcggtggcgctcggggtcgagccgagtgtgctcaccgagcgcgccaccgcggtgtcgacgtgcttctcgaagggtctgggggcgccgatgggttcggtcgtggccggatcggctgacctcgtcgagcgtgcgcggtgggagcgccaggcgctcggcggtcgcctgcgccaagctgggatcatcgccgccgcagccctcgtcgccctcgacgagtggcgaagcgtccttgcccgagaccatgagcgagcggccgtgctgcgcgaccgtgtggcggcagagctcggtgatgcccgcgtgcgctggggcgggacgaacatggtgctcgtcgatgccgatcgcccggtcgagatgctcgcccgccttcgtgaagcgggcgtcttggccaacgccatcggacctcggacgctgcgcttcgtcgtccatcgggatctcagcgatgccgaggtgaccgtcgccggtaccacgatcgcccaggtcgtgtcgtgatggagcctcagcgaccatgacggtagagatctacgagccggcggcgagcgtcgccctcgcctgctttgcccacccggacgacgccgaggtgctctgcggggggacgctcgcgcgactcgcggcccagggagcacgggtcgtgctggtcgtggcgacccgcggcgacaaggggctcgcgcgggtggacgacgccgaggagcgccgcaccggtgaactgctcgaagcggccgccatccttgccatcgccgacgtcgtccagctgcgctatggtgacggcgatctctccaacgacctcgagctgcgtcggcggctcgtgaccgtgctccggtccttcgctccgcagctcgtcctcggtcccgaccccacgacggtcttctacggcggacggctctacaaccatcgtgaccaccgcgagctcggctgggcactcctcgacgccgccttgccggccgcgagtcagccgggttacttccccgaagcgggcgagccgatcggaccgctcgaggtcctccttgccggttcggaggagcccaacagcgcggtcgacgtctcggcgtacctcgaacgcaaggtggaggcggtacgtcaataccggagtcgcctcggcgccgccgacggcgtcctcgccgatgcggtggtcggccgtgccgtggacgcggcgcgcagcgtcggcattccgggcgcggcggaactgtttcgcagggtcgagggcgcaggttgaggggaggggcgatggtcgagatcgaggttcgaggcccgggtcaccacgagcgcagcacactggcggctcgagcggtcgcggtgctcgcgggcgcggggctcgacgtgggtgtggtcgtcgacgttcgtccgcggctcgccgcggacatcgaggcccagctcgaggcaggtgcggcacgcgtcgtgctcactggccccggcttctcggcggtggcacgtaccggtcgtgagggcgtggaggaggcactctccgaaggcgacgtgctgatccgactgcgtgccaccgccgacgaactcggggtctacggggtcgacgatgcgctcgggcaggaatgggtccgtcgcctccgcgatgcgggtgtgccctgtatggggcctgagatcggggtctgagcgtcccggaatcggcggtggaacgggagcgttggggttttcgacgacgagccgaggcactagaatcatgacagatcaagcctcggtttggtctgtcggcgtcgaggaggacggatggcgctgaacgaagaggagcaacggattcttcaggaaatcgagcgctccttctacgagagtgaccccgccttcgccgatcgcgtccgctcggagaccgtgtaccggcatgctggacgcaacctcaagtgggcgatcgcggcgttcgtcgtgggactcgccttcaccatcctcaccttcacaacgtcggtgatcctcggcgcagtcggcttcttggtcatgctgggagccgcgtacgccttcgagcgcaacgtccgtcgtatcggtcgggcgtccctgagcgacatggcgcgctctggtcgcggcccgttcgggtccatcggtcggcgtttcaaccgcccggacgactcgcaatgagcgctgctcgcgctgcggacggggtcgttcgaggcctccgtgtgtccgtggcgcgagaggcactccgacaggtctgggcgctgaccttcggctctcgtgggaacccgtggcgcccgggagccgttcgcacgtacctcggcatgcggcacgaggcctttggggcgcgaccgtcgttgcgccagatcgtgcgctatctcgcgtgggccgcggaggagcgtcgcgcctggaggatgcggtgagcgcgcgtgtccatctgagagcggccagaggctgaggctcgcatgactgccggggtcctcgtgctcaacgcctcgtatgaggccctcggtgtcgtcagtgtcgagcgtgcggtcgggatggtggtcgacggggacgtcgacgtcgtggacgtcaccgacctcgtgctccactcgccgtcgacggcgattcgtgttccttcgatcctgcgtctccagcgctacgtgcggataccggcgacgcgtcggatcgcaccaacgcggcgcgccatcttcgcacgcgatggttatcgctgtcagtactgcggggggcctgccgagaacgtcgaccacgtcatcccgcgcagccgtggcggccgacacgtctgggagaacgtggtcgccgcgtgccgtgcctgcaacgctgccaagagcgatcggctgccggccgaggcggggatgcaccctcgacgcgagcctcgtgcgccggccgcgcgtactggttggttgctcaccgttggggtgcgtcggcccgagtgggagccgtaccttcgagcggcctggggagactcagctcgggatctcttgcttggcggcggcgacgatggccgtgagcttgctcgccgggaagagcggactcacgctcactcgcgcgctgcccggtagggcgtttgcgatggtcacgacacctcgagcggtgtcgtaggcgcgcgggacatcagtgccgaccacgaggaaggccgcccgggcacgtgggccgagccgcagtgaggtcgatgcgaggaggatctgatggttcgaggtcccgacccgcacgatctcgttgggcagcggcgctccgaccggcaggtagaagcccccgaccgagcagctcgtcgcgctcgtgttctcaaccgagacgacggcgaggtcgtcacctgtgcgggtgcgcgagagctcgatcacgcttccgtggaggaccgatgcagggcaggtcgcgtcgtaggcctggcggtgggctcgctggccgaggacgacgccgagcaccggcccgccgatgagcgcgatcgctgcgagcgcaatgggcacgcggagcgcacgaacgggcgcgcgcacgccttgtgccatgggtccctccctgtgtgtaagccccgacgagcgctcgtgcgcgacccgcatgtcgctcgccatggtcgataggctaggcccgtggagcgagtaccgcctcctgtcgtcctccccatcggcgtcgcggtcgcctctgggctcgcgcgcgtcgatcggctgccctcccgtctgcggcgatcgatcggcggcgccttgctcgtggctggggccggtctggctggttgggcggcgttgaccatggaggcgagcggaacgtccccggatcctcgcaagcccccggaggcactggtcagttctgggccgtatcggtttacgaggaacccgatctatctcggcatgctgagtgcgcaggccggcgcggcgttcatcaccgctcgcccatcgctggtgttcggggccctcgtcgcgggcgtgttcctcgaccagttcgtcattgcacgcgaggaacgtgaactcgccgagcgcttcggcgatgcctacgccgaggtcgtcgctcggacgcctcggtggctcgtgcgccggtgatctgccaccacgaatggcagtgtcaagatcgagaacaacaacagtgcgaccgggacggcgctcacgatgtaccagggccaggggccgagcagcgacagcatggtgtgctcggcgggtggtcgacgcaggaacatatagtccgcgccggttgcccagtcgatgaggccgtcgaaggccgtgtaggcgatcgagatggcaaggacacgccagggagcgctcggtcgaggatggatgccacgaccgatcgtcaggtagaaggccgccacgacgacaccgacatggccgacgaggtactcgaagaacacgaggtgggggaagcgaaccgcaaggtctggggtgatgatcgcctgcagcgtgccggcgatgccccagagccagaccacttcgacgagccagcgtcggggtacgacgcacgcgatcgcagcgatgaacgcagccgcgtcacacagcgagagcggcagattcgctgccagggaggcgtgcggtgcgagggcgacggcgaccgcgtcgctcgcggcgtccgctgcgatggcgatggcgatgatccatcccacccagtgggcggcgcgtggtgatcgacgcgaggccgcgatgccgatggcgccggcgacgccaagcacgccaaccgtggcgagatacggacctgtggtaggtgcgatcggcgtgctcatcgtggtgctcgtgccattctcgtcaccttcgatgctactcatcgtggcccttggtgtcggagaggctcgttcgcttcgccgcgctcgctttcaggcttgccgatcatgctcatgggccttcagtaggcgtcgctggtgggatgccgagggatcctccaatggctgtggtgacgccatcgccacggttagcccagcgacgggagcctgtgcgtcggttgatcgcgcatacagatgcaggtgccgctggcgcacaacgccgggagtcagtcgttgcccctcgatgctggtggccacctgggcttccccccatttgcttgacagtctgaatttaggccacggccacctcccggcaggcccaggagagctcgtactcgacgggcggtaggtacccgaggctcgagtgcaggcggacggtgttgtagcgctgaatccaggtagcgatggcagagcgagcctcggcgaggttcgcgaagcggtagcgacccaccagctcgcgcttcaggctcccgaagaaagcttcggcgacggcgttgtcgtagcaggtcgcgaccctgcccaccgactggcgaagcccgagcgttgcgcacagctggcgaaccttccgggagaggtactgactgcccctgtcgctgtggaagatcgccccagccaggctgccccgagtcccgagtgctccgcagatcgcctcgaccaccaggtcatcgggcatgcgacgcccaagtgaccagcccacgatccgcctcgagccaaggtctgccaccgtggcgaggtagcagaacccctcgtcgcttcggacgtcggtgatgtcgctcacatacctgcgcttcggttcaccaggggcgaagttctggctcacgaggtccggcagtggcgcttcctcttcccgcctcgtggtacgcacgaagcgccggggtgggcacgctgccatctcgagctcgcgcatcaggcgttccacccgcttgtggttcacgcagtaaccacttcgtcgcagctcatgggtcaccctggggctgccataggtgccgtcgctcgcctcccagatggcgcgaagctcgctcgcgagcaccaggtgctcttggtcagggccgcgctcgcgccagcgtcgccaggcgtagtacgcctggcgagagaccctcgctactcggcatggcgccgctactgggacgccctcggcctcctggtgagcgatccagcggtagcgggtcactggttgccctcgcaggatccgcaaaggccaggcaacgtttcgccaggtctcgttccatggtgagctgcttgacctggcggcgcagccgggtcatctcctcgcgctcggcgctcgtcaggccttctcgctcaccgcggtcgatgcgttcctgacggacccagttgccgagggtctgctcgttgatgccgagttcgcgagcgacctcagcgatggtgcggtgctggtcgagcaccaacgctgcggcgtcctttgcggaactggctcgggtagcggccgcgtcgtcgtcgagcggggctatcgcccgggggcgggttcggtgtctggctcgtcccttcctcctatagcaggtgtcaacctggaggggggaaggccacagagccgctcacgcgaccgttactgcccagccctgacgcgacgcggcgaccagcgacgtggctagcgtgcggtggtgcgcgacagcggcactcaaggcgccccggggcttcgcgtgagggatgcgctcaccaatgttcgcccgacgacggtgtcggtgaacgctcgccgacgtgtcgaggccttcgtccgtccgagctcaagcgcgacgatcacacgaaggtctgtgtgttgcaaaccacgaactatcgcaaccatgagccgggcgcgcggtgctcggtccgcgtcggggacatcggggccccagggggtcgaggtggcgtcgtcgaccggtcggggtgggtgggccgacgtgtgcgttcagcgtgcgtgggagggagttgtcaccttgacaccgtcgccaggcacgtggcacggtcaggcccgaggcgagacaagctcgcaggtctgcagctaccgcgctcgagaggagtttgcgcgtcgccgtggctgcgacggcggtggttcggttcgagtgttccgagccatcaccaacgctctgcgcgggtgcgtgataggcggtcggtggccatagccgatgtgaaccgggcctgcggttcgcgcagggatcgcgaccgaggccgctcccggcagatcctgctgaggtgagcatcagggcctcatgctcggtcctcgccgtcgtcgaactgcaccgcttcgaggcgctgacggcgcgcttcgagcgtctctccaccgtacatccagtaggccccaccctgtgccgacgttgtccgcagaccgatccgctgtagagccttgacggccgccgcggacaggctcaggttctcgccctcgaactccactcgattgccaggcaggacggtcacgtccattgtctcgtctcgcgagaacgtcagtaccgcgcccaccgggatgtcgagcgcctcgatgcgcagattcgatcgacgctgcctcatgctgttaagcgcgacctggtcgtcggcatcgagttctggctccgtcacctggatcggcgtgtgcggtgcgatggagatggccaggacgactcgttctggctcaattcggaagaactcgcgcttcggattgacccgcgcctcggagaacaactggtggagcttgcgttccaatgtgcttgcgtcggcgacctctgcggcgaagtggcactcgaagggcagtgggacgccggtcgtgtaaaggtcgttcatccgtgaggctacatcgccgttcgacttgccgattgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcagatcttgacgatccctggcattgcctcgttggtgaggacatagatgatctcggccacacggcaacgttagccaacggccgtgccgtcgaggctcgaggacgcgcgaggaggctcgggagcacgccgggcgtggcgttcgccgactcgcgaatccaggtgctgcgcaggagcgttaccgcgtgatgtcgggcgagctcgcgccatggatccagcctctgggcgcgagtggctcgccgccaagggtgcgctgtctcgcgtcggcgacgatgcgtcccacgacgatcggttcgcgcaggcctgcggctcgacaggcgtcgatcaaggcggagggatcgtggatcgcgatgacgagctcgtagtcctcgccacctccgagcgcgtcggcgagcgtggcgtcgggcgcgatcggaacgtgatcgagctcgaagccgacgccggatcggtcggcgagccggtgcaggtcgagcgagaagccgtcggacacatcgatcgcggcgctcgcgccgtagctggctgcaagctggccgtgagcgaggcgtggttgaggggcaaagagggcatcgtggaggtggcgcgggagtgcctcgggggcctctcctgcgagcacgcgtcgtaggcccgccgaggccgcaccgagcggaccggtgacgagcaggtggtcacctgagcgggcgccacgtctcgtgagcggggtgccatcgacctgaccgagcgcggtcacgcacagcgtcagcgtggctccccgtgtggtgtctccaccgacgaggggcgcgccgaggcgatctgctgcctccgcgaccgcgacggcgatggcgcgggcatcgatcgctggtgggcaggcgagcgcgagcagggttgcctccggtgttgcaccagcggccgcgagatccgagaggttcaccgcgaccgccttgtgtgcgatcgccgcgaggggccaccggtcgacctcgacgtggacaccgtcgacgacgaggtcggagcaccacacgcgcgacttggacgagggagcgatggttgccgtgtcgtcgccgatcgccagcgaagccgatccggcgccgatgacggcctcgatgacctcgtcttcgcgccagttcgtgtccacttcagctatctaagctgcctggtttgcgcattcggtccggatgctggcagcatggaggatcctgttcgagcaacgagcgagcaacttgacccttcgggaggagaccatggggatcgcggatgcgaaccaggacgtccagcgttggatcgatgagtgggtgcgcgtgctcgagcccgcgcgtgtggagctctacctcggcgagcgggaggagaccgatcgactcatcgacggtctcatcgcccagggcacccttcgaccgttggacccctcgcggcgtcctcggagctacgtggcggcctccgacccgagggacgtcgcccgcctcgagtcgcgcacggtgatctcgaccgacgatcccgatgatgcgggcccgaccaaccattggcaggacccgaccgccatgcgcgagcgtctcggcaagctcttcgcggggtcgatgcgcgggcgcacgatgtacgtcatcccgtttgcgatgggggtggtgggatcaccgttcgcggtctacgcgatcgaactgaccgactcggcctatgtcgccgtgtcgatggcgaagatggcccgtgtcggccgcgcggcctgggatgcgatcctcggcggtgcgcccttcgtgccggcggtccactcggtgggagcgccgctggcaccaagccagcgagacgtcgcgtggccctgcgatccggacaacacctggattgcacacttcccggccaccagcgagatctggtcgtacgggtcgggctatggcggcaacgcgctcctcggcaagaagtgcttggccctgcgcatcgcgagcgtgcacgcgcgtgaagaggggtggctcgctgagcacatgctcatcttgaagctcacctcgcccgagcagcgcacctactacatcgctgcggcgttcccgagcgcgtgcggcaagacgaacctagccatgctccagccttccgtgccagggtggcgagccgagaccatcggcgacgacatcgcctggatccgtccgggccccgacgggcgcctccgggcggtgaaccccgagtacggcttcttcggtgtggcaccagggacctcgcgccgcacgaacccggtcgcgatggcgacgatcagccacgacaccatcttcaccaacgtcgccgtcacgcccgatggcgacgtgtggtgggagggcatggacgaaccggcgccgagcggcctcatcacctggcgaggcgagccctatgaccccgcgaagggacctgcagcgcatcccaacgcgcgcttcaccgtggaggccaggcagtgccccacgatcgcgcccgagtgggaggatccgaacggtgtgcctctcgacgccatcgtgttcggtgggcgacgccgcgacaccgtgcctctcgtcgccgaggcgaggtcgtgggagcacggtgtgtggctgggcgccacgatggcgtccgagaccaccgcggcagccgaagggtcggtgggccgggtacggcgtgatcccttcgcgatgcttcccttctgcggctaccacatgggcgactacgtcgcgcactggctcgaggtcggtgcccgtgccggcgccaaggcaccccgtctctacgtcgtgaactggttccgccgcgacgacgagggggccttcgtgtggcctgggtacggcgagaacgcgcgggtgctcgcctggatcgtcgatcgcctcgagggccgggcccagggggtgtcgcatccctacggcacggtgccggcaccaggggaactcgacctcgcgggcatggcggaggcgccgtcgtgggacgcgctcttcggcatcggtgacgaggagtggtcacgcgaactcgaggatgctcgagcgttcgtcgccaccctcgctccgcggttcccggcctcgctcctcgacgtcgccgaggcagcggaccgagcagcagacaccgacaggggctgaggcaccccggcgatcagatcatcaggagcccgtggaggcgctcacccggcctgcgcgagtcgtcccggcgacgacgagaagagcggctatgcagaacgtggcggccatgatggcaaaggcccagcggaacccgaggtcggtgaccgcgagcccgatgagggcgacccaggccgcgccgatggtttgtgagacggtgaagaacacgccgaaaccctgccgttccaggtcgcggggcatgtgatcggcgaagacggtctggcggagcggcagttcggagtaggagaagatcccgatcgcgagcccgaccagcgcgagtaggagtggctcggcgccgaccaccacgaagcctacgagcgcagccgcaccaagcacgtagttgatgagcagggtgcggcgatgggccgtgcggtcggcgagctggcccatcgctaccggcccgatgaccgcgccgacgtagatcacggtcaggatcaccgtgatggccgcggtggaggtgtggatgccgtcgtggaggtaggcgggtgcgtagaggccgatgatcccgatgccctggccgcccgctgcgatcgtgccggcgaggaggagggtccacacgggtcgggcacgaaggagcgtccacagcgacacggacgagcgggcggacgacgtggtctgcgcctgggggatcggacgacgccagggactgcgaatcccgacagcggtcaccaccgcggtggtggcgaggagcgcagccagcacccacagcgcactgcgccagccgccgatcgcgatggcgaggccggtgatgctgggcgcgatcagcgtgccgatgttgccggcggtgacgtgccacgacaggacggtgccgcgccgcttgggatgtcgggaggagaggaacgacgaccccaccgggtgctgtggccagccggcagcggcttggatcagccgtccgctcgcgaagatcaccacgttcggcgcgagcgccgagaccgcggctcccacgacggagccgatgttctggagcgtgagcagcagcctcgcaccggcgcgcttgacgacgacggccaagccctggagtgctgacccagcaatcgcggccaccgagagcagcgctccgatgaccgcatacgaggtgtggaaggcggtgagggcataggggatcacgatgccgatgccggcgacataggcgtgttggcccgcgtgcgaccacccgacgcttgcgaggtcaccgaggaaggaatgtcgagtgggtttgggttcgccggcgttggtggaagaggactctggcatcgatcagctcccctcccaccctaaccggaggtgccagcctgggtgcgattagccctgtcggcgctggcgctcgggctcgatgacgagcaggacgcgctcggaggtgatcggagcggcgtagggtccgccggtgtagcgctcggagagccgatcgatgtgctcgcgagcgcgagcgccgccctcggtggcgatcacgcggccgcgaacctccacgtagcgataggggttggcatggtcccacaccaccaacgcgaccctcgggtcgcgttggacgttgcggtacttcagccgatggacctcggtgttgatgaggacgtggtcgtcgtcgatgtcgaaccacatcaccgacgactgtggcgacccgtcggggagcagcgtggtgaaggttgcgaagttcgctccggtcgcgagctccacgaggagtggatctagcatgcacgtaggttagcccaacccgggctgggcccgcgagtgcgctcgctcgtccaccgtgaccggatcgacgggcgcaagcgcggccacggcgcccaagtggcacactcggacggaggcgacctcgtaggcgacggtacgggagggtaggcatggcggttgcgtggatcgacggggccctggtggacgaggccgatgcccgggtcccggtgttcgatcatggcctcgtcgttggcgacggggtcttcgagactctcgtcgtcgtcggagggcgggcctttgcaatccgacgtcacctcgagcgtctggcgcgcagtgcgcaggggatggggatcacgctccccgacctcgatgcgttgcgcggcgcgatcgaggccgtcgtctcgaccaacggttacgaacgagccaaggtgcgggtgacctacaccgccggtgacggcgaactcggctcgggtcgtgtcggtggtccgacgagggcgatcgtcgccgaggcgccgatcgagctcgaacctgcgacctgtgcggtcgcggtggccccgtggcctcgcaacgaacgtggcgtgctcgccggcatcaagacgacctcctatgccgagaacgtggtcgggctcgcgtgggcgcgagcgcgcggcgcatccgaggtgctcttcgggaaccttgcgggcaacctgtgcgaaggatcgggctccaacgtcttcgtggtccgtgacggcgacgtgctcacgccgccgctcgacgccggtccgctcgccggagtgacgcgtgcgctgctcatcgagcgcttcgccgtcaaggagaccaacatccccctcgacgatctcttcgacgagcgggtgtcggaggtcttcgtcacctccacgctgcgcttcgtccaaggcgtgcaccggctcgacgaccgcgagttcgagcaggctccgggtccggtgacggccagggcacaggcgctcttggctgatctcgttgcctctgacatcgacccctgaggagtcctcgtgcgcttcgacgatcttgctcgcgtcagtgagctggccgcgcggttcccggacgccgctgtggtccggctcgtcgcgttgcacggtttcgggggtggcgagcgtgcggcggacctcgcgatcatggctcccgaaggaacggtcggggcgatcgtcggcccgggggtcgtcgatcgcctcggatccgacccgacgccacgacttgctcgtgtcgaggtgagcgatcccgacgccgaggcgcatggcctcgcctgcggtggctgggcggaggtgctcgtgcatcccgcctcgtggctgccgccacttggcgaggtcgccggtcggcgtgtcccgttcgtgttgaccaccgtcgttggtgacgacggaccggtggcaccgatcgcgatcgaggtcgatccgctcgtgcgtccaggcgtgacggtgcgcgatggcgtccatcggcaggcgttcgtcccgaggccgcgtttcgtcgtggtcggcgatgggcccctcgtcgacgagctgggatccctcgggacctggctcgacgtcgaggtcgacacaggggacgtcactgggctcggcccgctcgacggcgtgctcgtgctcacccacgatcatgaacgggccaccccggtgctcgcgtccgcgttcggtgcaggggtcggctacgtggcggcgctcggatcgcgagccacccaacacgagcgtgtggagcggctgcgagccgtcggtgtcgacgcgcgccgactcttcggcccggcaggtctcgacctcggatctcgaagcgtccgcgagacggcgctgtcgattctcgctgagtggcttgccgtgacgcgagggcgctccggtgcgcacctcgccgccggcgacggaccgatcaacggctagtcgatcgcgtccagcttgagcggagggatgtcgccgagcggtgggggcgacgacggctcgccctcgagcgctcggtcgcagagccacgcccgcgaggggctcttggtcgatgccgggcaggtcgagtcgagcaaccgcagctgcttcgctgagcgcgccgaggtgggtgaggaggtggcgcgcgttggtcggcgcttcggcgagctcggccgccgtcctccggaccgcgtccccaaggcgcttgcctacgctcccatcgagggctgcggtgatgcgttcgacgaagccatcgcgcacaactcggtcggcgagcacctcagcggcgtcgagggcgtggacgtggggggttccctcccagatcgggagcacgagtgcttcgcggtgccatcgtgcgatcggcgcgtcctcgacgaagccaagcccgccgaacgcctccatggcccgctgggtgacgaaggcggcctgctcggcggtccggaccttggcgacgtgcgaccgtgcgcgaaggatctggtaggcacggtcgccgtggtgcgatccgagcgagctctgcgtctcctcggcgagctcgaacgcgagcaacgaggtggcgagctgagaggcgcggaggcgagcgagctcgtcggcgaacaaggcatgggcgagcagcggtcgaccgaacgcgacgcggcgctgcccacggatggtcgcctcggcgagcgcgatgcgtgcgatgccggcggcgctcatggcgttggcgacccgcgcgatcgtgagcgattcgaggatgcgatggattccgtcggggggagctgcgaggagttcggcgggcgcgtcggcgagatccacctcgccggtcgggacggcgcgggtggcgagcttgtccttcagccggcgaacggagaaggcgagcgagccatcgggctgctcgcgacgcacgaggaagagcccgagcgaacggaccccgcgaacctcaccgacgtgggccgcgacgagcgcaacgtcggcgagtccggcgttcgaggcgaagaacttctcggccgtgccgatccgccactcgccgttgggcgtctgggtcgcacgggcacggagcgacccaaggtccgagccggcgtgggtctcggtgaaccacgtcgcgccgaaccatggcccctcgcgcaagcgtgcggtggcgctgtggtggggggcgagatccgcgagtgcgagcgagacctgcgtggtgagcgtgatcgtgcagtagaggccgggatcggcgaggaggtagccagcggcgagcgcggcgaggaggccgtcgggctctgtcgtggcgagcgcgaccatgggacgcagtcgctcgagcagggccacgtgggtcggggcgagctgggcgcggtcgatgcggttgccgtcgaggtcgtgggcgaccagccgtggcggcgcgtcacggtcgacgtggcgcgcgacctcgagggcgtcggccgagatggtgcgattgaggtgctcgagctcggatcgtcgagccgcagagagtcgagcggcgagccagcgctcgaccacgggatcgagcgcgagctgatcgagtccactcgcgtagccgccctcccgtggcatcaccatccgatcgcgctcccgtcctcggcccgggggtccgagcagctgatgacgtcgtgctcgcgaaccatcgcgatatggcacacgccggcggccgtggtgaggccgggctcgagggtgagcggcccgatgcgctcggcgagctcgccgaggacggacggatccacgtggtcctcgatcacccacgtgcgcttcccgtcgtggtggtgggtgtcgaaaccggggtgtggaccggacgatgcggcggtctcggcgagtcgggcgcgagcgagggcagtgcgcgggtcgatgccctcgcgcagcgtcgcagagaccacctgggcgatgaccgtcggctgacgatcgcctcccatcgtccccgcgacgaggcgcaacgtgccggtacgcggatcggtggccatgagcggcgcgagggtgtggcgcgggcggcggcgcgggccgagctggttcggactcgcgggatcgagatcgaacccgaccgcgcctcgcgagtgcacgaagaccccggtctcgtgggtcgtgagtcgggtgccgaacgcattcgcgttcgactggacgaggacgcaagcgccccctgcgtggtcgacgacgacgatcgccgtggtgtcgggtgcgttcgggcgtcggagggtcgcgggcggagacgacggagccggggcggcgagggcggcggcgacgtcggccccgtcgtagtggagctcatggagccagcgggtctgctcgatggcgtcgaccatctcgagataggcctgcgtgagcgacgtcggtcgttcgggcgggagcgccgcgaggaggccgagggtgagaaagctcgccgacggagccggtgtccccatcatgcgcagcccgagggcgtcgacggcgatcggctcgacgagctcggcttggggtcgggcgaggtcttctgctcgcagtgcgccttgggtgagcgccatgagctcggctccgacctcgcctgcgtaaaagccctcgcgtccgagacgcgtgatggcctcgagggtgcgggcgatgccgtggtgacggatccgctggccagggacgaagcgacccttgaacgccgccgtgagctccgagcgaaagccgaggtccgagagctcgcgtgcgccagcggcgagacgggcgggcgcggcgaagccgttgcgcgcgtagtcgatcgcgtcggcgaggatggtatcgagggcaaggcggccgaagcgttcgtgggcgaggagccaaccgtcgacggcccctggcaccgtgatcgccgctggatggtcgcggggaatggtgcgaaacccttgctctcgcaggatctcggcgttcgcgttcgagccggcgcgcccgatgccgaccagcgcgtggacacgaggtggcgtgcggggtgtgcgaggttgatagacaagtccgacgacgtcgccaccgaggccgcacgcgtcaggggcgacgacggcgagcaccgcgttcgccgcgatcgcagcgtcgacgctactgccgccgcgacgcagcaccgtgagggccgcctgcgaggcgagcgggtcgatgctcgagacggccgcatgggggaaaccgtgacacgcgacgacaggtggctccacatcgcgcaaggctactccacacgtcgcttcggcgcgcagggccgtgagaaatgcgcgattgcgtggtcgacgagctcttgtgcggcggattcgtgagatttactcgtgtggtcatacggaatcggcttgcctcggggagcgagatgcgctagcgtacacaacggttccgcgctccgcgttgccacagcgcgaccgcggcgtacgtccagggcacacgaggccagcaccgagagggcacggccgagagggcaaggccgagaacacggccaagaaggagcagagcatgattcgcacgatcgggctgccggcggagacgaaggatggcgagcgacgggtagcgctcgagccgagcgcggtcaagagctgtgtccaggccgggcacgatgtcctcgtgcaggccggtgccggccgtggcgctggctttggtgatgccgactacgaggcggtcggcgcgaagatcgtggccagtgcccaggaggcctggagtgcggatctcgtcgtgaaggtgaaggagccccagcgtcacgagtgggcctacttccggcgcgacctcgtcctctttgcgtacttgcatctggcggccgagcccgaactggcgcgggcgctcatggacgctggggtgcgcgcgtatgcgttcgagacgctcgaggagcgaggcggcttgccgctgctcgcgccgatgagcgaggtcgccggacgcaccgccgccatcgtgggcgctcattacctggcccaagggtcgggcgtgctccttggcggctcggcaggcgttccgccggctcgtgtcgtggtcgtcgggctcggtgtcgcaggaacgatggcggcgcgtggtgcgcgcggcatggatgcggaggtcaccgggatcgacatcgacctgcaccgcttgatggaggcccacgagcgcgggatcgtcacggcgacgctcgcgagttccgagcacgcgatcggtgaggccgtcgccgatgccgatctcgtcgtcggtgccgccctggtgaccggggcgaaggcgcccaagctcgtcctcgaggagcacgtgcgatcgatgcgaccggggtcggtgatcgtggacctcgccatcgaccagggcgggtgcgtcgagaccgcccgaccgacctcccactcgaacccgatctacgagacccacggggtgatccactactgcgtgacgaacgtgccgggccagtacccgcgcaccgcgtctcgcgcgctcagcgccgcgatcgctccgaagctcgtccgcctggccgcgaacctggatgaccccctcctcgcgaccgcgctcaacgtcgctgacggtcgggtggtgcacccgacggtcgccgatgcccttgggctctagtgtcgctgcccgcacccagcctctggctgcgtgagctcggtcgcgaccgttggcgtccgcagctcgatggatccctcgaggcggacgtcgccatcgtcggcggtggcttgagcggcctgtggaccgcacacgcggtgctcgacgctcgtccgggcgcctccgtggtggtgctcgaggccgagcgggtcggctggggcgcatccgggcgcaacggtggctgggcgtcggcactgttcccggtgagctggggtacggtggcgcgcagcttcgggccggagggggcacgggcgttgcgcacacgtctcgtcgagaacctcgacgagatcgaagccgccctcggcgatgacgccgcggacgtggagtggcaccgagccggcaccgtcgtggcggcccgaagcgaggagcagtggcggcagctggtggccgatgtccgggaggagcaggcgctcggccttcgggaccctggggtgctcctcgacgcgcgaggcgtgcgggctcggttggcgatcgacggcgctgtcggcggagtcttcgagcccgtgtgtgcctcggtgcaccctgccaagctggtcgagttgctggctcggcgcctcgagcagcgtggaggtctcgtgctcgagcggagtcgggtccactcgggtgcacccggcgtgctcgtgggtgtcggcggtcgcgtccgggcatcgcaggtggtgtgggcgacggagtcctacagcgccgccgaaccgcgctggcatcgggcgctcgccccggtggcatcccagatcatcgcgacggcaccgctctcggcggcgcagcgtgagcgcctgggcaaccccgaggcagggctcaccttctccgatggtcggcgtctcgtgatctatggtcaactgcgagccgacggtcgggtgatcttcggcggacgaggcgcgccgtatcggttcggctctggcgtcgagttcgcgaccgaggtcggcgcgaggatgcgcctcggcctcgccgcgacactcgcggagctgctgcgtgaggccgggcccatcgagatcgaggcgtcgtggggcggtaccatcggtgtctcgcgcgattggtatcctcgggtgctgcacgatccgagcgagcgcatcgtcttcgtcggcgggtatgcaggcgacggcgtcgcgatgacgcgcctcgcgggccagctcgcggcggcgtacgcgactggggtgcggctcgatccggacctcgccgtgatcctcggccgaccggtgcggcggtgggagccggagccgatgcggtggcttggcgtgaacgttgggctcggactcacgcgactcggcgatgcgctggagggtcggccgcacgcgcagcgcgcagtggacgtgctccgaggagcagtgctcggtcgttagcgttcgctgcgatggtacgtcgtaaggtggagcgagaccgcccaggtgcggtcaagacgagaaggaggcaaggcgatgggccgcttggcaccggtgtggagcaaggtgtcgccgatcacggtcacgcatggccgaggcgcgcgtgtgtgggatacgaacggtcaggcatggcttgacatgacggctgggatcgccgtgacctcgacgggtcacgcgcatcccaaggtcgccgaagccatcgctcgtcaggccgagcgcttcatccacgcgcaggtgaacatctacactcacgacctcttgcaaccgctcgccgatgccctcgatgcgatcacgcccgacggtatcgacacattcttcttctcgaactcgggtgcagaggcaaccgaggcggccgtcaagctggctcgccaggcgaccaagcgccccaacgtcatcgtgttccaggggagctttcatggccgcaccgcccaggcgatggccatgacgacctcgcgcaccgggtaccgggccggctacatgccgctgcccgctggcgtcttcgtctcgctgttccctggcttcccgcgctcgagtcgggtgggtgacgaggtgagtgtggacgaggcactcgactacctcgactacctgctcgcgtcgcagacggcgccggccgagaccgccgccgtggtgatcgagccggtgctcggcgagggaggctacatcccggcgccggcggcgttcctcaccggcgtcgtcgaacgcgcccgggcgcacggcatcgtgttcgtcgccgatgaggtgcagaccggttttggtcgtaccgggcggatgttcgccgtcgagcacgccaacgtcacgccggacatcctcgtgatggcgaagggtatcgcgtcgggatttcccttctcggggatcggagcatcgtgggagctgatggagcgctggccggtcgggagccacggaggaacctatggcggcaaccccatgggcgtcgcggcggcgctcgcgaccatccaggtgatccaggaggaggggctcgtcgacaatgcggctcgacgtggcgcccagctgcaggcgtcgatggagcgcatcgccgagaagttcgagtgcgtgagccgagttcgtggcctcgggctgatggtcggtgtcgagcttcgtgacgacgcggggcggcccgatgcggacctcgtcggccgagtgctcgccgagatgcaggcgagccaccgcgtgctcgcgatgagtgctggcaccttcggcaacatcatccgctggatgcccccgctcgtggtgagcgaggccgagatcgacgaggccgccgccgcgttcgaggcgtcgctggcccacgtgctcgcacagcggtaggagcgtcctggtcgggaggctctcggtctcccccgaccgcccccactcgaagtgctcgagcgggggcggtcggccaggtgcaggtcaccgcggtcgggcgccgtggccgcgccccgcgcgcgcggccgcgaggcgtctagccgttcgcgagtgagggacgcacctccgcgacgacgaagtcgcgagcggtgccctcgaagtagcgctgtggcggccggagcatgtcgtagaccaagcggtagccgtcggacggcgaggctgcctggccgagctggtggttgaagtagaagaagtccgtccagtcggagttgatgtccagctccatcgcgttgaccgctccgacgcgcgcgaggaggcgggcgagcgacgcgaccgacaggccgggacccgtcacgtagacgagcgcgccgttacgggtgatgccaacgccggagcgccacaccaacagctggttcccgaccgtcgcgccccagatggcgaagttggtcgagttcacgagtggattgatgcgcccgttggagatgagcgggatcaggttctgtcgaacgaccgcgatccccttgggcacatggttgccgtgcgtccaggtctcgatggtgggcacgccgctcgtcgagatcacgaagctggcggcaccgttgcgcaagggaaccgccgtgcggccataggcgtagtacccgccgttcgcgtcttgcatgcgaaagccggagttgaaggcggcgacgagatcggctgcgaccgggttcgtgatcggtgccatgtagggccaaggaccgccaccaggcggttcctgggcacccgcatactggatgaagcgcaggagccgagtgtccatccaggcgaccccggcgaccagcgaggtatggatggggtccgggcgcatgagggtgacgtagagggtagggacgccattgacgagcggcccctccggggtccaaacgccctcgttggcgagcggcggcttggcgaacgggatcacacgggccggtgccgggagcggccccgacgcggttgcgtcgacgtggccgaccggtgtgagcgcgtgacgcggtggcttcccgcccgtcggcggttggttgatggcgtaccaggtgttctcgagaaaggcgacgaagctcgcgcccccgtgtccgcggacccactcgacgaacttcacgccgagcgacgccgaaccgggcatcgtcacggtgccgatgccggcccaactcgccatggcgaggacgacgacgagcacgacggcgcgaaccagacggaacgtgcgcgagcggcgacggcgaggaagccgctcgatgcgggggcggctcggcgcggatcgttggacggtactcacgaaagctccttctgtcgcaggggggtggcgaacgaaacggctgcagtcacggtagcagtggggagttcgactcggaagcgggcgccaccgaggtcgctgtcgaggacgcgcacgcgacccccgagcccgacggcgacgcttcgtacgatggcgagcccaaggcccgtaccgccgtcatgacgggcgcgggccgtatcgagccgcgcgaagcgctcgaagacctcgtcgcggcgatcaggagggatgccgggtccgtcgtcgtccacatcgagcgtcacgccgggcccgagggagccggtcacgagcgtggacgtccgaacccgaacgcgagaggtcgcgtgtcgtgcagcattctcgagcaggttgcgaaccagcgaccggagcaactctggctcggcagcgatcgtggcatgcacatcggtagcgagcgcgaagctcaggcggggattgaggcgttcgaggcgagcgacctcgtcctcgacgacaccgaccaggtcgagctccgtggaggcggggcgtcggggtccggtctcggcgcgcgcgaggaggagcaggctctcgatcaggcgctgcatgcgatccgcctcggacagggcgatctgcgtcgattcgtcccagtcggtgatctccgggtggagcgcaccgacctcgagggtggtgcgcagcgccgagagcgggctcttcagctcgtgcgacgcgtcctggatgaactgcttctcgcggatgagcgcgtgttcgagccgtgcgagcatggcgttcatcgtctgtgccagtcgggcgatctcatcgtcgcccggcggttcggtgacgcgctggtcgagctgcgacgaggtgatctctgcgacgtcgctgatcatctggtcgaccggtgccagcgctcgcctcgccagccaccacgtggcgctggcgacgacgaggagcacgagcggatagacgacgtcgaagatgtgcaccaaggtcctcgtcgcctgatcgacactggcgagcgaggcgatggtgaacacgtagtaggtctcgacgccggagctgccgacctgggcaggtacggcgctgtgcgcgagggtcgctgctgcgcgtgtggtcagcgcgatgggctcggcgacgagcaccgatcggatgtcgatgtcgtggccgaccaggatcgaccgcgccttgctcgtcgcccgcgtgacgacgagaccggcgggtgggacgtggtgcggattgacgagtggggcgacgccacggaggttgggggtcgcagcgacgacctgcccggtgctcgagacgatctgggccgcaagatcgccgcgcgggagcgggagcggtcgaggcacgtcgccgttgcgcacgaggaggacgatgtcgtaggcctcgctacgagcggtctggacgatccccctcgtcagggcggtacggagcacgagcacggtagcgacgaggcttgcgaggagcgcgagaccgacggcgacggtggccgcgacggtggtgcggaccaccaccgacgcagcgaggcgaccgaagaaccgaacgacgcgccaacgagatcgtgcgagacgccccaggtatccgagcgagttcagccgcatgggccgcggtcactcactggcgctcgacgccatcgcctcgcttctgccaccatcctcctccaggcgatatcccacgccgcggatggtggtgattgccttcgtgccgaacgggacatcgatcttcttgcgcagatacccgatgtagacctcgacgatgttcgagtctccctcgaaatcgtagtcccacacatgggcgatgatgtcttgcttgcgcaggacgtggcccttgttgcgcagcaagagctcgaggaacgaaaactcgcgggtcgtcagatcgatggtcacgttgccgcgcgtgacacggtgactcgctgggtcgagggtcaagtcgccggcctggaggatgggtgggtggctctcgacgttacgacgcaacagcgctcggatgcgcgcgacgagcacggtgaacgagaacggcttcttcaggacatcgtcggcaccggtgtcgagcgcctcggcttcgtcgtattcaccgtccttggccgtgagcatcaagatgggtgtccagttgcgctcctcgcgcaggagttgcgtgaacttgaacccgttgacaccgggcaacatgatgtcgaggacgatgcagtcgtagggggcatggcgcgccatgtcgagccccgtcgtgccatcgctcgcggtatcgaccgcaaagccttcagcgctgagcccgcgcttcaagctggcgagcaagttttcctcgtcgtcgacgatgagcagtcgcatgacacacctcccagcactcggaccctacgaggtttgctcggggctcgcctcaagcgagtccgaaggtttcctgagagtctgccgatccgagctgctcgagacgcggcttacgtgagcgtgggtgcgtgggcaggccgagactggtgccgacgccgacgagcgcgacgatgcgttcgtggacagcgagttcaagtgcgctggcgaggaccgggtcgcgggcgaggcgccctgttcgccacatcgagccgtacccgagtgcccgcagggcgagcaggagatacccggtcgcgacgacggcggcgtcacgctgctcctcgacgctcgtgcgagcggcggcgtcggggctcgcgatcaccgcgacgaagagcggcgcacgggagaagctcactcgagcacgtgcagcgtcgtcggggcgttcgagttcgatgtcggcgacgatcgccgctgctgcgtcgggccagatcgcgaccatccgatagggcgtgagagagcgatgatcgggtgccgtcgcagccatctcgatggcgaaggcaagctcggccgccgagggcgctggcggcgcgagcttcggttcggagcgccgggtcgccatcacggtcagtgccggtgcgcgtcgagcaagctcgagcaggctgtcgtcgctcaccagccacgctcgatccaggtcgcgagggaagggcgctcggccccgacggtcgtgatgcgcccatgtcctggcagaaggacgcacggatcgggcagctgttcgaacagttcggccgagatcgagtcgatgatcgtccgaaagtcctggggtgagccggtcttgcctggaccacccgggaacagcgtgtcgcccgtggcgcacagtgacgtgccgaatgcgaagcagaccgaccctggcgtatggcccggggtgcagatcgcctcgatcgtgacgtcgtcgatgacgagctgctgcgatgtctcgatgcgatgggtgacccacggggcatcacggccgtcggccgcacccatccagacactcatgcctcgcgccgcgagtgctggagcggcgccaatgtggtctgcgtggccatgggtgatgaggagagaggtgatcgatcgttcctcggcagctcgccagagcgtgtctggatcgctcggggcgtcgatgaggacacctccgcccggccaggagcacagccaggcattgttctcgagtggtgccaggacgaagcgctcgacgaccacatcgtcgagcgtgatgaccagctctggagcgcccacgtggcgggagcctagctggttcgcctggatctgggggacgggctcgtgcgcgcctcagcgtgcggcgaacggtggtgggtacactggaaacgggtcgtcgtgacggacgagtcgtgagtgaggggaccgaaggtgagacgtgtccggcgctcgggggagtgggctgttccggtcgcgaaggacgaccgggatcgggctcgagcgattctcgtcgaacgtctgcgttcgggcgcgatgggattcgatgagtacgagcgtcggctcctcaaggtcgagcgagctgcctcggtgccggctctctacgacgcaaccttcggtcgagcgcgactccccttcgggggaacgaggtggcgccgacgacgtgtccggctctcggtggtcgggctggtgatcgcggctgcggtcggggcgctcgggttcatgtggatcgggttcctcgtcgctgccgctgtcgtgctcgtcgctgtggcgggcgtcaacctcgcggtctgggtgcaggcccgcaggtacccccaacggttcgaccagtccgtgggcggcacgtcgcgctagccgggtgcaccggagggagccggtcgacctgcgttgcgcagccgatacgccgattggatcgatgcgccgcttgggactgcgtcgatcggcccggagcgagtcggtgaggttggcttcggcgtcgcggccagatagcgtgcggtcggtgccatcgacgcacgaggtggctggccagaagggagcggtcaatgagccaacactggcatgaggtgcaagacgagcttcgcgacccggtcaaggagctccgtgcccagatcccagagacgtggcacgcctatgcgacgttgcaccgccatgcactcgaggccggccacatcgacgccaagaccaaggagctgatcgcgctcgcggttgcggtgacgacccagtgtgacggctgtatcgcgtcgcacgcgcgcggtgcggcacggcaaggcgcgaccgctgaagaggtcgcggaggcgctcggcgtcgtggtcttgctcaccggcggccccgggaccgtctatggcccacgcgcctatcaggcattcctcgagtttcgcgaggactatcgaaccgctgagtgagccacggcctggacgacgagatcgacgacgtcgatcccagcgcgagcgagtgttcgtgctccgacgacatcttcgatctcattgaccaccacgtcgtcgtcgtgctcgaagaggtcgatgccgtagtagccaggtccgatcagacccatgacacgggtagcgaggcgatgggactcgcgagtcggtgtggcgaggtgtcccgatgctccacggctcaggttcgcagccaccccgtcggccgcgcgtcgctcggtccatgctgcgatcgtgctcccgacgacgtaggcgcgcaggacgcgctcaccgccttggacgaaggcttgggtgatccacgcgtcgagatcgcacctgggtggtgcggctgccgggacgatgcgcacgccgtggccgccgtggcccgctcgaggtttgacgacgagatcagtggccgagaaggcgcggtgtgcgagccacgagggcgtcgttggtggtccggggagctcgtgctcggcgagccaccgggcggtcgccagcttgtcgttgccgatgagggccagaagcggtgggttcaccacgaccgggagccggtcggcgagccagcgacgcagctcgcgatcgcgcgagcgggcgatcgcgatggcggtgtcggcagccaacgccgggcgatcaccgggcccgaccatgcggagcgagcacgagccgaagtgtcgctcgagcccgtcgcggagcgcgcgtgcaaagtgcacgttgcgcgccagggaccatggatcgtaacagaggaggacgcggctcatcggctggggccgaggagctggtcgagcaccgcggctgcgacatcgatgccggtgatggcactgaggcgccagatgtgtgcgttggcgttcacctcgcagacgatcgagccctcgccgtcgtcgtcgatgagcaggtccacgcctgcgttctcggcgcccacggctctcgcagcttcgatggcgagcgtctgttcgcgccgggagggccagtacggatagcccgcgccacctgccgagagattggctcggaagtcgtggcgctggcggcgctccatcgcagccaccacgcggtcgcgagcgacctggagccgtcgatcgcgaccacgcgacgatgcgatgaagcgctgcaccaggaggcgacggtccgcgagtgccgaggcgatgtcgatgagatcgtcgagcgtctcggcgaggtggacctgcgatccgaacgagcccttggcctccttgacgacgagggggaggcccacgtggcgcaccgtggcctcgagtacacccgggtcgatgggctgcttgggatagagcggcggtaggagtacggacctcgggaccgtgaggccggcgccgacgagacgtgcatcggtgcggcgcttgtcgtcgcaggcgaggatggcctctggcgagttgaccacctgcgcgccgtcagtgcggagcgcctcggcggtggaggcgtccttgtcgagcatcagcacgaagcgtgcatgcggcgggtcgtcgagccagatggcctcgcgcgagagatcgaggacgccgacatgcggtgttcgctgacgcgcagcgtggaggtagaggccagcgttcgcgcggaatgctgggccgagtccaaggttcgccacgaccaggatgtccagcgggcgcgtacgatggcttggcgccgggtgcacgcgcagagtctacgggtcgcggtgacgggaggacgtgtgggggtggtgagccgagacgacatcctcgacggacgtgtcgtcctcacggcctcgggagggctcgacgacgtcgaggaaggcgtgacggtgctcgccctgttcggtgccaccgaggccgtggggggtggccctcccgtcgaggtgctcgggggcttcgccgatcgtcttgcggagctgtcgcgccgaccggtggtcacctttgcgccgcgaggactcgatggcggtggtgcgttccgagagcgagaagcgctggcggatgcacggcgtgtcctggccgaggtcggagggcctgtcgtcgtgctggcggcgaccgtggcagccggggtcggcgttgcactgggccgcgacgagcgggtcgtgggggtggcgctcgtcgacccgtggacgatcggcgaggcggtcgccttcggcgtgaacctcgacacggatgcgagcatcgatcaatccggcgatgcactggcctgcgcggtgctcgtcgtcaccgaccacgagcgcgacgtcggtgcgatcgagacgatcgcacccgaggctgagatgcatcggctctctggggccgcgcgcagcttcgtgctcgatgcgcgcgtcctcgccatcgtggcgggctggatcgagcgggccccgtggtctggggaggtcgcctcgcccgaggcctagagcacgggcgtggaggatcggcggttgtgcgtgagagtggcggcgccgggtgtgccccagctcggctgttcgcgcgcgagctcgatggcggcgcgaaggtcgtgcgctgcttgcctcgggtccggggcttccgtcagtgcccgcacgacgacgaagcgccgtgcacccgccgcgacgagcgctggtatggcttgagccgtgacgttgccggtgatgaagcggggtcgagcctcggctgctcggtgtgcgaaggcgacgtaggagcggccggtgccggggcgccctggcttcgtcggtgtgggctcgaccggcccgacggagaggtagtcggcaagtggcgaggcggcgttgaactcggctggtgcgtgcgtcgacaagcccacgattctgtcggggccgacgagggaacgaacggtgccgacgtcgaggtcgtcttgaccgacgtggaccccgtcggcgtcgctggcgagtgcgatgtccggccgatcgttcacgatgaacggcacgccgcgccgcgcaaggagccgggcgaggtctcgagcggcgcgaagcacgagtccatcgggcgcgtccttcgcccggagctggacgatgtcgacaccgccgcgcacggttgcgtcgacgaacgcaagcaggtcacgccgcagcgggacgcacaggtacaggcagcggtccccgagcgacctcgtcactgccgcgccttggcgcgagcggccttgaccgccgccttggtctcacggatgcgctcgatggcttctggcgagacggcgtcggcgaccgagcgaaagctgccgggctcgccaaagggctcgctctcgcgctcccacccgtcgggacgaacgccgaagcgcttggcgagcagggcgaggtagatgcgtgccttctcgtcgccgaacccaggcatggcctcgatgcgccggcgcagctcggccgcgtcgcgcacgtcctcccagagtgcggtgacatcgccggcgtaatgctcgcacacgctcacggcgagtgcatggatgcgcttggccatcgaggtcgggaatcgatgcagcgctggcttggtggcgacgagtcgtgcaaggtcctcggggtccatcgccgcgatcgagcacgcatcgaacgtgcgaccgagcgcacggaggcgctgctccagctcgagcggacctcggaaggctcgttccatcggtatctgctggtcgagcagcatgccaacgaggagggcgaagtgatcggtggcgagcagctcgttggcgcgctcgtcgtcggtcaggtagagctcgatcacgcttgctccttcgacgggaccgtatgagtggcgtgccctcgagcctacatggtcgggtcgaagcgctcgggtgagactccgtagtgcgcgagcgcatcgtggagttcctcgggcttcgcctcgccgatgcgcacgagttgcgcgatcgcggcgacgacgacgtgcgccgcgtcgacctcgaagaagcgtcgaagcgcctcgcgcgtatccgagcgaccgaagccgtccgtgccgagcgcgaggaaaggtcgatcgacgaagttggcgacctgttcggcgacgagccggacgtagtccgtggtggcgacgatgggcccgctcgactgggccatgagctcgtcgagccacacgcgctggcgttcggtcccggtcagtcgctccgtgcgctcggcctcgagggcgtcttcgcgcaagcgcttgtacgacgtgatcgagaatgcggtcgctgccacgccccagtggcgagcgagttcgctctgggcctcgagcactgcccggtgcgcggttccggagaagaacagcgtcacgggacggcgccgatcgcgaggggtcgctgccgagatcggctcgacgtcacccatctcgggggcaggacggaagagatacccgccgcgcatgatcgcctcgaccagtgccgctcgctcgaggtggtcgggcgcgggcggcatcgggtagttctcgttgtaggtcgtcaggtagtagatcacgtctctcggctggggaccgtacatgtcggcgatcccgtgctcgaagacggttgcgatctcgtaggcgaacgctgggtcgtaggcctgcacgttggggaatgccgccgccaggagcagcgaatgtccatcggtgtgctggaggccctcaccgaggagcgtggtgcgccccgccgtggcgccgacgagaaagccgcgcgctcgtgcgtccgaggccgcccaaagcaggtccatcgtccgctggaagccgaacatggagtagaagaggtacaccgggatcatcggaacgccgagcgttgcatacgacgtgccggccgcggtgaacatcgccgtggcaccggcttcggtgatgcccatctcgaggatctggccgtcttgtgcctcggtgtaggacagcaagagcccggcgtcgaccggcgtgtagagctgtccgatcgacgagtagatcttggcctctcgaaacagcgcttcgagaccgaacgtccgcgcctcgtccggcacgatcggcgcgatacgggatccgacctgtgggtccttgatgagcgatcgcagaatgcgagccatcaccatcgtcgtcgacaccgcttgggcgccagagccgtcgtagaactcggcaaacgcctcgctgctcggcgcagggaggctccgtgcgcgttcgacgcgcttcgggaggtagccgccgaggacgcggcgccgtgtgtggagatactcctcctcgatcgagcccggaggaagcgtgatgtagggcggatcctcgcccgcaagcatctcgtccgagatcacgtcgttcaggtggaggcgatcacggaactcgaggagctgctcccgggtcatcttcttgatctggtgggttgcgttgcgcgcctcgatgtccgggccgagcgtccaacccttgatggtcttggcgaggatcgcggtgggtgaacccgtgtggttcaccgcggcgtggtaggccgcgtagagctttcggtagtcgtgtccaccacgagggagcgcctggagctcctcgtcggagaggtgctccacgaggcgacggaggcgtgggtcgggtccaaagaagtgttcgcgaatgtaggcccccgactcggtcgcgagcttctggaagtcgccgtctggcgtcgtgttcatcttgttcagcagcaccccgtcgacgtcccgggcgaggagctcgtcccacttcgagccccagatcaccttgatcacgttccagccggcgccgcggaaggtcgcctcgagctcttggatgatcttgccgttgccccgaactgggccgtccagacgctgcaggttgcagttcacgacgaagatgaggttgtcgaggtgctcgcgtccggccacaccgagcgctcccaccgcttcgggttcgtcgagctcgccatcgcccacgaacgcccagatgcgactggaagcggcctgggcgagcttgcgattctccatgtagcggttgaacatcgcgtggtagatcgcctggatgggcccgaggcccatcgagaccgtggggaactcccagaagtccggcatgagtcgcggatgcggatacgacgacaggccctggccaccgacctccatgcggaagtgattcagctgcgcctcggtgaggcgtccctcgaggaaggcgcgggcgtagaaacctggtgaagcatgtccttggaagtagacgaagtcgccggggtactcggtgtccttaccgcggaagaagtggttgaagccaacctcgtagagagctgccgagctcgcatacgtcgacaggtgcccgccgatgccgtccgcggcatggttcgctctcgtcaccatcaccgcggcgttccaacggatgaacgcacggatcctgcgctcgatggcctcgtcccccggaaaccatggctcgttctccggtgcgatggtgttgatgtagggtgtcgagaccgtcgcggggaagccgacctggcgctccctcgccgcttcgagcagcttcatcagcatgaaggtggctcgctggcgacctcgctcgtcgacgagtgcgttgaaggagtcaacccactccgccgtctcgtcggggtcgatgtcggggatctgatgtgcgaagccgtcgatgatcacgcctccattctgacagctcccgatgtcggtgtcgactccccgctagcctggcgcggatggccgtcgagcgtctcgtctacaccgatggagcctgtttgggcaacccgggtcctggtggctgggcctggttcgagcctctcacgggacgtcgagcgtccggctcggaggcgcagacgaccaatcagcggatggagctcaccgcggtgcttcgagcgctcgaggcagaccccgcgcccctcgtactcgtgcgctcggactcgcagtacgtcgtgcggtgcttccaggagcggtggtgggcacgctggcggcagaacggctttcgcaacgccaagggccaacccgtgtcgaaccgcgacctgtgggagctcgtccttcgtctcgtgctcgacgagggccgcagcgttcgtttcgaatgggtgcgtggccacgctggcgatcctgggaacgaggaggtcgaccggctcgcccaagctgcggcccgtgcggtggcgcgcggcgtctgacgggtgcgccgacgacctcgtcactaaggtggcctcatggagctgcgtggatcgtcggtggtggttacgggaggcgcctctggtcttgggctcggggtcgccgagcgcttgatcgggcgaggtgcccatgttgtgatcgtcgaccgcaatgcggaggccggggcggccgttgctgcgcgactgtccgccgagttcgtcgaggccgacgtgacggacgaagagcaactcgctcgcgcgttcgaccgggctgcagcgttggggccagtgcgtatgggcgtggcgtgtgcgggcatcggaattgccgagcgtgtccttggccgctcgggcgagccgcatcagttggcgtccttccaacgggtcatcggggtcaatctgatcgggacgttcaacctcctccggctcgcggctcgcgccatcggagcgagcgagccggccgatggcgagcgcggggtgatcgtgctgacggcgtcgatcgcggccttcgatggccagatcggccagatcgcctatgcggcctccaagggcggcgtcgtcggcatgacgttgccggccgcacgcgatctcgcgagcgcgcagatccgggtcgtgacgatcgcgccgggcatcatggacacgccgctgctcggtcaacttcccgaggaggtgcgccgcgacctcggcgcgtcgattcccttccccaagcgactcggccaaccagccgacttcgcgcagctcgtcgaggcgatcgcagagaaccactacctcaacggtgaggtcatccgcctcgacggcgcgctgcgcatgccgcctcgatgaaccggcgcgcggagtcgtcgatcggctgacctaggctggttcgcgtgcgctacgtcgaggcagccggactcaaggtgtccgcggtcggcctcgggacgtggcagttcggctcgcgagagtggggctatggggaggcctacgccaaccacgatgctcgcttgatcgtcgagcgggcgctcgagctcggcgtcaccttgttcgacacggctgaggtctacggttcggggcgctccgagcggatcctcggcgaggcgctcgcgtcgtcgcgggccaacgtggtcgtcgccaccaagtacgctccgacgctgccgatcccgggcagggctgctcgccacctccgcgcctccgcccagcgtctcggtcgtgacgccatcgacctctaccaggtacacttcccgaatccactggtgcccacgcaccagctgctcgaggaactcgaggccgaggtgttcgctggtggggctcgtgcgctcggggtgtccaacttctcgttggcggcctggcgcgccgccgagcgaacaggtcacgtcccgatcgtctcgaaccaggtccacctgtcactggtggtccgccgcagccttcgggagttggtcccgtgggcccaggccaacgaccggttggtcatcgcctactcgccgctcgagcagggactcctggcagggacctacacaacgacgcatcggccgaggggtgtgcgtcggctgcggcgcgccttctcgccgaccgggctgctccgggcgcgtccagtcctcgacgagttgcgacgcgtggggactcgctacggtgcctcgccggcacaggtggcgctcgcgtgggtgctgtcacacccgaacgtcgtggcgatcccgggcgcgtccagcgtctcccagctcgagcacaacgtcgaggccggggcgctgtcgctcacgaacgaagacgtcgtccgtctcgaggcctctgcgcaagcagcgtggcccgtcaggtgagtgcatcggtgcggcggcgaggaattgtgtggacgttgactgcctggtagaaacctgtatcggaaggagtggaacgaacggtgagtgactcgacctacgacgtcgtcatcctcggtgcaggtccagcgggctacgctgcggcgctctacgggggatcggctggcctcagcatcgccatcgtggaacaagatcgcgtgggcggtacgtgcttacagcgagggtgcgtgccggccaaggagtttctcgagacagcgaccgttcggcgcacgatcgaagcggcgggagcgttcggtatcggtgccacgtatacgggcctcgatttcgcgacggcgcaggcacgcaagcaggacgtcgtcgccaagctgaccggtgggctcacgggactcatgcgttctcgcggcaacaccatcgtcgaagggcgcggtgtctatcgtggcggcggggtcatcgaggtcggcggcgagcggctcgtcggcgaaacggtgatccttgcgccgggatcggttccaaggaccatcccgggcttcgacgtcgatggtgaggtcgtcctgacctcggacgaggtgctctcgctgaccaagctgcctgacagcgtggtcatcatcggcggaggcgtgatcggctgcgaattcgcctccatgatggccgatctcggcaccaaggtcacggtggtcgaggcactcccgcaggtcctgcccggtgtggacccggatctcgtcggtatactgctccggagctttcggcgtcgcggggttacggtgcggaccggagtcggcgtcagcggcctcgaccggaccggttcgggtgcggtggttcgactcgccgatgggacgcaggtcgaggccgagcaggtcgtggtggcggtcggacgtcgtcccaacaccgacggggtcatcgaccctgcgagtggtgtgggcctcgacgagcgagggtttatcaaggttgatgaccagtatcggacctccgaagcgggggtgtacgccatcggtgatgcgatcgcgacgccacagctggcccacgtcggctttgccgagggggttgcggtcgtcaagtccatcttgggcgagatctccccgtcggtcgagtacgacaaggtgccctggtgcatctatacccatccggagatcgccttcgcgggtctcacggaggagcaggcccgggcccaggggcgtgacgtgatcgtcaagaaggacccgcttggtggtaactcgcgcgcccgaatcctcggcgagaccgatgggatggtcaaggtggtagcggaccgagcgacccaccagcttctcggcgtccacatcgttggcccctgggcaacggagctcctgtcgcccggctacttggcggtcaactgggaggcctcggcggaggaggtcgctgcgttcttgcagccccacccgaccttgtccgaagcgttcggcgagactgtcctcgcactgactggaaggagtctgcacgttggctgatgtcacgcttcctcaacttggcgaaaccgtcaccgaggggacgatcacgaagtggctgatcaaggtgggtgacaccgtcgagatcgaccagccgatcttcgaggtctcgaccgacaaggtggattccgaggtcccttcgcccgtctccggggtcgtcaccgagatcctcgtccccgacggtgagaccgtggacgtggggacggtcctgtgccgcatcgaagccgcggcgtcggctgcgtcggcatcatcggggccctcgacgcctccagccgcacaggccgctccggcgccacagcccgcgtcggcgccacagcccgcgtcggcgccccagcccgctccggcgccacagcccgcgtcggcgccccagcccgctccggcgccacaggctgcaccagtgccccagcccgcaccagcgccccagcccgcgccggtcgcgatggcaacgagcaccagttcgcagccagccccgagcacgcctcctgctccatcagcgcccgtgtcgccgtcgccgagcacggtcgaggccaacggcgtcgccgccggcagcggtcccgaacgagacctcgatggcctcctgctctcgccggtcgttcgtcgtctcatcatcgacaacggcctcgacccgcgagacctccacgggaccggcgtcggcggacggatcacacgaggcgacgtcctgcgcgccctcgacgagcgggcccggtcggctgcgggatcggctccaccggccacgagcgagccggccccctcggtcgccaacgagccggccccctcggtcgcccgtgaggcagcgccgcagccgacggccgcgtcggcgcctgagctctggtcgccgagccaggaaccgacaccgagcaaccgtgcccagcaggtcgtccccgtgtcggccatggagccgagcgaacgtgattacgtcgtgccgttcacgaacattcgacgccgtaccgccgagcacatgatccgctccaaggccacctccgctcatacgctcatgtcgatcgaggtcgacttcgagggtgtcgagcaggtccggcgacgtgtgcgtgagtcgttcgctcgcgacgagggtttttcgctcacgtacctgccgttcgtggtgcgagcctccgtcgaggcgattcgcgcctaccccaacatcaacgcctcggtgctcggtgacgccctcgttgtgcatcgggacatcaacatcgcgatcgcggtggatctcaacctcgaggggttgatcgccccagtgatccatggggccgacgccatcagattgcgcggtatcgctcgcgcgatccacgacctcgctgcccgagcgcgcagccgcaagctgagcgccgacgacatcgccaatggcacgttcacgatcacgaacccgggtccgttcgggaccttcatgaccggggcgatcatcaaccagcctcaggttgcgatcctcgcgaccgacgggatcacccgtcggcccgtggtggtcacggatgcccatggagcggagtccattgcgatccactcggtggggctgctcacggtcaacttcgaccatcgggcgatcgacggcgcctatgcggcggcgttccttgcgaaggcaaagcaggtgatcgagcagacggcgtgggagcaggagctgtgagcgacaccctgcgcgtccggtggctcgggcgaaccgattacgacgacgccctcgagctccagcaccgcctgcacgagggaacggggtcgtggttgctgctcctcgagcatccgcacacctacacgatgggggtgcgcgcgaagcgcgagcacgtgctggtggaccctgccgatgtcggagcacggctcgtgtggaccgatcggggtggtgacgtcacctaccacggacccggtcagctcgttgcctaccccatcgtcgacgtgccggtcgagcccgactcgacgccgcgctacgtccatcgactcgagcaggtgctgatcgagaccttggccgagttccagctcgctgcgttcgcgttggacggctacccgggcgtgtgggtcgacgccgcggcaccgcgcaagatcgcggcgatcggcgtgaaactcacgcggggtcgttcactccacggcatcgcgctgaacgtcacgacggaccttgggatgttcggccatatcgtcccctgcggaatccccgacaagccggtcacgtcgatggccgccgagggcgtcagggtgagtgtggaggacgtcgcgcgggtctttgcccgacgctttgcagtgacgttcggactcgaagcccgaagtgccggtgtcgactggccggtcgcccagccggcgtcgtccgagtcggccacctcgccggtcgagcggcgcttgcaacgggccggcgtctcgctcggcgaagcggttccgttccatgcgcgcaagccggcctgggttcgaccacgtgtccgtcatgggagcgaggtcctcgaactcaagcgtctcgtcggccaactgtcgctcgtcaccgtctgcgaggaggcggggtgccccaacctctcggagtgctggaaggatgggacagcgaccttcatgatcaacggcgagcgttgtacgcgtgcgtgcacgttctgtctggtcgacacgagccatccgctgccgctcgaccccggcgagcccgatcgggtggctgctgcggtggccgccctcgacctcgagttcgcggtcgtcacggccgtcgctcgtgacgacctggccgacggcggtgccgaggcttttgcgcgaacgatccgggcgatcaaactggcgcgtcccaccacgcgagtcgaggtgctgatcccggacttcaagggctcggcggcggcgctcgacaccgtgctcgaggctggtcccgatgtgctcaatcacaacctcgagacggtgcttcgtctgcagcgggccgtgcggccaagtgcgcactatgcccgcagtctcgcggtgttgtcccgagcgcagcgagccggattcgtcacgaagtccggcctgatggtggggcttggcgagtcgttcgacgaactccgtgaggcgatgggggatctcgccgccgcaggggtctcgatcctgaccgtgggacagtacctccgtccgacgcagtggcacgcgccggtcgctcggtactggcatcccgaggagttcgacatgatccgggactacgccaccgaactcgggttccgcttcgtcgaagcctcgccgctcgcacgctcgtcgtaccacgccaagcgcggatcggacgccgcgcaggtccttgcggagcgcgcgtgagcctggtcgagcgctacccggaacgacgtgcggcgctcgtcggcgagctcgtccgcaacggcgtggatgcggcgatcgtgaccatcggaccggagatgccgtggctgatcggctacgaagcgatgccgctcgagcgcatcacggccctggtcgtgcgtgccgatggcacggcggtcctcgtggtgccgcgactcgaggagccgcgggtgcgtcatcgcgacgggatcgacctcgtcgcctggagcgacgggcaagatccgttcgagctcgtggcagctctgctcccaccgacggggcgcatcgcgatcggggagcgcgggcgcgcgggatggctcctcgagctgcagcgtctgcggcccggctgtcggttcgagccggctggtgccctgatcggaccgctgcggcggcgcaaggaccccgacgaggtcgcggcgttgcgagcagcggggacggcagccgaccacgtcgccacggcgctcctggcgggcgagatcgcgctggtcggaaggacggagcgtgaggtgtcgcgcgacatcgccgagcggctgatcgcggctgggcatgcacgtgccaacttctcgatcgtggcgtcggggccgaacggcgcatccccacaccacgagcccggcgcacggcgcatcgagatcggcgacgtcgtggtgtgcgacttcggcggcacgttcgaggtcgacggcgagccgggctactgctcggacaccaccaggacgtttgccgtcgggacggccccggatgggttcgcgtcggtctacgacgccgtgttaggcgcgcacgacgcagcgatcgccgcgatcgtgcccgggatcgtagctggtgaggtggatcgcatcgcgagagagacgctcgtggaggcgggatatgccgagtggttcgttcatcggctcggccacggcatcgggctcgaggaacacgaggacccgttcctcgctcctggggccacgacgacgctcgaggtcggtgacgccttctcgatcgagccgggggtgtatctccccgggaacttcggcgtgcgaatcgaggacatcgtcgtcctgacggaacatggggtcgagcggctgaatcgctcgagcacgcagcggacggtgctcgaggcgcgctgagtcggccgccacgtgcgtcgcggtggcccccgtcgagcaggtgtgcgctcgataggctggcagccatggcacaacgcagtctctcccggcgtgcaacggcgctgggcgtcgtcgtcgtggtcgcggtggtggcgggcggtgccggcgcggtcgttgccacgcgcctctttcccccgaccgtccacctcgatacgccggtgtcccagctcaagccggggccagcgctggccggcggcgtatcgattcctgccatcgtgtcgtcggtcttgccagaggtcgtctcgatcgatgccactggcgatctcatcggcgtgacgaacggcggcccgttcggcctcggtggcggtcagacgggggcggagttcaagtccgccgggaccgggatgatcgtctcgacgagcggcctcgtcctcaccaacaatcacgtcatcgcgggcgcgacctcggtcgccgtcacgctggacggaacgcacacggcgttgccggccaccatcgtgggcacgattccgtcgcacgacctcgcgctcttgcggatcgaccatccgccggcccacctccacaccgtgaccttcggtgactcggctgcactggtcccaggcgatgcggtgatcgcgatcggcaatgcgctcggcctgcaggcgggttcgccgacggtcacgagtgggatcgtctcggccctcggacgggtcgtgacggcgtcgatcccgaccaccggccagaccgagacgctcgacgacatgatccagaccgatgccgccatcaatccggggaactcaggaggtccgctcgtcgactcggctggggacgtggtgggcatgaacaccgcggctgcgggcacgacgtcggacggtacccaggcggagaacatcggctttgcgatcccgtcctcggagctcatcgcggagctcccggtcctcgagcatggcggcacgtcgggagcccctggcgccttcctcggcgtcgaggtcgaagatgactcctcggcgctcgcggctcagttcgggctcccggtctcgcagggggcggtcgtcgtgtccgtcctccctggcaccgctgcggcgcaggctggactgagcgccggcgacgtgatcgtcgccttcgatggacacaaggtgacttcggcggcagcgctcggcgcgatcgaggagacgttgcaccccggcgaccaggtatcgctctcgtactggacgtcgtcgtctgagcgaacggtcaccgtgacgctcgggactcgcccggcgagctgactcgtcgcacgctactcgacgccgacgtctttggcccgcaggtgcatcccttcctgccagcgagcgagcgtccagagggcgtcggagagtcggttcaagtacgcgccgacgtgcgagctgggcgccgatgcgacgaagcggaccgcgaggcgctccgcgcgccgacagacggttcgggcgacgtcgagcgctgccgcggtcggggttccaccgggaacgacgaagtctcgaatcggctcgaagcgttcactgacgtcgtcgatgagccgctcgagccgctcgaccatcgccttcgtcacgagggtttcacccgggacgagcttgcttcggtgctcgggcagcgtggcgacttcggccatgaggacccacaggtcgcgttccagatcgagacagatggtcgcgaggtcgacggctgcactggccctgacgaccccgagctgggcttgggtctcgtcgacggctccgttgagctccacttgcgggtgatccttcggcagtcgaccgccatagagcatgccggtcgtgccgccatcgccgcgacgcgtgtagatcggcgtccggcgtcgtgctgcaccctccacgatccacctccccggtcccggtagcctagttgtcgtgaggacctacgaggagctgctgcgtgagcgtgtcgtcgtgttcgacggcgcgatgggcaccaacctgcagctggccggcctcggcgccgacgactttgggggtcccgcgctcgagggttgcaacgagatcctcgtcgtgacgaggcccgaggcggtggccgcggtgcacgactcgttcctcgccgtcggtgtcgacgtcgtcgagaccgacacgttcggcgccttggcgccggtcctggccgagtacggtatcgccgagcgtgcctacgagctcaaccttcgagcggcccagctcgctcgagacgtcgcctctggctatgcgacgcccgatcatcctcgcttcgtggcgggctcgatggggccggggacgaagctgccctcgctcggccagatccccttcgaggacctgcgagacgcctacgaggtgcaggccgagggcctgatcgcgggaggtgtcgatctcctgctcgtggagacggtctacgacctgctctctgccaaggcggcggtgatcggcgcccgtcgagccatgcgccgactgggccgctcggtcccggtccaggtgcaggtgacgatcgagaccaccggtcggatgctgcctggcacggaggttggtgcggcactcgccgcgctggagcgtctcgacccggtcgcgatcggcatcaactgcgcgaccggtcccgaggagatgggcgagcaccttcggtatctctcggagcatcagcgcgtgccgatctcgtgcctgccgaacgcgggcatgccccacgtcgtcgacggtcacatgcactacgacctgaccccggacgccctggcggcggcgcaccgtcgcttcgtcgacgaactcggggtcgggatcgtcggtggctgctgtggcacgcggcccgagcacctgcgggccgtcgtcgaggccgtcggtgaggcggtcccgagagagcgccatccgacgccacgggcacaggtggcgtcgctctaccaggcggtcgagctgcgacaagacctcgccatcactgcggtgggtgagcgcaccaacgccaacggctctcgccgcttccgcgacgccatgctcgctcgcgactgggacacctgtgtgcgcatggcgcaggatcaggttcgcgacggcgctcacatgatcgacctctgcgtcgactacaccggcgaggacggcaccgtcgccatggaggagctctcgagccgcctcgcgaccgcgtccacgttgccgatcatgatcgactcgaccgaagcggcggtggtggagaccgcgctccggcacctcggcggcaggccgatcatcaactcggtcaacctcgaggagggtgaggggtccaatacccggttcgactccttcttgcgcctcgcgaaggactacggtgcggcggtggttgcgacctgcatcgacgaggaaggccaggcgcgtaccgcggcgcgcaaggtcgagatcgccaagcggatcgttgcactcgcggtcgaacgctacggcttggccaccgacgacatcatcatcgatccactcgtcctcccggtgacgaccgggatggaggagtcacgacgtgacgcgctcgaaaccatcgaggccctgcggcgcatcaccgccgagatgcccggcgtctcgacgctggtcgggttgtcgaacgtctccttcggtatcaatgcggctgctcgtgaagcgctcaacagcgtgttcctcgccgaatgccaggcagccggcctgagtatggccatcttgcacccctcgcggatccagccgctcgctcgcatccctgaggatgtgcgcgcgatctgcctcgacctcatctacgatcgccgcggccagggcgacccgcttgcccgcctgatcgagcgcttcgcggacgtccaggcggtcgcggtcacgggcgaggagctcgaggccctctccgtgccggaacggctgcaccggcgcatcgtcgacgccaatcgtcagggcctcgaggatgacctggccgccgcgctcggcgagggcatgagcgcgctcggcgtgatcaacgacgtgctgctcccggcgatggccgaggtcggcgacctgttcgggtcgggccagatgcagcttccgttcgtgctcgcctcggccgagacgatgaagcaggcggttgcatggctcgagccctacctcgatcgcgcatcggtgaacgatcgaggcaccgtcgtgctcgcgaccgtccaaggggacgtgcacgacatcggcaagaacctggtcgacatcattctcaccaacaacggctatcgcgtggtgaacctcggcatcaaggtcgccttgtcggagatgctggcggccgccgaagagcaccatgccgatgcgatcggcatgagcggactgctcgtcaagtcgaccctcgtgatgcgcgacaacctggtcgagatgaacgaacgaggaatggcccacctgccggtcatcctcggtggcgccgcgctgacccgtaccttcgtcgagcgggacctgcgccaggtgtacgacggtcgggtcttctacggcaaggacgcgttcgaggggctcgatgtgctcgagcggttggggcgcatccgtcgtggcgagctcgacgatcccgagttcgggcgttcgatccggcagtcgagcacgaggacgccgcggctcctgcgacgctcgacgagtgagcgcaccgagcgatcgccgacggtcgcgatggacaacccgatcttccgtccaccgttcctcggcacgagagtcgtgaaggggatcgcgctggacgacatcgcggcctacgtgaacgagaccgcgctgtttcgtcaccagtgggggtatcgacccgaaggcgatgaggacgacgcggccttcaagcagcgcttgcgcgcggagctgcgccgtcagctcgaccgtgcgctcgtggaccagagcctggtgccccaggtcgtctacggctacttcgtcgcggcttccgagggtaacgacctcgtggtgttcgcggacgaggcgcgtgagcacgaactcgctcgattccgtttccctcgccaagagcaggagccgtacctctgtatcgcggacttcttccggccgctcgcggggcccgagatcgactacgtcgccttccacgtggtgaccatgggtccgcggatcacggaggtcgccaagcgggcgttcgacgagaatcggtaccaggagtacctcctcctccacgggctcggagtcgagctcaccgaggcgctcgccgagtactggcatgccaggatccgagcggagtggggctttggcgacgaggacggcccgacgctcgcggggctctttcgtcagcagtaccgtgggagtcgctacagctggggctacccagcctgtccggacctcgaggacaaccggacggtcgtcgatctgctcgatgccggtcgtatcggggtcagcgtgtcggacaccttccaactggagcccgagcagaccacgaccgcgatcatcgttcaccatcctcaagcgaagtacttcgtcgcctagcgagcggatcgccgaggggcgcatgacgcctaacgtggggccaacgaacgttcacggtgacgagacgagagggagccccgcatgggtgtgacgacgaacgtggtgagtggtgtcgaggctcgcgggctgcgggttcgactcgacgcagcgagcgagcgtgaggacgcctggcgcaccgagatcgtcggtgacgaactctggtgggtcaggggctacgacctcgaccacggcgcgcggggagccggggccgatgtcgtggcgctcgccgccgaccgccacgcgaccgacgtcagcgtcgatctggggtcgcacgacgcgatcgttgccgaggagttcgccctcggcgcgctgctcgcgagctaccggttcgatcggtatcgacacgcctcggcgccggctcagacctggcccaccgaggtcgtcgtgatgggtgacgtcgcgcgtgcggcgctccagcgggcgaggagtcgagcggaggcggtggcgttggcacgcgatctcgtcaacgagccgccctcgaggatgacgccgacggtcttcgcacagctcgccgagcaggtggccgatgcggcgggtctcgaggtgcgcgtctgggaccgtgcggcctgcgaggctgagggccttggcgggctcctcggtgttgcacgagggtccgtcgaggagccgcgggtcgtgcacctcgtctatcggcccggggcgcccaccggtgagccggttgcgttggtcggcaagggtattaccttcgactcgggcggtctcagcctcaagagcgccgacggcatgatgtccatgaagacggacatggcgggcgcggccgcgattctcgcggccatgtccgtcctcggtgagctcggctgtacgcgtgaggtgcgtgcgtacctgatgctcacggagaacctcccttcgggcagcgcgcaaaagcccggtgacgtgctcgtcacgcgctcggggaccacgatcgaagtgctcaacaccgatgccgagggccgcttggtgctcgccgacggactggcgctcgcggtggaggacggcgcgagcgccatcgtcgatctggcgaccttgacgggcgcgtgcgtcgtcgccctcggcgacgaggtcgcgggcatcatgggttcggatccgaatctcatcggtgcgttgcgcgcagccggtgaccgcgaggacgaacccctctgggaactgccgctgccgtcacgctacgaggcacacatcaagagcagcgtcgccgacgtgaagaacatgggcaagcctggcaaggctggggccatcgcggccgcgttgctgctcaagcgcttcgtcgggtcggttccgtgggcacacctcgacatcgccggtccggcgcgcgccgatggcgaccgagggtgggtgcgcgagggtgcgaccggtttcggggtcctcaccttgacgcgctggctgtgcggaccgacgctcgacgacgctgctcgttgacggcccgggtcaccgcctcgaccgtatagccctggcgaacgaggcgtgccgagacctcggcctcgctcgcgcccaggccgagcagggtcgcggtgagctggcggagcctcgcttcgcgtcgctgcgcgttggcgacctccgaggcgctcgggtgccaggcgtcgacgaggcgcagtgatgcggggagcgcacgacgctgacgcgcgctcagatgcggcacgggggaacggatctcgagccggtttcgttcgacgacgcgagccagttcgaaggtcgcgaggcgctcgatggcgcgcacgatcgagcgcaggccggtgtcgtgcgaacggaggccgaggctcgcgccgaggtcgtcgagccgtacgagcgcgggtccgtgctcgctgagcgcgtcgagtcggcgcaggagagcgagggcggtcggcccgatgaggggcagccacagaagttcgacctcgtcggagcgggggctccagccgggctcatgcgtgtgccaccggtcgatggtgagtgctggatcgagctgtgccatgggccatcctccatgatgcgggctcgggcctccctagcccgagcgcggatcggaacgtcctgttccgccttgcgccgtgtggcgcgcactccagtatgtcagctatgacgtttcatgtcaagcgatgtccgtccctacgagccgtcgtactcgccgaagactcctcgtagggtgtcggcgacctcgccgagggtcgcaccagcgcggagtgcagctcgcatgggatagagcaggtttccggtgccgcgggcggtggcggccaggtcatcgagggtgccagcgagcgcctcggcgtcgcggtgacgacgccaccgttggacccgcgcggcttggtcgcgctggaaggccgggtcgatggggaagacctcgggggcttctggctctggttcgcggtagcggttcacgccgacgatgatggtccgaccctcgtcgatggcggtggcggcctcgtaggcggagcgttcgatctcctcctgcatccactgctgttcgatcgcggcgaccgcgccaccgcgcgcatcgatctcgtcgatgaggtggcgtgcactggcctcgaccgcatcggtcagggcctcgacgtagtacgagccggcgagcggatccaccgtgtcggtcgcgccgatctcgtgggcgagcacctgttgggtgcgcagtgccaacttggcggcgtgttcggtcggaaggccgagcgcctcgtcgaagccgttggtgtgcaggctctgggttcccccgagcacggcggagagtgcctggagggtgacccggacgatgttgacctctggctgctgggctgtgagggccgatcctgcggtttgcgtgtggaagcgcatcagccagctccgctcggacctcgcgccgaagcgttcgcgcatgatgtgagcccagatacgtcgagcggctcggaacttggcgatctcctcgaagaggttggtgtgagcgttccagaagaaggagagccgcggcgcgaaggtgtcgacgtcgaggccggcggcgagcgccgcgtcgacgtaggcgatcccgttggcgatggtgaacgcgatctcttgggccgccgacgcgcccgcctcgcggatgtggtagccggagatcgagatcgtgttccactggggcaggcgatcggcgcagtaggcgaaggtgtcggtgacgagccgcatcgatggtcgaggtgggaagatgtaggtgccgcgggcgacgtactccttcaagatgtcgttctggatggtgcctcggaggtgctccggtgcgaccccttgctcttcggcaacgagttcgtagagcagcaagagaactgaggcggtcgcgttgatggtcatcgaggtcgtcacccgctcgagggggatgtccgcgaagaggcggcgcatgtcgtcgatggtcgagatggcgacgccgacgcgccctacctcgccgtgcgcgcgcgggtgatcagcatcgtagcccatctgggtggggaggtcgaaggcgacggagagacccgtttggccagcctcgaggaggaacttgaagcgctcgttcgttgcctccgcggtgccgaagccggcatactggcgcatcgtccatgggcgatcgcggtacatccccgcgtggatgcctcgggtgaaggggaaggttcctgggtcgcccaggtcccggtcgtagtcgaggtcggcgaggtcctcgggtcgatagacgcgtcggatcgggatgtgtgaggaggtgagacgctcgtcgtcggccacgggctcatcctaccgacgtctggtcctcgcgccacggcgacccggcgtcctcgtcgagcgctcgagcgagcgcgtaggctggtgcgaggacagcgcgacggtgaaggccgcttggcgcgtgagcgttgggcgcgacgaacgatcgtgatgccacgggaggagcgttgcgtggagcagctgagtgccgagcagttcacggcggtgcccacgttgagcgcgtgggaggttcgtgggcacgttgccgtgtgtcggttcgcgaccggtgacttcgcgaccggcgtgaggttgctcgaggacgttgcccatatcgctgacgccctcggacaccatccggacgtcaccatccgcttcggctcggtcgaggtggcgaccaccacctacgagacgggcggtttgacggaccgcgacgtcgcacttgcgcgtgcgatcacggagcttgctcgacggttggggctcacgcctcgagacgcgtagcaaccagccaccccgagctggaggaggccgccggtgaggctaggggcgcacggggtggggcaggcatagatcgtcgtaggcggcgatggtgatctgtgcggggtcgaggctacaagccggacacgccggatcgcggtggaggcggtagctgtggaaggtctccgcgagggcgtcgaaggtgaggaggcggcctgcgagggtgtcaccaaggccgaggatgagcttgatcgcctccagggcctggattgaccccacgatgcccgggagcacgccgagcacgccggcctccgcgcacgacggcgcgagctcggccggtggtggctcggggatgaggcaccggtagcagggcccgtcgtagggcgaaaagacggtgacctgcccctcgaagcggaagatcgacccgtggacgaccgggatcttgagcttgagggaggcgtcgttgacgaggtagcgggtcgggaagttgtcggtgccgtcgacgacgacgtcgtagcccgacaggatctcgaggacgttgtcggcatcgaggcgcaccggatgcttgaccacgcggacgtccgggttcagctgtgcgatcgcggcttcggcggagtccaccttggccatgccgacgcgatcgagggtgtggagcacttggcgttggaggttcgaggcgtcgacgacgtccatgtcgacgatcccgatcgtgcccacacctgccgccgcaaggtagagggcagccggggaggacaggccgcccgcaccgaggagaaggacgcgcgcttcgagtaggcgcagctgaccagcttcggagacctccgggagcagcaagtggcgatggtagcggcttcgctgctcaggggtgagtgtccggggcgtcgaccaggcccgtccctcgtccttccagcgattgaagcctcccgccatggagaccacgcgctcgtagccgagatcgccgagcgtcctcgcggcgaacgccgagcgtacgccgcccgcgcagtagacgacgatcggcgtcgacttgtcggggagtttggactcgaccacgagctccaggttcccgcgagggatgaacaccgccccggcgatcgcgccttgctcgtattcgtcctgttcacgaacgtcgaggagtgcccaaccctcgcgttggaggcgagcagcctcgtccgtcgtgacctcgtgtaccgaggccttggtctgaaacagcagatcgcgaaagcctgccacccctacgcacctccggaccgtccgccctgtagcttacggagcatcggcacgaggcgctgcgcctggaggtcgagcggcacgacgcggtcgcgggggtcgaggcgccctcgcctcgacggtgagccgtgcactggctcgggaagggggtggccgagcgcgaccgtgatgacgatgcggctcgtctgagcgagtccggcgaggtcgcgcagcacctcctcgcctcgaaaggtgccgatgacggctgccccaatgtcgagcgcggtcgcggcgacgaggatcgcttccagtgtggcgccagcgtcgacccaccagtaggggatgggccatcgttccaggctccagagtccggcggcgcgcttgtcgggggcaccgtagcgttcggcgtaggccgcggggtcgacggtgacgaggagcagggccggtgcgcgttcgagtcctcgcatctcgggacgcgcggccagccaccccggcgtcgtgagtgctgcgaggatccgggcgcggctctccggttcgcgcgcgatcgcgatggtgacggcctgtgtgaagccggcggacggcgctcgcagcccggcgtcgacgatggccgcgagcgtcgcgtcgtcgatcggatcggcagtgagcgctcggcgcatccgtcgccgccgaatcgcagcgagcgcctccacggtgctactcgatcacgacgacgatgtcgcccgtgccgacggtgtcgccggggttgacgcgcacttcgcggacggtaccggcgcgctcggccaagatggcgttctccatcttcatcgcctcgagcacgatgacgacctcaccagcgtcgacctgttgccctggggagaccgggaccttcaccacggtgccctgcatcgggacgctcacctcgccggagcccgtctgtgctgctcgggcaccggctctggccgatgagcttcgctgaggtcggctcggtgcattcggcgtgcgcggagcaggcgcactcggtgctgcggcgtcgagatagagcgtgacggcgacacgcttgccgttcacctcggcgatgaccggggtgggcacgagctcgtgagcgtcctgggatgcggtcgcgacgggggccacgccgcccaggtcgaggcgttcttccacccaacgggtcgagtgggttcctgcgcgaaagtcggggtggtccaagatggcgacgtcggccggtgtggtcgtggcgacgccctcgatgcggagctctccgagcgctcggatcgcacgagcgatggcgtggtctcgatcggcggcgtggacgatgagcttggcgaccaggttgtcgtagtactgcgagaccgtgtcgccggtgtcgtagccagcgtccacgcgcacccctggtccgtcgggccggtcgaagcgggtgatggtgccaggggtcggcatgaagcggccaccggcggggtcctcggcgttgatccgcacctcgatggcgtgtccgcgccgcacgacgtcgtgctgggagaagccgaggggctcgccggcggcgacccgaagctggagctcgacgaggtcgagacccgtcacgagttcggtgatcggatgttcgacctgcaggcgcgtgttcatctcgaggaagtagaacgcgccgtcttggtagaggaactcgacggtaccggcgttgcgatacccgcaggcgcgcgccacggcgcacgcagcctcgcccatcgcgcgccgggtctcgtcggggaagtgcggtgcaggtgtctcctcgatcagcttctggtggcgtcgttgcgcggagcagtcgcgttcgctcagccacaggaccgagccgtggtcgtccgcgatgacctgcatctcgatatggcgaggccaggcgaggtagcgctcgaggtagcactcgtcacgtccgaacgcgctgcgtgcctcgcgccgtgcggaggcgagggcctcggccgcctcgtcggggcgggtgacgacgcgcatgcctcgcccaccgccgccataggcagccttgatcgcgacgggccagccatgctcgtcgccgaaggccacgacctcttcgggatcgtccaccgggtgggtgaggccggggacgccggcgacgccagcggcttcggcggctcgtcgggacgagatcttgtctcccatgacctcgatcgcgtcggggggtgggccgacgaacgtgacaccggcctgggtgatcgctcgggcgaagtcggcgttctcggagaagaagccatagccggggtggacggcttcggcgccggagcgctcgatgatctcgaggagcttggtcgtattgaggtagctctcttggctggtgagcccgccgagcgcccaggcctcgtcggccatgcgcacgtggagtgcatcgcgatcggcgtcggagtacaccgcgatggttcgcagtccgagctccttggcggtgcggatcacccgaaccgcgatttcacctcggttcgcgaccagcagcgatgaaaacacgcgccctccttttgctcgccccgcgctcagggctccgccactcggcgactctagggtggagtccgtggcaggacgtcgagcgccctggcggctgatcctatcggacgaggtcgactccaccaatcgcgtcctcgcggctcgcgcccggtgggccggcgcgcacctggtggtggtcgccgatcaccagcgcagtggtcgtgggcgccgtggtcggaccttcgtcgacgtgcccgggggctccctgctcgtctcgtcgctccatcgctacgaggcaccggcgcgcccgatgctcctcggagcgtccgtcggtggcgctgcggccagcacgctgcgccgcctcggcgtcgcccagggagcgtggctgtggccgaacgacgtggtggtgggcgaggccaaggttggcggggccctgatcgaggcgtcctggcagggcggttcgctcgagttcgtcgtcgggttcggcctgaacctcgccggttgtcccgaggtgccaggtcgccagctcgccgacctcggctcgctcgctggccggtcgatcacacgcgacgaggccctcggggtctggctcgaggagctcgcgtcctggctcgagcgctggtctcggggcgatgacgtgctgggcggtgcgcgtgcgttgctcgcggggatcggcgaggaggtcgttgtcgaacgagctgcgggtgagcttcgcggacgtgtcgtcggattgggtccctcgggtgccttggtgctccgtcacgacggtgctacgttcgaggtgagcgaggcagacctcgtccgtctcgtccgctcgtccacgggagccactcgagccgacgaccaaggaggcacgcacgcatgacggtggagttctcgccggaacacgagcagctgcggtccgtggttgcggacttcgtcgcgggagaggtcgcgccgaacgctgccgcgtgggatcgtgaggagcgattcccactcgaggcggtgcgcaccatgggcaagctcggcttgttcgggatcccgttcccgtcgcgctacggcggcggggatggggacttcacctccttgtgcatcgcgatcgaggaggtcgccaaggcggactcgtcgctcgcgatcaccctctcggccggtgtcgggctcggtgcgagtccgatctaccgcttcggcaccgacgcgcaacgcgaacgctggctcccagccctcgtccggggcgaagccctcggtgccttcggcctgaccgagccggaggccggatcggacgccggcgcgacgcgaacacgcgccgagcgcgtcgctgaccgatggcgtctgcgcggcgagaaggcctacatcacgaactcgggcacgcccatcacctccgtcgtcaccgtcacggcgcgaacggacgaagggatcagcgcgttcatcgtgccggccgggaccgctggtctcacggtgctgccgtcctatcgcaaactcgggtggcgcgcgtccgatacccacggcatcgtgctcgaggacgccgaggtcggcgacgacgcgctgctcggagcgccaggggctggctttcggcagttcctcgcgaccctcgacgagggacgtgtcgccatcgcagcgctcgcgctcggtctccaggaggcgtgcctgcgcgagggtctcgagtgggcgaaggcgcgcaacgccttcggcggtccgatcggtcggtttcaggcgatcgccttcaagctcgcagacctcgaggtcgcggtggaggcctctcgtcatctggtctaccgtgcggcctggctgcgtgatcagggacgcccgtttgcgcgcgaggcggcgatcgcgaagctctatgcgaccgaggcggcggtgagcgccgccagggaggcgacccagatcctcggtggtgccggcttcatcgaggacaccccggtcgcgcgctactaccgcgacgcgaagatcctcgagatcggtgaaggcacctcggagatccagcgcttggtgatcgcgcgctcgctcgggttgagcccgagctagcatgagcgccgcatggatcggctcgtcctatgaaggcgctcgtcctcgctggcggttcggggacgcggctgcgtcccatcacccataccgcggccaagcaactggtcccgatcgcgaatcggcccatcctcttctgggcgctcgactcgatcgccgaggcgggcatccgtgaggtggggatgatcgtcggccacacgaaggacgaggtccgcgctgcggtcggcgatggctcggccttcgggctctcggtcacttacctcgagcaaccccagccgctcggactcgcgcacgcggtcagcgtcgcgcgtgactggctcggcgacgacgacttttgcatgtacctcggcgacaacgtcttgctcggtggcgtcgcgccattcgtcgagcggttcggtcgacccggccgtagcgaggacgcactcgtgctgctcgccaaggtcgacgacccgacgcggttcggcgtcgcggagttcgacaccgaggggcgcctcgtccgcctcgtcgagaagccgtcggtccccccgagcgacctcgcgctcgtgggcgtgtacttcttcagtccagcggtccacgacgccatcagccagattcgcccgtccgctcgtggtgagttggagatcaccgacgccatcgacgcgctcatcacgagcggacgcatcgtggacgcgctcgcggtcgatggtttctggaaggacctcggcgaccccgaggcgctgctggccggcaatcgcttcatgctgctcgggatcgagggttcggtcgaggggacggtcgtggactcctcggtggacggcccggtcgtggtcgagcctggtgccgtcgtggagcgcacggtggtgcgcggtcccgccaccatcggtcgcggggcccgcatcgtcgatgcgtacgtcgggccgttctctgcgatcggtcccgactgcgagctgcgggccaccgagatccagaactcgatcgttctcgccggcgccaggatcgatggtgtcggcccgttggacggctgcatcatcggacggagcgctgtcgtcgagcgccgaggccacctcccacgtgcgaccagcgtcgtggtcggcgaccactctcggctcgagctcgcctgagccgagaggcggccaaggtcggtcgctaggctgccgggcgcccgtcgagggtgcatcgcaggtgaggaggagtggcatgcggcttctggtgaccggtggagcgggattcatcggctcgaactatgtccacgagcgagtggcccgccacccagacgaccggatcgtcgtgctcgatgccttcacctatgccggctgtcgtgagagcctccgcgacgtcgatgaccacattcgcatcgtcgaaggcgacatcggcgacaccgagctcgtgagctcgctgctcgacgaggagcgcatcgaggtgatcgtcaacttcgccgccgagtcgcacaactcgctcgcgatcatcgacccggagcgcttcttccggaccaacgtgctcggcaccgtcggactgctcgaggccgcgcgtcggcacgacggcttggtgcgattccatcacgtctcgacgtgcgaggtctacggcgacctggagctcgacgaggagcgagccttcaccgaagacgacccctaccggccccgcaccccctacaacgcgtccaaggccggcgccgatcacgccgtgcgggcctaccacctgacctacggcgtgccgatcacgatcacgaactgcgccaacaactacgggccctaccagttccccgagaaggtgatccctttgttcgtgacgcgcgcgctgcgtgatgctcccctgccgatgtacgcatcgaaggagaatcgccgggagtggatccacgtgcgcgatcacgcggccgcgatcgaccgggtgctggaggccggcaccgtcggcgagacctaccacgtgggcaccggcgtcgagcgctcgatcgagcagatcgccacttcggtcctcgacctgctcggcaagccacggagcctcatcgaggtggtgcccgatcggccatcacacgaccggcgctacgtgctggactcgacgaagctgcgcaccagcctcggttgggagccgacggtcgccttcgacgaaggccttgcgtcgaccgttgcgtggtacgtcgagcatcccgagtggtgggagcccctgcttggccgtgctcctgtcgtcgaaggcgaggcctggcgccggtgagcgatcgcatcgtggtcctcggtgcgggcggtcagctcggtcggcggttggtgcgcgcgttcgagcgcaccagcgccgcggaggtcgtcggtctcgatcgtcgagcactcgacgtcaccgagcgtgtggcggtgcacggtgccgtcgacgcactccggccacgctggatcgtgaacgccgccgcgatgacggccgtcgacgcctgtgagcgcgaggtagagcgggcggttcggctcaacgccctcgccgtgcgttggctcgtcgaggccgccgagcgcgccggtgcgcgcgtatgtcaggtgtcgaccgactacgtcttcgacggtaccgccacgcgtccttatacggaggccgaccagccgaaccccatgagtgtctacggcctcacgaaactccagggggagcgcgagttgcgtcccgggatcgacagttgtgtgcggacctcctggctgatgagtgccgacgatcgttgcatgctcgggaccatcgaccgccttcgccgaggacctgggcccttgcgcttcgtcgaggaccaggtcggttctccgagcttcgcggacgacgtcgcgctcggcatcgtggagctcgtgcgtcgtgaggtgaccggcgtcatccacgtgacgaacgacggtcaggcgagctggtacgacgtcgcgagggaggcacttcgggcctttggcgacgatccacaccgagtcgagccgatccccacgacgcaactcgccggcagcttcgtcgctccgcgacctgccttctcggtgctcgccggggtcgtgcgcgccgcggtcgggctcgagcccctgcgaccgtggcaggaggcgctcggagctgcggtcagcgagcgtgctcgtggatgagctctgggcggtcgtggtcgactacgggggccacgccgacgactcgctcctcgatgcgctgatcgatgccggtgcggcacgcgtggtcgtcgtcgacaatgcactcgctgtggcgagctcgcgcaccgagccacggggccagggggtcgtcgagtttcggtcctacggcgccaacctgggcttcgggggtgccgtcaatcgggtccttgcccgtcgaggagccaggtggctgctcatcgccaacccggacatcgagatcgctccgtccgcgctgcggacactcctcgcgaccggcgagcgctggtcgcgagctggcatcgtcgcgcctcgactcgaagaccacgcaggccaaccccaggcgagcgtccgagcgttcccgagcctcgcgctcgcggcgctgcacggagcactcggcgtcgtctggccgtcgaatccggcgtcacggcgctatcggcgcgaagtgcccgatccgccgaatgcatacctggcgccgtgggtctcgggcgccctgatgctcgcgcggtgggaggcactgtcggcgatcggtgggttcgacgcgagctacttcttgtacctcgaggacgtcgatctcgcctggcggctcacgcgggccggttgggaggtcgtcgtcgatccgaccgtgcgtgtccgccacgtcgggggtgccaccacacgctcccgacgcgtggtggcggccctctggcacgcacgttccctggttcgctacgggctcgcgcaggaggacacggccactggcgcggcgttggtgctcttcggcgtgcttgctcgttgggcagtggtcgtcgtggcgtcgcgacgcagctcagcggacggatgagtcgctaacctagtgccggtatgcccaacccccaggaaggagctcggcgagtccagcgcgccaaggcggctggtcgaggggctcacgtaccgcgtgagattcccgtcgggttctacgctgccctcacgatcgtcgcggtgctcggcatcgctgccatcggctactcccgctacgaggtcaaccatccggtctccgcgacgtcgtcgcagtcgccgcctcgcgtcggccagacgtggtacaccgcactcgggatcgaggtctgcgggcacttcgagccggtgctcgccaagggttcaggtgctgcgagcggcatgacggccctcggcaacggggtcgtcaaggtcgcgccgaagacaccggccgagaccggcgctgcggcgacgctcgtgcacttcctcgacgcggcgggcgtgcgcgtctcgacgtcgagcgtcgtcctgcctgggcacgcgagcatcgacgtcgcgagcgtgtgcggccagcggccggtcgaggtgcgtacggcgacgtgggcatccctgcttgcgactcggccgacgatccatgcggggacaaccggtgtgcgcatgctgagcggcgaggtcgtggccgtcgcggtggtgaccaagggcgcgacgatcgcccagcctcccacggccgccaacctcgcgaacgtctaagggtcacccgaggacacgcaagaaagtacggagggcgcgtgcaagcgatcatccttgtcggcggggaggggacccggctgcggccgctcacgctgcatcaacccaagcagatgctgcggttgctgggctttcccatgctcgagcgcgtcgtcgagcgtctcgccgcgatcggcgtcgatgaggtcgtgctgtcgctcggataccagcccgatgcgttcatcgcgcgctatcccgaccaccgcatcggcacggtcaaggtgcgctacgcggtcgagccggagccgctcgacacggcgggcgcgattcgcttcgccgtggacaagggcaacgtccacggcacgttcttggtcgtcaacggcgatgtgctcaccgacctcgacgtcgcccagctcgtcgacttccatctcgatcgaggcgcactcgcaacgatcggcctcgtggaggtcgatgatcccagccgcttcggtgtggtcgtcaccgacgaccggggccgagcggtgcgcttcgtggagaagcccccgagggatcaggcgccctcgcacgcgatcaacgctggcgtctacgtcatggagccggcagccatcgagcgcatcgccgttggcgagcgcgtctccgtggagcggagcctgttcccgcagctcgcgagcgaggggacgctgtgggggctcgcgcagcggtgctactgggttgatgcgggcacaccggcgagctacctgcgtgcggcgctcgacatcgcaacggggcggcgcgcggcgagagtgcgagagggcgtgcggttcccggtcgagagtcgaccccccggtggcgagacgtgttacctcggagagggatcgcaggtcgcgagcgacgccgtcgtggacgccgcgatcatcgaggacgatgtcgtcgtcggcgacggggccgtcgtgcgatcgtccatcgtcctcgagggcgcgcgactcgcacccggggttcgggtcgagcactcgatcgtcggagccgagacggacgtcccggaggccgtcgagctggtcgatctcgcggtggtcgcgccgtccacggagctcgcccccggccagcgactcgctggcacccgatgagcgaggcgccgccggtactcgtcacgggcggggcgggctttctcgggtcctgggtggtcgagcgcttgttggcacgcgggctgcgcgtggacgtcgtcgatgacctgtcgacggggtcgctcgagaatctgcggcgagcgcgcgaccgacacggcgcgcgactcacggtcgtcgtcgaggacgtgacgagtgccgccatcgggtcgctggcggagcggcggggctggcgcagcatcgtgcacttggctgcccgagcgagcctccgcgcatccacgctcgatcccgtgcgcgacgccgaggtcaacgtcctcggtaccgtgcgcgtgctggaggctgcgaagcgggctcgctcgcgcaaggtggtctttgccgcctcggcggcgatctacggcgaccagcgggcgttgccgattcgcgaggaggcgccgcttgcgccgatgtcgttctacggcgcgggcaaggtggccggactcgagtaccttcgagcggctcgacacgtccacgggacggcgtccacgagcctcgtcttcgccaatctctatggtccgcgccagcgcgctgagctcggcgcggtggttgcgcggttcgtcgacgcactgctcgcggggcacgcgcctgtcgtcgtcggtgacggcacgcagacacgggacttcgtgtgggtgggggacgcggccgatgcggtggtcgccgcgctcgatcgggccgatggggagatgatcaacgtcgccaccggcctcgagacctcgatcgcgggcctcgcacgactgctcgtcgaggtcgccgggatcgacgggctccacccggtgcaccagggacgccagtcggtgggggaggtgcaccgcaacgcgctcgacccctcccgcgcggcgcacctgctcggctggcgaccatcggtccgactcgccgatggcctcgcgcgcacctgggcggctgcgctggaggcgcggcgaatccgcgaggcggcgccgaggtcctgagcagcgctgatcgagctcagtggtcctcgcggcgggcgccgagctctcgatctgccccttcgcagcgcggtcttgacctcgtctggctgctcagaagcccacggctcgccgcggtgctcttcgaggtcggcgcgcccggcgtgggcgtcagcgaaagaggtctcgagcgctgtcgcgcacgatggcgcgggcggacgactcggcgagccaggcggggtcgatgcctcgcacgacgctgaagggcgtgccggcagccttcgtcgcgacgagattcgccgccgctgcgatctcgtcggcgatgcagacctcggtcacgcgcaaggttgcgccggtccagtcggcggtgccacgcaggtcgaggattgcccgaacccccgccaccccgatggcgacgtcggtgaccccctcgcgccacgctcgaccgaaggtgtcggtgacgatgacaccgacgtggaggttccatgcaaagcgcaggcgatcgcgaatccgacgcgccgagcgatccggatcctccgggagcagcacgagcgcatgtgcgggggcgttcgaacggtcgataccggcgttcgcgcagacgaagccgtggtgggtctccacgatgcgcgtggtgccacgcacgcgcagcaccctgcgcgtctcggcagcgagtgcggcctcgaacgcctcgtcgagatgctcggggtcgctctggatcacgcgaccttcggccttggagacggccttttgcgacacgcagacgacgtcgccgtctgcgagctcgccggtcgcgcccaggagatcgccaaggttgtccccggcgcagatctcgcgatcgatggggatcgaccagatcgtgagccgtctcatcggtcagaacccaccacttggacgagccgatccacgaggtcggcgcttcggtcggggtcggcgatcatcgtgtccatcaccacggcccgcacgccatggcgttcgacgtcgccagccagtgcgccatcgcggtggtcgacgacgagggtgccggcgtacggtgcgtagagctgggccacgctcgttgcgctcggttcgaggccgaagtcggccatgatggaggctgcagggcccttgatggcctggcctcccacgatcgggctgatcgcgaccgttcgatcccgtgcgtcgcgcacgaggtcgccgaggtcgccgagttcgaggatcggaaagaccgagaggaacgggttcgagggcgcgatgatcacgagatcggcctcggcgatcgcggtccgtgcatcgggatggggacgcgcggttgcgatgccgtcgtagcggatgcgttcgacgtggggttggtgtcgcatggccacgaagtactcctggaatcccacctcggcgaccccgtcgtcggtccgtaccgtgagcatcgtcgccacctcgtcgtcgctcatgggtacgaggtcgatgtcgatccccagtcggcgcacgacgtcgcgggtgatggatcggaggccctcgcctcgacggagccggtcggttcggtagaggtggaggccgatgtcgcggtcgccgagcgtgaaccacgtcggtcccccgagccgtcgcagcatggtgagcgccgagaaggtctcgggagcgatcccccagccggtgtgggggttcacgaggccgctcagtgtgtaggtgatcgtgtcgaggtcggggcagacgcgcacgccggcgatccatgtgtcgtcaccggtgttgacgaccgcggtggtcgcgggagcgagcttgcgtcgggtgacgccagcgaggaggcgagccgcgccgaccccgcccgagaggacacagatgcgcgggtttggagtcacggccacgaggctaccggtcgaggtgtgacccgatcggcccagagcctcctcggtagactgcgcccgtgctgcgcgtgagcctcgacgtcttgcccctggtgggcgcgaggacgggcgtcggagagttcgtctggcacctcgcgaacgcgcttctcgaggccggcgtcgacgtctcgggctggggtgtgacgtggcgaggccgcgaccggctccgagcggccgtgcccgccgagctccgtgtgcacgacgctcgtctgcctgctcgtccgctctgggcggcgtgggcacggtggcgatggccgtcgatcgatcgcgtgttcgccgacgtcgacgtcgtccacgcgaccaacttcacgctgccgccgctgcgtgagcgcccgagcgtcgtgacggtccatgacctcaccgtcgtgcaccatccgaactggtgtgatcgcgcgacgctcgtctatcccaagctggtcgcggctgcagtgcgcgagggctcgttcgtccacaccccatcggaggcggtcgctcgcgaagtcagggcgtggttgggtctcgacgccgatcgggtggtcgcggtgccccatggcgcccccggggcgccggttgccccgcccgcggcgccagcgaggatcgcgcggctcgccgggcgccgctacgtcctcgcgctcggaaccctcgagccccgcaaaggtatcgacgtgctcatcgaggcgttcgcgcacgtcgccgagcacgagcgcgacctcgagctcgtgctggctggacagtgggggtggggggtcgacgccatcacctcggcgctggtggccagtccggtgcgcgcacggatccgggtgctcggctacgtcgatcccatcgagcgagcctggctgctcaccaacgccgccatgctcgcctacccgagtcgctacgaggggttcggactgccgcccctcgaagcgatggcggccggcgtcccggtcgtcgccagcgacgtgcccgcggtacgcgaggtggtcggctcggcggcggtgctcgctcccgtcggtgatgcggcggcgctcgcagcgtcgatcggccgcgcgctcgtcgacgcggaccgtctgcgcgcactcggcccgagccgagcggcgcagttcacctgggagcgcacggcgcgcgccatgatcgagctctacgagcgggtcgcggcgacgtgagggtcgacatcgtcgtcgagcagctcgcccgtccggcccccggggggatcggtgtgtgggttcgcgaagtcaccccacggctcgcccgacgtcacgccgtgcgtctggtcgcgtcgcgctcggcgcgcctcgacggtgtagtcgagggggccacgacggttcgacggatgccgttgcccgagccgatcgcacagcgtgcgtgggatgcggggctctggggggcagatccgtccgccgatgtggggctctggctgtcgttcggagggccgccgatcgcgcgacgaccgccctcggtggtggtggtccacgacgtgatcttcctcgagcatccagagctctacacgaggcgaggggctcgctggcacgtggcccaactcgaggcggcgctcgcccgtgcgacgcggttggtcgcggtcgatcccaccgtggccgatcggctggtcgcgctcggggcacgagatcgggtccgcgtcgtcgctcccggggccgaccaccttcctccggccgatgcagagggcgcgcgggccgtgctggcgcgagccggggtcgagcgcccctacctgctcgtggtcggtacgctcgagccgaggaagaacctgggtcgcctcgtcgaggcgtaccaggcctatcgcgcgcgatcgttcgaccccgtcgacctcgtcgtcgtcggcccggctggctggggcgacgacgctcggcgcggtcccggggtgcacgtgctcggcacggtggcggcgccgatcctggcgggtctgctcgtgcaggcgagagcgctggcctacgtctcgctggtggaggggttcggcctcccggtcgtcgaggcactgcacgccgcggtgcccgtggtggtgtcgacgaccgtgccggccgcgcgtttcggcggcgttggcgtggatccctacgacgtccggtcgatcacggatggtctcgccgcggtgctcgacgacgaacgggcgcgctcgcggctcgtgagcgagggcttgctcgccgtcgagcagctcaggtgggaccgtacggccgacgcgctcgccgacgtgctcgaggaggtcgccgatggctgagatcgtcatcgatgcaaccagcatccctgcggaactgacgggcgcgggtcgctacgcggtcgggctgtgccgtgcgctcgccgcgctcgaggggcgtccggacatcgaggtcttcacgaccggtgcggcgcgaccccacttcgtcagcgacgcccccggctgggcggtgtcgacggcagccccgcgccacagggtggcgcgcctcgccgcccaggaactgctcgtcggccggcgtgcacgccgccacggagcccgcgtcatccacgggctgcactaccagctcccgagggcacgtggggtcggcctcgtcgtcaccgtgcacgatctcacgctcatcgagcatccggagtggcacgatcgcgcgaaggtcctctactttcgcggcgccattcgctcggcactgcgacgtgcgcacgccatcatcgtgccctcggaagccactcgcgagggtcttcgagcacggttcgacccgcgcgttccggtccacgtggtccaccacggcgtcgagggcgttcctcgactcgaccatcgccttgcccgccccggtcgacgcagcctcctcgtcctcggaaccctcgagccgcgcaagaacttggtgcgcatcctcagggctttcgatgcgatcgccgaggaggagcccgacgtcatccttcgcttcgtcggcaagcgaggctggggcctcggcgagttcgacgcgacgctcgctggccttcgccatcgtcgtcgcgtcgaggtgctcggcttcgtctcggacgaggcgctcgcaggctacctctcggaggcggctgcgctcgtgtacccatcgctcgaggagggcttcggtctgcccgtgctcgaggcactcgccgcggggcttgcggtcgtgacgtcgaaggactcggtcatggaggaggtggcgggtgggttcgccaccctggtcgaccccaccgatgtcggctccatcgcccacggcatgcgccaggcgctcgacgaggcacgtccgacggaacggatcgaggcgcagatcgcctgggctcggagcttcacctgggagcgcgcggccgagacgaccctcgcggtctatcgggaggtcgccgggctctagcctcctcacgcatgcgcgcgctcgtcaccgggtcacggggattcgtcgggacgtggctgcgggcacacctcggggccgccggcgacgaggtcgtcgagctgccggccgatctcgacgtcacggatcgagccgcgatcggtgcgtggatgcgaacccacggcgccgcgatcgaagcctgctatcacctcgcggcgcaggcgagcgtcgccaggtccttcgaggatccaggccacacctggctcaccaacgcgctcggcacgcagttcctggtcgaggccctgtccgaggcggcgccggccgcgacgctgctcgtcgtgtcctcgtccgaggtctacggtgcaccggcgcccgatgagctcccggtcgacgaggacgcgccactgcggccgacctcaccgtatgccgcgtccaaggtcggtgccgaggccgcggggctggagggagcctggggccgtgggcttcgggtcgtgatcgctcgaccgttcaaccacatcgggcccggtcagtccgaggcgttcgtgatcccgagtcttgtgggtcgggtcgtcgaggcgcaccgcaacggagagcgcgtgatccgtgtcggcaacctcgcggctcgtcgggacttttccgacgtgcgcgacgtggtcgcggcctatcgagccttggtcgtcgatgggcacgatcgcggcgtctacaacgtctgttcgggccaggcgtactcgatccgggaggtgctcgaactcatcgtgcgagcagccgatgcgtcactcgaggtggtggtcgatcccgcactgctccggcccgtggacgtgcccgtgatcgtggggaatccggcgcgcctcgtcgcacacactggggtgcgctttcaccactcgctcgaggcgacgatcgaagagctggtcacgagcgcacttcgcggaccaacggcgacgggagggttcgtcgatcgctagcgtggaggcctcatgtctaccgctccacgggtcgcggtcgtcgtcacggcgttccgtcctggtcgctacgtcgacgagtgtctcgcagcccttgcgcatcagagctacccagatctcgacatcacggtggtcgacggcgccggtgacgatcgtgaattgcgcgacgccgtggccatggcggcacccagggcgcgcatcgtcgatggaggaagctgtggggggtacggagcctgcgcgaacgcgggggcgcgggtgcaccccgacacaccgttcctcgtcttcgtccatgacgacgccgtgctcgcgcacaacgccatcgcgtccatggtcgaggtggcctatgccgccaacgccggcatcgtgacgccgaagctggtcgccttcgacgatccacgcagtctggtgacggtcgggtgggatctcgacccgttcttcaacccgaccgctcgggtggaggcgggcgagctcgaccagggtcagctcgacgaagtcgtggacgtggacgccgcaccgggtgctgcaatgttggttcgtcgtgacctcttcgacgccctcggtggcttcgacgaggtcttcggcctcatcggggaagacgtcgacctgagcgtgcgcgctcgactcgctggtgctcgcgtcgtcaccgctccgcacgcccgcgtccgacatcgaggggtgcgcatggagcggctgcgacgcgcgcgccgacgccgccaggtcggcgcccaggtcctcgaggagcgcgtcggtctgcaagatgccgagcgggtctggcgcaggcgccgcgcctcgcgcatcatgatgtcgagcctgtacgacggcccgatccgcttggtgctgctcctcctgtttgccacggagcgcatcggcgagctggtctggagggccctcgcgggttcgccgtcggcgggtgtcgcgggactgcgggcgctcgtgctgtcgcgcgacgaccgcgtggcgctccggcgtcgtcgtcatggcatcggcgagcgcgctcggtcgcatcgcgtcgtcgcgacgcgcacctggacaccgggggagcgtctcgtggccgtcggggcccaagcaggtactctctcacctgggcccacggatgcgccccccaagcggctcgcacggtgggtgccgcgctcgggctcggctcgctggttgctcctcgtcgcgatggtgattggcctcgtctcagcgcgaggtgcgctgacggcctcctcgcccggggggagcctcctgggtggagtgagcggcctcgcgttgctcgatgcctgggtccacgctcgggccgttccggcggtcctcggggccggcgtggcgccggtggggaccgcgttcatcgggctcgtgtcgctggtgttcggcggtgacgtcggactcaccgtgcgattggcggtactcgtcggcgcactcgtggcgcccgtcgcggtggctcggctcgctcggcgcgagttcgacgacgtgcgctccagtgcgctcgcgctcgtgtggtcgctcggtccggccttggcactcggcatcgccaggtcctctctgtcgctcgtcgctgcgtcggcgctcgcaccggtgctcgtcggcgccacgctcgctgccacccaaggacagcgtctcagtccgcgtcgcgccaagcgtgcccagcggcggctcgggctggttgcggccgtcgcgctggcgttcgcgccagagctcgtcgcggtgtggctggtggtcatcgctgccgaggcgctgtggtgggcccgtgcggcagacgcctaccgactccggcgtctcgggcgcgcgctcggcatcgcgggcctcatggcgatcggcatcaacctgccctggctcgcggccctcgtcctgtggcatcctggggtcgctgtcgtggcccacggcgtgccgggagcgcgagtgcagtcgctcggggcgcacctgttcggcggaggctacctcgctggcccagcaccgtggctgtacgtggcgctcggtgcgatcgccctcgctgcgggcgtcgagcgcagcgaacgagccagactcgcggtggctcgggccgtcacgggtcttgccctcagtggcgtcggggcgctggcgatgctcggtggccttggctcgacgccgatccagccggcctacttcgacgtgctcggtggcctcttgatcgtgctggcggtgccgactggtgtcagcgcggcccaggcgtggctgcgccgcagacgcctcggactctggcatctcgtgggggtggttgcggcgctcctcgtcgccatcctcggccttggttcggcgctgtcggcgctcatcgcgccggcggagccgatcgcgctgccgaccgccaacctcgcgctcgctggcgggttcttcgcccgtccggtgccgacgttgtggatcgaggtcgggcccggcggacctgttggtggcgcagcggtcgccgccaacgtgaccgttgcggtcaccacgggtgcggagccgagcttcctcggccagttcggtccgccggtgacggaggggtatcggcgcatcgtgccctcgattctcgatgcgctctctggtcacacggtgcaactcggcgcggtcctgcgaaggctcggccttggtgaggtcgtggtgctggacgcatcgcagtctccgctcgccagtgcagtcacgctcggcgtcgagcgccaggtcgacctgcgtcagctcctcggaacctcgtcgatgactatcgcggcgacgacgggggtgcctcggccggtcgccgcggcggcaacaccgccgtggttcgtggtgagcgagctcatcgcagcgggggtgctcgtctggtcggcagcgagcgtgttcgggatcgaggagcggatggtgaggcggcctcggctgcgcatgcctgctgcccccacgaccagggtcgaggtgctccagtgacgcgctggtcgcgcaccccgacgatcggggtgctcggcgtcgtcgtggtcgtcgcggcgacggtcgcggcaggactcgcgccggcacggccgcgcccagcggtgttcgcgcttcccgggcaccgctcactgagcggtgcgaccgtgctcggggcactcactcagccagcggtcgtggccggtgcgtcctcggaggcctggtactgcgtcgccccaccgttgctgccgctcgcggcgtccacgatcgcgctggccaacctcggtgcgagggcacgccacgtggaactcgtgcccacggccagcggtgctcgcccgatcgccgtcgtgcccctcgcggcgggcgcgatgacgtctcggcccgtgggtgtgcgtgggttctcgatcgtcgagggacctgggggcgtcgcggcgacggtggtgagtcacgagagcgcgggcgtccagagcgagccgtgccagagcactgcgagcgatgcgtggaccgtccttggtttcgacaccggcgcgggcgatcgcgccgtggtgcgcatcgccaacccgttccagacgactgcggtcgtcaacgtcgatccgatcggaccgtcgggtaccacggtggtcgcgtcgacgcaggggatcgtcatccagcctggccagacggtgaacgtggacgtagccaagctcgagccgggcatgacggacgcaggggtcgtcgtcggcgcgaagaacgggcgcgtcgtcgtggtcggagcgacgcggcccaatggcgcgatcgcgccgatcgtgctcgatccgcaggcgacgcaggggcgatcgctcgtcgcgccgtgggtgccggtggtcggcctgcgcaacctctcggtagtgctggccaatccgagctcgagcgtggtgcgagcctcggtgcgggtcgtcggccttcgtgggaccgccggatcgacggcttcggtcgcggacggacatggcgtgagcgaacgggtcgtcgtgccgagcggcgccacggtggtggtcccgctcaccgccgaggccctcgcggagccgtcggccggggtgcagctcagcgtccacacgagcggcggtgctgtgagcggggtcgtggacatcgagcgccgcggtgtcctcgacgggcgcagtgtgatctccctcgagcaggttgcttctcgcgggtggttcctcacgtgcccatcgagtgcggcgatgtcggcgctcgccttcgacgaggttggagcgagcgcccagctcaccatcgccgcccacaccgctgcgagcggtgcgcgatccttcgagacgaacctgctccacgcgggcgtcatcggtcttggcggcgttcggggcgtcgcctggtacgacgtgagcgccaccgagccggttgccctctggccggtcgcttcgtcgaccggctgtgcggtgctcggtgtggtcggtccgctcgattagtcgaacctggtccaggcctcggcccagaggcgctcgtagccgacacgtgcgaccagctcgatcgcgtcggtcggtcggctgggctcggctccaccctcgagcaggatgcgcgccatcgccgtgggtatgggatagtcaccgggggtctcggcgatacgagccagcccatccgggggtgcctgggagttcggtccgagcggtccccaggctccccaggcgcgcagcaccacgacgaggagcgctgcgggaccaagggtccgattgaccacctgctcggtggcacggcccggggggccagcgatccagctcgccccgaggtagtcggcagcgacgagccgtaccgggccgaaggtcgtcgtgaggtgtgccgccatggcgtcgagggacggaccatcctcccaatcgagcaccccgtcgacgagggacgctcgaggctcgagcgcgcgcgcgacggccagcaggcgctcggggtcgaggatgcggcgtcgtaggatcatgcgtcggcccgatcctgggtggtcggcaagccgaggcgccacaggagctcgcgctctgtcgagacgagggcgagcggtgtcgccgtgagcggagcctcgaggatgcgagggacgagcggcgcctcggcttgcccggcgacgatcggagcgaccgtcagcgagagttcgtcgatgagacggcgttcgaggagggtcgcaaggacggtcgggccgccctcgacgaggaggtggccaggggcgctcggctcgacgccacaggcaccgaagaggtcggcgcgcgtgcggatcttgtcgaggtcgacggcgcgagctgcgaagtcaggcgccgtggcgcgggtggcgatgcagatcgggacctcggtgcccccgatgccgaggcgcgctcgcagcgaccggagctcctcgttgcgcaccagcgcgggtccatagccctcgtcgcgagccgtggcagaccctacaaggatggcttgggccgtggctcgcaggaatgcgagggccgaacgatcggcctcgctcccgaggccaccggagcggccgtcgatggtggctcgcccgtcgagcgaggcgatcaccaccgcaatgacacggcaggtccctggcgcaaagtggcggccgaggagcgtggtcgggatccgtccggtcggccagtgctcggtcttcacgatctcacgctagccggctaggctcggttcgtcgtggagctgttcctcgggcgcccggccccaccagcgacgtcgacagcgttgatcgacgaactcgtggtgccgcgcgcgctggtcggggcgacgttcgacaactacgagccgaccgacgcctcccaggtgcgtgcgagagacgccgtgcgtgcctgggtgagcgcgatcgaggccccccgcccccggcgtccgtggagacggcgccatgggcggagggcaccgatggggatctacctcgacggtcccttcggcgtgggcaagacccatcttgcggcggctgcggtggcggctctcggcgatcgtgcacggttcagtgcgttcggtgacttgaccgcaatggtgggtgtgctcggcctcgagcgggtggtctcgctgctcgcggcctctcgcgtgctcgtgatcgacgagttcgagctcgacgatcccggcgacaccgtgatgatcgccaggctgatcggtgagctcttcgagcggggcacagcggtgctcgccacgtcgaatacgctccccgagcggctcggtgaggggcgcttcggtgctgatgactttcggcgcgagatcggccagctggaggctcggttcgaggtggtgacccttcgtggcaccgactggcgtcagcgccgcttcgacgcgctggtcttcgatcggcccctcgtgccgacgcgactgcgtgacgacctcgagcaccggcggggaacggagctcgtccgggaactcgttcgggtgcacccggttcgctatcgcggcgcgattcgcgggcaccccgggtgggtcatcgagggaccggtaccgctcgatgaccaagatagcgcgctgcgcctggtcgccttcgtggatcgagcctgggaggaagacgtggcggtcgtgctgcgcgaccagccgctggcgaccttgttccgtgagagctggctcaccggggggttccgtcagcgctacggcagggccctctcacgtctcgtggcgctcagcgaccgtggcggtccgcagcggcaggctgaacctggccatggtgcccccggttggtcggcgctcgagacggaacgcgccgccgagttcgtgggcacgggcgctgagattggcgagaccgtgcccgagggtggccccgtcggagtcgaatccgacgccgtcgtcgtcgacctcgagggtcaccgtccgcgcatcgacggcgatgcgtaggtcgacgcgctgggcttgggcgtgcttgacggcgttcgtcaggagttctcgtaccgcggcgacgaggtgtggccggagcgaggcggcgaccgcgaagtcgacggggccatcgaaggccacgctccgtcgcatgccggtcgcggcggtcaggcgctcgacgaggtcgagcacctcgccgcgcagtgacgttcggcgggcctgttcgaggtcgaagatggtggtgcggagaccctggatggtcgcgtcgaggtcgtccatggcgttgccgaggagttcgagggcgtggggcgcctcgatctctcggagcgccgcttggatggtgaggcccacgccgaagagccgctggatcacgtcgtcgtgcaggtcgcgtgcgatgcggagccggtccgtcgtcacttcggtcgccgcgagctcgtcgcgcagcgcgaggctctcgatgacggcggcgagggcggtggcgagcgcctcgaggacggcggcgtcgacgaggtcgaatgggccgccgtccgcgcggtcggcgacatagaccgtgccgtagatggcgtcacgaacgctgatcggtgcgccgaggaaggaccgcatcgcagggtgggactcggggaacccgacgctgcgagggtgcgtggcgatgttggcgatcgcaacgacgtgatcacgtgcgagtccgaggagccccttgccctcgggaagggaggcgatctggtctgcggtggcggggtccatgccggaggtgacgaagcgagcaagacggtcggggcgatctcgctgccacacaccgatggctccgtaacgggcgttcgtcagccctcgcgcggcctgggcaccgaggtcgaggagttcatcgaggtcgtgggctcgaaccaaggcgatgacctgatcgaagagcggccggagccgtcgcgccggaattgcctgaggcacctcgactagcctagcgatggcgctcagacggtctcggacgtcgcgtcgagttggagggcggtgccatgatcttgctggaagagaccccgatcgaagccgaggtacccgagatcggctcgggcgcctggcggggggtgcggctcctgcgtcgccactgcccggtcttcggcaccggcacgcgcctgatcgagggcgccaaactgaccggcacggggtccgatctcgcaccgctcgtggccgaaggggggttctgccctttctgtgccgatgtcatcgaggaggcgacggctccgttcccgaccgagatcgccgtgacgggacgcatccgtcaaggcacggcgtgggtggtgcccaacgtgctcgcgtactcggcggtgtccgccgttggcgtctatgaccccgggcgccacgtgctcgagctcgccgatttcgacgaggacctcctcttcgacgcctttggtgccatgctcgagcacgcccgagccgttcgtcgcctgagacccgagctcgtctggtcgtcgatctcggcgaactacctgccgccctcggggtcatcgttgctgcatccgcacctccagagttcacacgatccggtgccgcttgcggcccaagcgatcctcgaggcgaggagcgaggcgcactgggcgtcgtttggtcgagggttgctcgacgaactcgtggagctcgagcgcagcgcgagcgcacgcttcgttgcccagaccggtccctggtcgtggatcacgccctttgctccaagcggcttctacgaggtctggggcgtgcacgagcgcctgggcgatctcgtcgcgctcgacgaccacgaccgccgacagctcgcaggcgcgatggccgccgtcctcgccagctatcgcgccaagggtctgtcgagcttcaactaccagctgctcggggccggcccgcgtgggggcgagttcgacgttcgtgtgctcgtgcggatggtggcgcgtaccccggcggccccctggtaccgtagcgacgtcacctacttcgagaagcttggtttcgaggcgatgatcgatcacacgcccgaggcgttcgccgcggagctacgtcagacgttcggcacggggctctaacgacggggctcaagtcagagccctgagacgtccgatacctgcttcgttcaggcggtgtggcctcaggaggcatggatgcggacgctggcacagaagttgctcatcgcgatcgtgacgctcgcgatcgtcgtcgggattggtggcgccatgacggtcgaccaggcgctcgcctcgcggactcaagcacgcgtctacgcggccgaccaggcgcggctcgaggtgttgtcgcagaccatcacctctgacttctacgcctgggacgatcagatgaacatgtacgtcctcacggcgctcgcgacgccaggacagcacagcctgatcgctcagacgtaccagcaggcagcccaagccggcgcccagctcgaccatgacctcggcgtcgctgcgtcgctcccggcgacgcccgcgatccgagctgacctcgcacgggtcgcacgcgatgcacgggcctatggcgggtatgcgcgagaggtgcacgcggcggtcctagccggggcgacgagtcgagccgcctacatccagacggtgggcaacctcgcgccgtccaacgacatcatggtcgcgctctcgaacctcggccgcgacgcacggatcgacgcatcgggcgcactggccaacgtacgcgccaaggcagcctcggcggcgacctggaccgccatcagcttggcactgctgatcgtgctgctcgtcgcgctcgtcgtcgggatgcgccgttacgttctcggaccactgcgtgcgctcggcgcgtcgctgtgggcgcttgccgaggggtcgacgacggtcgagcggctcgatgagtcgcgggcggacgaattcggtgagatcgcaagagccttcaaccagttccggggaaggctcctcacgctggtggaccgcgtggccgcttccgtcgggacgttgctcgagagcgcccgcgaactcaccgaggtggcccaaggcctgagcgatggcgcacgcgagaccgcggaccagaccgccaacacggtccacgccgcccgggacgtcaacgagcacattcaggcggtcagcgtcgcagccgagcagatgcgcgtcgccatcagtgagatcgcgcgttcggcggccgatgcggcgggggtggccgctggtgcggttgacgtcgcaggcgcgacccaggggcgtgtgcaggccctcggcgagtcgtccgccgagatcggtgaggtgatcgcgacgatcaacgggatcgcggagcagaccaacctgctcgcgctcaacgcggcgatcgaggcggcacgcgccggcgaggctgggaagggattcgcggtcgtcgcgagcgaagtcaaggagctcgcgcgcaataccgctcgagcgaccgaagacatcggagccaagttggaggcgatccgctccgagagtctggcggccgtcgaggccatcggtcggatcagcgaggtgatcgcgacgatcaacgacctgcagtcctcgatcgcttccgcggtcgaggagcagtcggtcacgacgaacgagatcagtcgggtggtcgagctcgcgacccgctcgacgggggatatcacgcgcgcgatggaagacgtctccgacagttcgcgccgcgcggtcgactcggtcgacagcgcaggcacggtcctcgcccagctcgtcgagctcgcgaattcactcggagagctcgtcggggtcgcggcgacacggagccgcggcagcgatggtgccgcacggttcggcctcgcgcgtcacgacgccgatcgtagcgagtcgttcagcgcggtatcgtcgtgaacttgagctcgttgatctcggggtgatcgtcgaaggtcccgaggacgtggtcgagcgtccggcgggcaagcgcaccgtcgccattggggcgggtcatcaggcgtacgaacgcagctcggccgtcatcgaggatgacggtgggcacgccgaagacgcgaaagcgctcgacggcatcgtggtgtgcttcgccgagggcgcggatcgcgcgaggttcttcggcggccgcgagcacgctgggcccatcgagcccgctggcggtgagcacgtcggcgaggacctcgcgatcggcgaggtctcgcgcttcgtcgtggcgggctgcgaagagcgcccggtggacgcgcgcgaaggcttcagggtggcgatcgcgaacgaccacgcccgcgctgagcgcgagcagctggtcgcgcttggactcgtccgcgaagacgctcgtgccaccttcggggacatggacctcgaggagcgagaagggaacgaagtcgacgttccacgacgctccagcctcgagggccgcgagcacgtgctcatggaagttgcgggcgaatgggcaccgatagtcccacgtgacggcgaagtgcatggcgtacctccttcgaccaggctaacggctgcggggagaacgcgtgcagatgcaattacatgccggggctcggtgccctgagcgcgcggaggagctcgacgtcgccgccgtagtgcaggagctccggtgcgtcggccagggggatccaggtgacctggtcgacctcgacgccgtcggggcgaagctggcacggggccggcgcgagcatgaggaaccacgtcacgaccttgatgcgtccgtccgcgaggcgatagcgcgcgacgccgaccggcgcgatcgggaccgcatcgacgccggtctcctccgcgacctcgcgcagcgcacaggcgaggatgggttcgtcatcgatggccttgcccttcgggagtgaccaatcgtcgtagcgagggcggtggacggcgatgacggtgtcgtcggatccgatcacgatgccgcctccggcacgcaccagcccggcacggaccggctcagccacgccgacgccctcgacgagcgtcgccgggctcgaggtgctcgatcagtcggcgggcgaacgtgccgtaggccagcccgaccgcgatgccgccgagcacgtcggaggtgtggtggatccggacgtagatgcgcgacagcgcgaccgcaccagcgagcggcagcagtgagcgccgctgcgcaggcgtgcggccaagcagcatggcggcggcgaaggcagccgaggcatgaccgctcgggaagctcgaggtgcgcggatagcggagtccgagtgggtggggatgatcgcgatcgatcgggcgatcgcggtggaagacgctcttgacgacgccgttcacgagtacggactcgagtccgagtgcggcgatggtcagaagcgcccgacgacgagagcgcgcagagagcgcctgcacgcccgcgatgagcatccacaagatcgagtgatccgcgagtgccgtcagcgtgtagaacgtcacgtcgacgatccggtggccgcggagggcgtcgatcctgcggtcgatcgcggtgtcgaaggtgtgcagtgggcctgccgcggtgctggcgctcatcgggcggctcccatcgccgggcacacgtcacggtgtgggcagctcccgcagagccgtgaggggcggggcggaaagtcctcgcggtcgcaggcccgctcgatcgcgtgccagagcgcgcgaaggcgtgtggcgaccccgcggagcatctgtgcgctcggtgcgcgttcgatcacgctgccgtcgccgaggtagacgaggcgaacgagacggggtacgcggccgaagagcaccgacaccagcagggcgtaggtgaggacaccgccgagccgcgcgtcttgatgggacggtgggggggtccgcccggtcttgtagtcgacgaccacgaggtcgccctcgtcgtcgaggtccaggcgatcgatgaccccgcgaacgtggacgccctcgatggtggcctcgagacgcagttcggtgccgattgcccgaacgcgcgcgggatcttcgaggtcaaggatggtgcgcgagagggtggtgatggagcggtacagtgcagcgcgttctcggtcgtcgagctcggccacataggcaccgagctcgtcgtcacaggcggcggcacggaccgcggtgtccaccgcttcgttgagcgcagcttcggatcgacggtccggctctcgtcgatagaagtcctccagggccgcgtgaaccaaggtcccgaccgcgagcgggcgggtcggtggggttcgcacgccgtcgatcacactgcgccgaaaggcaaaggggcagtcgctgaacgccgtagccttggtcggggtcagggtcgctggcggcgcgagaggcatggcccaaggttaccgaggcggctcgagcggtgccgtcgagagccacgagcgaacgacgcttgcgacggcgtcgggatgctcgaaggggccgaagtggccgacgccgtcgacgatcgcgcagctcgcggacggcgcgcgttgggcaacgagtgcgaggtcctcggccgtcatggtcgtcgaggcggcgcccgcgaggatgagcatcggtgcgctgatggtggcgacgaggtcgagcgccccggtcgtgatgccaccgcgatacatcgcggcttcggcagcaggggcgaagcggaggcgaacgcccgcgtcgtcgctgacgaggcacgtgtcgaggtaggcctcgagcacgcgtgggtcgaacgaggccatcggcggcttggcgccgagccgttcgcgtgctgcttcgcggctcacaaaggaggctcgccgacgcagcgcgccgtcggcgagcgcgttggcctcggccagctggcgtgcgttcgtcgggtcgatcaggatcggctcaaaggccaccagtgcccgagcgggcacggaggcgcgtgagagtgccatgatggcagcggtcgcgcccagggagtggccgaggatcaccggggcgtccgcgaaccgcccgagtgcgtcggcgacggctcgtgcaaagacgttccagtccgtggcatcccccgggggtgggtcggagtcggcacctccgtgaccagggagatccagtccgaatgccaagccaccgagcgcttcggcgagtggtgcgtagcaggcggcgctgaaaccgcccgcgtggacgatcaaggtcgagatggccctggcgctcgccgagatcggtcgatgcagcaggacgaggttgggcgctggcagttcactgctccttctcagggactttcggtgcgacgtccaccacgttacggctaccatcgcggatgtgacccacctgatcgactcgctggtgtctcgcgatggcttgatcgccatcgtcgttctcatgacgctcgagtctgcgctgatcccggtgccctcggagctcgtgatgtcgcttgccggcttctttgcctacgaggggcatctcagcctcgtcggcgcgatggtggcgggcgtcgtcggcaacgtggttggttccgtcgtgctgtgggtcatcggccgtaccggtgggcgcgctctcgtcgagcgcttcgggcgctacgttctcctcaagcctcgagacctcgatcgcgcggagcgttggttcgccaagcacggcgagtcggcagtgatcgtctcgcgactgctgccggtggtccgatcggtgatttccttgcctgcgggagtggcagagatgcgggtggggcgtttcacgctgttcacgctgatcggttcgatcccgttcgtcgtggcgctcacgcttgccggctatttcctcgggagcagctacgagacgatcgtgcgcatcgtccaggactttggctacctcgctgccgtcgcgatcgtgctcgccgtggtcgccttcgtggtggcacgggcgagggctcgacgccgtggggccgaggcggcctgacccgagcgaggtctagactctcgcgtgcgcgggaagtggcgcagcttggtagcgcacctgctttgggagcagggggtcgcgggttcaagtcccgccttcccgacggccacagccacgcgggtgtagctcaatggtagagctccagccttccaagctggtggtgcgggttcgattcccgtcacccgctccgcatcggcgcttctgggcgcacgacccgacggtcgtgcgcagggggcgcgggcacgatcgaggcggtcgcgttgtcgctcgttcggacggattcgcgagcctcgcgcgtgccgacaccctcgggtcgtggcgggtgccgaagaacgtcagcggtgcgccggcatgagcgcacgcaaggactcgtcgtggctctggtgactcgcggctggccgtcgccatgcctgatacctggtagggtataaggagcggacatgggacgtgaccggtctgaagtcgagttgctgggtcggatttcgttcatgccgtttcgtattgcgctattatcagtgcgatagcagagaccgaaggaggcccccggtggtgcaggtcgtgcgccctagtgatccttccgaggagcttggcgctccgtcgctggactcggtcgtcggcgagggtgtcgacggacgcgtcgtcggcgatcagccggcaggcctcgacgagtccgaccctcggagcggagaggtcggcgacctcgttcgacgtctctcgcgcatcgaaggccagatccgcggcatcaagcggatgatccaggacggtcgcgactgccgcgacctcgtgacgcagttcgctgcggtctcgcgcgcgctcgagcaggctgcgttgaactacgtcacctcggagctggtgtggtgcgtcgagcgacctgacgaggccgctgagcacggctacacggtcgacgagctgcgaaagctgctcggtcgccttcgttagtccggtcagcgggccggcgcccccggtatgattggtgcgctatgcgctctaccacctctaccagcgatgatcgccgatcagccaccgtcaccgtcgagttcgagagtgacgaactcgcctccaagttcgacgaagtcctcgcgcgcctgcagcagcaggtgcgcctgccaggcttccgtcgtggcaagatccctcgtcagctcctcgttcggcgcatcggcgaagaggagctggtgcgcgaggctgcggaggcgttgatcgaggagcgcgtcggagatctcctcgccgagagcggtctcgacgtgatcggccggccggcgttggcgcgggtcgaggcgcggcccgagggaggtgccgaggccgagctgcgggtcgagctgcgtccgagcgtcgaggtcgcgggctggcgcgacatcgaggtgcgggttccggatccccgcttgacgagcgaggaagtcgatcgcgtgatccgtgagatcctcgagcagcgtgcggaggtccgtgacgtcgatcgtcctgtcgccgaaggtgaccaggtcaccttgaacgtgtggcgtgtcgagtccgacgggaccgaggcgctcgtcactccggacctcgtcgtgcgcctcgggcgaggtcaggttcctcgtgacatcgaggaggcactcgtcggcgccgtcgtcggcgctcgcgtcgagcgaccggtgccacacgagacgccgaccgacgctggggccacgaccgacgccgaggcaggggaggccggcgatgccgaggatgcgtcaccggccgacgcgccgccccaggccgccgcggatgcgccgagggagctctacgaggtgcgtgcgatccgggagatcgtcgttcccgaggcgacggacgagttggtggaggaggtcacaggccagccgacactggcggccttgcgcgaggccgtcgaaggagacctgcgctcggctcgcctgcggcgcgcccaggaagccttcgaggccggagttctcgcggcgctcctcgagaggacggagccgaagacggtgccgaacacgctggtggaccccgtctttcagcaggagatccgccggttcggctcgtcgctcgatgcgtcgggaatctcgctgcgtcgctacctcgatctcaccggccagagccgcgatgacatcgcgaggagcctgacggagcgctcggcggagacggtcctcatcgatctggcgctgcgtgccatcgctcgcgacgcggatctcgaggtcaccgacgaggagttgcgcgcggaggtcgatcgcttggtcgcgacgggccagattcgcgatcgcgaggaagcggcgcggccggcgatcgagacccagctcgtcgctgacgttttgttgcgcaaggcgctcgcgctgctccagcgggaggtgcacgtggtcagtgagtcgggcgaggcgctcaccctcgacgatctcgagctcgcgaacgccatcgcagacgtcctcggcgatgcgcctccgaccgctgaggaggagcttcctggttcgatcgccgaggaggcatcgacgcccgcaggttccgagaccgacgacgctcactaggatcgctctcgtggatcgaccgctcgcgcctcgtaactacctcgtcccgaccgtcatcgagacctcgtctcggggcgagcgggcttatgacctgtactcgcggttgctgcgcgagcgcatcatcatcctcggcacgccgatcgatgatgcggtcgccaacctggtgtgctcgcagatgctctacctcgagtacgaggaccccgaccgcgacatcaatctctacatcaactcgccaggcggggagatcaccgcactgttcgcgatctacgacacgatgcgcttcgtgcgaccagacgtgtcgaccttctgcttcggtcaggcggcctcggcggcggccgtcatcttggcggccggtgccaagggcaagcgatttgcgctcccgcacgcgcgcatcctgctgcatcagccctacggcggtgtcggcggccaggcgacggacatcgaaatccaggccaaggagatcctgcgcatgcgcgacctcctgaacgagatgctggccgaagcgactggtcaaccggtcgagcgcatcgcccaggacaccgatcgcgatttcgtgctcgaggctcctcaagcggtcgagtacggtctcatcgacgaggtcgtggtcgcgcgcgaggctcgttgaaccagcagcggaccccacctccgcgaccatgacgcgctaggctggacgagtccgcaccgttcgaaggaaggtgggcgatggccaaggtgggcgacgggcaagagatcgtcaagtgcagcttctgcggtctgtcgcagaagcaggtgcgcaagctcatcgctggtccgggcgtgtacatctgcgacaagtgcatcgagctgtgcaacgacatcatctctgaagagttgggcgagccgaagccggaagcggtcacgcaggaacgactgccgaagcctgccgagatcatggagttcctgaacgcctacgtcgtcgggcaggagtctgcgaagaagatcctctccgtcgcggtctacaaccactacaagcggatccggtccggcgcgaaggatgacgtcgagctccagaagtcgaacgttctgctgctcggaccgaccggttgtggtaagaccttgctcgctcagacgctcgcgcgcatgctcaacgtgccctttgcgatcgccgacgcgacggcgctgaccgaagccggctacgtcggcgaggacgtcgagaacattttgctcaagctgattcaggcggccgacttcgacgtgaagcgcgccgagaccgggatcatctacatcgacgagatcgacaagattgcccgtaaggcggagaacccgtcgatcacgcgtgacgtatcgggcgagggtgtccagcaggcgttgctcaagatcctcgaggggaccgtggcctcggtaccgccccagggtggtcgcaagcatcctcatcaggagttcatccagatcgacacctcgaacatcctgttcatctgcggtggtgcgtttgtcggtctggacgagatcgtggctgcgcgccttggacaccggggcatcgggttcaccggctcgctcgccgagcgcgatgggggtgagaacatcctcgcccgggtccaaccggaggacctcttgcgcttcgggctgttgccggagttcatcggacgactcccgatcgtgggcactatcgagaacctcgatcgagacgccctgatctcgatcctcaccgagccgaagaacgcgctcgtgaagcagtatcagaaggtgctcgcgatggacggcgtcgagctggagatcacgccgtcggcactcgaggcgatcgcggatctcgcgctcttgcgcgggaccggtgcgcgcggcctcaaggcgatcatggaagaggtcctcctcgacgtgatgttcgaccttccctcgcggtccgatgtccagcgctgtgtgatcgatcgtgacgtcgtgctcgagcacgcggctcccacgctggtgccgatcgatccggcgagcgagccgcgccgccaggcctcttgacgagcgatctcgcgcggtcggcggacccgcgtcgttggctcggtgagctccccgacttcgaggccgatcgcagcgtcaccgttcatggccctgccgtggtgcgggccgccctcgatgcgctcggcgcacccgaccgggacctcgtcgtggtcagcgtcgcgggcaccgctggcaagggctcgacggcgacgctactcgccgcgctcctcgcctcggttggcgtgcgagctgcactgttccgatcgccgcatctgtgtcgatgggaggagcggttcgtcgtcgcgaccgagccggtcgaggcggcggccatcgacgaggagctcgagcagatccgcctcgcgagcgaggcgggactgctcgtcccgttgacgcggttcgaggtcgagacggtcctcgcggtccagctcgcggcccgcgagggctgcgaggtcctggtggccgaggccggactcggcgcccgcgaggacgccaccagagccctcgagccggcgctcgcgatcgtgaccgccatcggtgacgatcaccgggccgagctcggcccgacgctcgagtccatcgccgctcacgagctcggcatcgccgcgggtgccccgacggtcgtgctcggcgagctcggcgccgtcggggaacgggttgcggcgaggcagctcggtgccgttccgagggtccggcgtctggggatcgatcgagccatcgtggagcgccacagcggcgtggcggggcagtccgtcgtgctcgacgacggccgtgagctgctcttgcccttcatcgggcgaccgggtgcgcagagcatggtcctcgcggtggtcgcgctcgaggagctgctgtcgatctcgctggaggcggcccatatcgatgcggtcgcgcgtcgtgcggtggtgcccggtgtcccgtggctccatcggcagccggttcgtgcggtgagcgatctcgcgcacaatgccctcgcgatccgcgcgctggccgagaccgtggcggagacgttcccgcccgacctcacatggcggttggtcatcggcctgacgcatggccgcgatccgcgtgccgtcttcgaaggcctcggcacgctcaaggtcgacgaggtcatcggggtcgacgtgggtgtggcgacggaggtgcttggcgaggcggcgcgcgagctgtggccgtcggcgcgctggcggagcgcggcgagcgtggaggaggcgttgtccgaggcgccggaggacgacgtgtggacgctcgtgaccgggagtctgcgaatcgtcgcgccgctgcgctgtgccgaggcgccgtcggggatcatcgcggtcgactaggctcctcgtcccgtatgcagcgcacgcttgtcatcttgaagcccgacgccgtcgaacgaggactcgtcggggagatccttgcccgtctcgaggcaaagggcctgcggttcgagcgcctcgaactacgccagctcgacaaggacacggtgcggcgtcactacgccgagcacgaggggaagccgttctacgacggtctggtcggcttcctgacgcgcggccccgtcgtggtcgcggcggtgactggtcccggggatgcggtcggcgcggtgcgggctctcatgggtgccaccgacccggcagtggcggccccggggacgatccgcggggatcttgctatgctcatcgacgaaaatctgatccacgggtcggactcgccgggcgcagccgctcgtgagctcgcgctcttcttcccggatcatcagtagtagctcaccaccgacatgcctgaggtcgcgatcggccaccacaggggaggttccagatggccagcgtaggaaagatgttcggacgcgatatcgccgtcgacctgggaacagcgaacacgctggtgtacgtgcgcggcaagggcatcgtcatttcggagccctccgtcgtcgcgatcaacgtcaacgacgggcgtccgctcgctgtcgggctcgaggcgaagcgaatgatcggacgcacgccatcgaacatccaggccattcgtccactcaaagacggggtcatcgcggacttcgaagtgtgcgagaagatgttgcgctacttcatcggtcgggtgagcgcgtcgaaggtctccaagccccgcatggtgatctgcgtcccgagcgggatcaccggtgtggagcgccgtgcggtccaggaggcggcggagtacgcgggcgctcgtaagcctgcctacatcatcgaagagccgatggccgccgcgatcggcgcgggtctcccggtgcacgagcccaccggcaacatggtcgtcgacatcggcggtggaacgaccgaggtcgcggtcatctcccttggtggcatcgtgacggcgaagtcgatccgcgtcggcggcgacgagatggacgaggccatcatcgcgttcgtgaagaagcaccactcgctcgccctcggggagcgtaccgccgagcagatcaagatgacgctggcgtctgcctacccgctcgaggaagagctgcgggcggagattcgtggtcgcgacctggtcaccggtttgccgaagaccatcaccatcaccaccgaggagatccgggccgccatcgaagagcccaccagccagatcgtcgacgccgtcaaggcgacgctcgacgcgacaccgccggagctcgccgccgacatcatggagcgcgggatcgtcctgaccggtggaggggcgctgcttgcgggcctcgatcggcggctgcacgacgagaccggcatgccgatcgttgtggcgaagaacccgctccagtgcgtcgcgatcggttctggtcagtgcctcgaggagttcgacgccctgcgccaggtgctgatcacctcgtctcgctgatcgagctcgtgtcgcgactgcttgcgagacctcgctcgaccctgctcgtcctgctcgtcgtcgggttgaccctggtgacggtgagctttcgatcgccgaacgcgtttcgtttgggaaccgtccgttcgctcgtcactgacctcgtgaacccggtgcgcaacgccgtcgacggcgcgtttcggccgttggcatccagcgtgcgcggcgcggtcgactaccagcaagccgaggccgagatccgcacactgaaggcagaggtcgcccaagccgaactcgcagcccgggagcaccaagctgctgtggcacagctcgatcagctctcccggctgctgcacttgccgtgggcgggctccatccccgtccagccagcggaggtcatcgggaccactccgtcgaatctgcagctgtccttcgtgatcgatcgcggcagcgctgcaggggtcgcggtcggtaatcccgtggttggtggcggtggtctcgtggggcgtgtcgtcgcggtgacgtcgtcgacggcgacggtcctcgagatcaccgatcccacgtcggtcgtcggcgtgcggctccccgggtcgggtcaggtcggtgcgatgacgggcagggggcttggcgcgccaatgtcggtctcgctcatccagccaggcacgccgctgcggcgaggggcgatcctcgtcacctccgggctccagggggggctctttccaccgggaatcccggcggcgcgcgtccggtcggtctcgaacccgttgaacgcgctccaggagcagatcagcgttgttccgctccagaacctgtcgtcgctcgcctacgtggatgtgctgcgttgggtgccgacctctggcagcggcgcatgaggtacctccgtgcgctcgtggtgctggtgctgctcggaaccgcgctcgtcatccagaacaccggcctcggacaggcgacgatcctcggggtgcacccagatctcgtcatggccatggtggccgcgatcggggcggtacgaggacgcgagtcgggcgccatcgctggctttgtcggtggtatcgcggtcgacgccttcctgtcgacgccgttcggcctgtcagcgttgatctacgtcgtcgtcgggtatctcgctggtgaggtggagcgcatcgacggcggcgcacccctcgcggtgcgctggatcgtcgtcggcctggcgagcctggtcggggagggcctcttcgtcgttgctgagttcctgctggggcttgcgaatcctcttcagaccaggctggtagaacagatcttggtcgttggcggcgtcaacttggtcatcgctccggtggtccttgggctcgtgcgcttggccttcgtgtcgacgccgtcgaccgtgagttgatcagggagcgtgcgatgcctcgacgtcgacgtcgcagccgtccgggctcaccaccaaccggcccgaggacgtcgttccgagcacgagtgctcggacttgcgaccctcgccctgttcggcggtctgctcgcccggctctattcgttgcaggtcctcgaagcaccgacctaccaacaggcggcggtcgagaactccgtgcggaccgtgtcggttcctgccccccggggcttgatcctcgaccgcaacggcacggtcctcgtcggcaaccaggtcgtcgacgtggtcggcctgtcggcctacgaggcatacctgcatccggcggtcgttggtcggctcgccaaggtgctcggattgagcgccgcgcaggtcaaggcggatctcgccaactcccagtactcgacctacgagcccactccgatcgccacgggcgtctcgcaggcgaccgcggtgtcgatcgaggagcacgcggccgagtttccaggcgtggtcgtggagctcgagacgcagcgcacctacccacagggcgacacggcggcccatatcctcggctacgtgggtccgatctcgccctcgcagctcgccaagctcgccaagtacgggtacgcggcgggagaccaggtcggtcgtgcaggggtggaggagacgttcaaccagtacctccacggtcgcgccgggtcggagcagctgctcgtgaacgcatttggtcaggtggtcggggtacgcaagcgggtcgccccgacgcccggcggcaatctcgtgctgtcgatctcgctgccgctcgagcgctatgtcgagcaggtgctcgcgacccaggtccgcaagctgtcgaactcctacaacagctacttcgggcgctacaccggcaacctcggcggggccgcggtggtggaggatccgaacaacgggcagatcctcgccatggcttcctatcccacgtacaaccccgagtggtgggtcgggggcatctcgacgcagcactacgcggagctgaccagcgcgtcggcgaacgacccgctgctcaaccgcgcgatctccgcagccttcacccccggctcgacgttcaagctcgcgaccgcttcggcggcgctccaggacgggctgatcacccccagcacggtcatcgacgacacgggccagttccagatcccgaactgcaccggatcgttctgctcgctccacaactcaggtggtgaggcgctcggccccatcaccatcacgaccgcgctcgctgcctcggacgacgtcttcttctacacactcggctaccgcttctatacgcaggcggcgcagttcggccagacgccgatccagaacatggcggctgcgtatggctggggtaagccgacgggcatcgcgctccccggcgaggtctcgggcatggtggactcgccccagctgcgcaagtacctccacgagcactatccacaggcctatccctacgacacctggtacgtggccgatcagctggagatggcgttcggccaggggctcaccgagatcacgccgatccagctcgccaacgcctactcgacgttcctgaacggcgggactcgctacgttccccagatcgccctcgcggtgacgaacgaccagggccgtgtgatccagcgcttcgcgcccaaggtggcgggacacgtgacgctctcgccgacggtgcgccagacgctcatccagggctacgaggaagaggtctccaatccgctgggcacgggctactacgtctggcagggttggcccgatgccagctacacgatcgccggcaagaccgggacggcgtccgtgtccggccaggtgccgaactcgtggtacgtcggcatggggccgatgcagaacccgcagtacgtcgtggtggtggcgatccccaatggagggttcggcgatctcggtgcgggtccggtggcgcgcgagatcttcacgtacctccgagcacacccggtcggcgccccgaactaccaggtctcccacctcgctgcgggatcgatcacgccagtcgggcagctcggcaggacctcggcgggctaaactgccggtgagcgtccccttggcctacccagcgtgactgcgagagtccgctcgcggtgggcacggggcttcggattccagtggggcgcggggtcgatcggagggtgatgcggtgagcaagcgtgctcagctcccgtgtcctcgtgtcgacccgtgggacatcgtctgggaagccgccatcgccgcatccgaatggacggcccccgacacgagttcgatggtggtccgcgggcccaggcggcgttcgcgcgtcggtctcgatgcgcccggtcgctcgcgcgccacccagcaaccgagaagagggtttcatggtcgatcagccaacaccgacggaccgtgggggtgcgggtcctgaaggagcagctccaccgcctcctccaccacctccaccacgagcgccaaaggctgcctcagcgccggccacctcgagcgctcaaggtcaggggcgacgacgtcggtcgcgaggagctcgccgcggctcagcggcgtcgagcgctctcgacgccacgtcggaggccgtagcagagacctcgccagccgatcggcccgcgagcgcagctggcgggcgcccagatggcctcggcgacgacgctcccgcgaacggagccgacggctctgggagcccggctcagggggccccgggtggagagggtagtggcccatcggccgagggttcgcgacgtcggcgttcgcgtcgcggcggccgcggtcggcggggtcagggaaccccgagcgaggcccggagcgagccggtgatgatggagatccaggcgccgctcgccgagccctcctcgcagcgtcaggggcgccgtagggcccagagtcgcctcccgagggagcggcgtggccgaccggtcgggcgctaccagatggccgtgcatgtccacggggacgtcacgcacgtcgcgattctcgagggtcgcagcttgatccagcacgcggtctctcgcgcgagcgacaccgagacgagcgtggtgggcaacatctatctcggacgggtggtgaacgtgctacccggcatggaggccgcgttcatcgacatcggcacggcgaagaacgcggtgctctaccgcggcgacgtgcgctacgagcgcgaggatctcgagggactcggtgacggcgcccgcatcgagcagctgctgcgtccgaagcaggtgatcgtgtgccaggcggtgaagaacccgatcgcgcacaagggcgcgcgcctcacgcaggaggtgtcactcccggggcgtttcgcggtgctggtgccgggtcagcggtcggtgggcatctcgaagcgcctcccagaccaggagcgacggcgtctgcgagggctcgtcgaggatctcgtgcccgagggtttcggcgtgattctgcgcactgctgctgagggcgcgacccgagcggaactcgagcgcgacatcacgcagctcgtcgggatgtggcagcgcatcgacgagctggcacgaactgagcacgctccagccctgctctaccaggagcccccagcagcggtccgcgtcatccgcgaggagttctcgcaggagttccgctcggtcgcgatcgatgaccgagcgctctacgaggacgtcgcgcgctacgtccagacgatctcgcccgagctcgccgaccgtgtcgagtactacgacgccgaggcagagggcgttccgatctttcagcgttaccacgttcagcaccagctcgccaaggcgctcgagcgcacggtctggttgccgagcggcggatcgctcgtcatcgatcgcgcagaagcgctcaccgtcatcgacgtcaacacggcccgcaacgtcggggcggtgtcactggaggagacgatccaccgcaacaatctcgaggcggtcgaggagatcgctcggcagctccgactccgcgacatcggcgggatcatcgtgatcgacgtcgtggacatggtggacccgcagaaccgtgacgacgtgatgcgggcgttccgagcagcccttgctcgcgacaagacgagaacccacgtctacgacatgagcccgctgggtctcatccagatgacccggcagcgcatcagtgagggcctcgtggagtcgctctcgtcgacgtgcccgacctgccatggccaaggctacgtcctggacgaggatgtggtcgcgagccgctaggctcgtgcgagctatggacgcaatcatctcaaccgggggccgccaagagcgggtgcgcgagggggacgaggtcctcctcgacctccagtcgttcgagggctcctcggcgcggctcactccactggcgatcatcgacggtgacgaggttctcgtcgccccggctcagctcgagggagcctatgtcgaggtcgacatcgtcggggtggccaagggtcccaaggttcgagggttcacctacaaggccaaggcgaacgagcgtcgccgttacggccatcgtcagcggtacgtccgtgtgcgcgtgacgagtgtccacgtcgagcgcgcggcggcagtggagaggactgcgtagccatgtcgaagaccaagggtggcggatcgacgaagaacggtcgcgactcgaatgcgcagcgactcggcgtcaaggcattcggtggcgagaccgtgaaggcgggctccatcatcgtgcgtcagcgcgggacacgattcttcccgggccacaacgtcggtcgagggcgtgacgatacgttgttcgcactcgccgcgggccaggttcgcttcggcgttcgtcgtggtcgtcgcgtcgtcgacgtcgagcccgccggggagtcgctcggctaggcggccgagcagcgtgtcgagcttcgtcgatcgcgctcagctccatgctcgagcgggcgatggcggggcgggtgcggtctcctttcgccgtgaggcccacgtggatcgtggtgggcctgatggcggtgacggtggtgatggcggaagcgtcttcgtccagggcgacgaaggcgtcgcctcgctgatcgccttccgcgatcagccgtttcgccgtgcagaagatggccagcatggccgcgggcaacggcggcatgggcgtcgcggccgagatctcgtcgtgcggctcccgctcgggacggtcgtgcgtgatggcgagggcaacgtcctcgccgagatcctcgacaccacgacccgcgtggagatcgccagaggtgggcgtggggggcaggggaacgctcggttcctctcgaaccgccgccgtgcgccggcgtttgcggagcagggcgagcatggcgacgatcggtgggtcaatctcgagctgaagctcgtcgcggacgtcgcactcgttgggcctccgaatgcgggcaagagctcactcgttggggtgctcaccaacgccagaccgaagatcggggactatcccttcacgacgctcgagcccaccctcggcgtcgtgcggcgcggccccgagcgcgagttcgtcatcgctgacgttcctggtctcatcgagggggcgagtgagggtcgtgggctcggccatgcgttcctccgacacgtggaacgcgcgcgggtgtgcgccgtcgtcgtcgacgcggcgagtgcggcaccggagcgcgatgccgcgacgacgttgcatgagctccacgcgtatgccccatggctcagagagcgcccgacggtcgtggtgctccagaaggccgatctcgtcgacgaccgagccatggtggccgagcgggttggtgacgcggtcgggctcccggtggcaggtgtcgtctccgctcaccagcgggagggtctcgggccgctgctcgacgtgttcgagcgactcgtggccgaggcgcgggctcgggcggcggcggggccggcggtgaccgtgctcaggcctcgggcgcgtgtggaggcggaggcgcgtcgtgtcgcgcccggggttttcgagttgctcggacgcgacgccatccgggccgtgcgcttgagcgatctcagcgacgagggcgccttacgggtggtgcacgagcgtctcggagcgcttgggctgttgcgggcgttgcgccgtctcggggctcgcgatggcgacgtcgttcgtgtcggggacctcgagctcacctacgaggacgaggcgtgatccggcgcctggtggtgaaggtgggcacctcctcgctgacgaccgaggcgggctcgctccgcaccgagctcatcgggagcctcgccgctcagatcgccgagctcgagcggagcggcgtcacggtggtctgggtcgccagtggcgcggtcgccgtcggactggctcgctgtgggctgacgaggccgcaggaacccgacgtcctccaggccgcgagcgcacttggtcaggtggtgctcgcgtctggactcatcgaggcgctcggagcgcatggagtgctgggaggacagatccttctcacctcggatgcactcgccgatcgtcggagctacctgcatgcgcgcaccacgttcgaggcgctgtttcgcctgggtgtggtgccggtcgtgaacgagaacgacgcggtggccagtgacgagatccgcttcggcgacaacgatcggctcgcggcgctcgtcgcacacctcgtgggtgccgatcggttgctgttgctcaccgatcagccgggcgtcttcgccaaggatccccgttcccatcccgacgccgacctcatcgaggagctgacgcccgaggctgcctcggtggtgacgctcggtggtgccggcacgatgcgcggaagcggcggcatgagctcgaaggtccaagccgccgagatcgcggcccgttcgggggccgactgcctcatcgcgagcgcggctcgtgccgaggtgatcgtggacgccgcgcgcggacgtccgctggtggcgaccctcgtgcgacgccgtcgtcggcgtgagcctgcacggaggttgtggatcgcctacgcggcgacgcctcagggtcgcgtggtggtcgacgacggagcgcgcgatgcgctcgtcgagcgcggcgcgtcactgctcgccgtcgggatcgtcgaggtcagcggggagttcctcgccggcagcgtggtcgaggtcgccgaccgatcagggcggctgttcgccaagggcgtggtgcgggtcgattcgagggatgtgcgtcgttgtcgcgacgaggtcatccaccgtgacgacctcgccatcctcgtcgagggccccgggccgagagagcaccacgcagacggatgactcgtccgcaggtcctcgctcggttcggagtctgccgcgagggttgtgcgcgagcgttcggtgccgtgccgacgaggcggccttggcgagcgacgccgccttgaccacggccgagagccgtggtggcgtgctcagacgagctcggcgatgcggcgagcgagcttgtcctcgatctcgcgattccacgcgagctcggcgagatcgagcggcaggaacaggtcggagatgagcagcgtctccacgcccgcgacgacgaggtccttgcgccagttgccgacgccgatcgtcacggtgacggggctcggtgtgacggtgaagacgagggcccgttgcgcatcgatgatctcagcgaggaacccacccttcttggcctgcagcacgaaacccttcgtgccatccccggccatctcgacggtgaagccatcgccctcgaggagttggcgtaccttggtcgcgagctcactcgggtcgacctgcttgtcgccgaaggtcacggtcttcttgcctgccatggagtactcctcgtggtcggatcgtgccttcatagtctcgacgaccgggcgggccagcgcaagtcgcggcggtgtcgtcctctcaggaaccgaccgtgccgtcgatgagttcgcgcaggaggtcagcgtggccgttgtgacgggcgtactcctcgatcatgtgcgcgaggacccagcggatggtcggagcgccgggctggcgtgcccacgtcagctcgcgcccgtcgatggcgcgccggctcgcatcgatcgcgctctgccaggtggcgaggtcgtcggcgaagcccacgggagcgtcgatgagaaaatcggcatccggggtctctggatcccagaaccgaggtgcccagccgtcctcgccgaggagctgcttgcgaaaccaccacgcctcgacgtcggccatgtggcgaacgagtccgcgcagcgacaggagcgacgtcgcgatcggacgcgtcgtgagctgctcctcggtgaggccttcgaccttgaggagcaacgtggtgcggtggtagtccaaccatccctcgagcatggcgcgctcgccatcgtcgaaccctggttcgactcgcctgggatcgtgcagttcaccgaccgtcgctggcatcgttgcgctctccttgctcggtggggtccgttaccagtgtcaccaccagctccccgtctcggcaggctaccgggtccgacatcgtggtgggtgtggcggatgcgtggtgcctccaggttcgatggcgagcgccgagcgcacgttagagctcttggaggccttcgagtccaaagaaggcctcgcggagttggttgtcgtgttcgaaggcgtcgcgagggccgctgaagcgcacccgaccaccctcgaggacgatcacgtcggtcgcgagctcgaggaaggagacgttctgttccgccacgagcagcgtgatgccctgggcatggagatcacgcaggcgatcgatcacctcgttcacgatccgaggagcaagcccagccgagggctcgtccatgatgagcaggcgtggggccgccatgaggcacttggcgatcccgaccatcttgcgctgtccgcccgacaggctccctgctggctcgccgagacgatcggcgagctcggggaacatcgcgaggacctcgtcgatgcgcgctgctcgctccctctggcgaaggcggaggccaccgaggacgaggttctcgcggatggagagactcgggaagatgccctgctcgctcatgaacgcaacgccgagacgagcgcggcgatgggcaggcacccggtcgaccgactcgccgaacagcgagaccgacccgccgcgcgtctcgtggaggccgacgagggtggcgagcaaggtggacttccccgctccattcgcaccgaggacgagggtggcggcgccgtcctcgaccgagaacgtgatgtcccagagcacctggacggggccccacgcggccccgagaccgtcaatcgtgagcgctggtggtgccaaggaagaccctttcgacctcgggatcgcgcagcgcgtcgcgcagcggtccgacgaagatggaggagcccgcgttcaacacgacgaccgtgggcgtgacctgctcgaggaagccgagcaggtgctcgacgacgacgagtgaggttccctcggccgcgatctcgttcaagaggcccgcgatgctgtgcagttcggctggggagagtccagcgccgagctcgtcgatgaaaaggacgcgtgggcgcagcatgagggcacgtgcgagatcgagcagcttctgctgcgtggcattgagcgtgccggcttcggacgctccgaaccgcgcaagtccgaggcgctcgaggagttcgtcggggtccacgtcgccccgtgggtggcgcgtgctcgtggcaacgaggaggttgtcgcgcaccgtcatcccgcggaacgggcgggggatctggaacgtccgcccgatgccggcgcgcgcgagctggtggggccgtgccccggtgatgggcgtaccgtcgagcgtcacggtgcccttcgtggggcggttgaggccgcagatcgcgttgatgcacgtcgtcttgccggagccgttgggccccacgaggccgagcgcttgggcgggctcgaggtcgaagtcgatcccggcgagcgcgacgagcccgccgaagcgctgttcgagtcccctgacgctaagcagtggcatcggggagctccttgggccgccgaacgagcagcccgcgaacggcggtgaggatgccggcgaggccacgaggtgcgaacaggacgagcaccacgatggcgagcccatagatcagctggaaggcctgtgggtcgctcacgccgatgatcgcatagagcgcatagaggaccacggcgccgatcgttgggccccacagggtgccgacaccaccgaagagtgcgaagacgagggccagcacggtcgtggtgacgtcgaagacggcggtggggtagaacagggaactcgcccagccgtagagggcgccggccatgccggcgatcgcgcaggcgatcagccacgccacggcgcggcgcatcgggacgttgacgccgaccatcgaggcggagtagggctcgtcgcggatggcttggagggtgaggccgaaccttgagttgcgcagccagaccaccacgatcagtgacaggccgacgagcacgatggacgcgacgtagaactggccggaggagtaggcgctcgcgaggttgaggccgtccggaccgttcgtcacggaggtaagggccgggttggcgacgatgtcggcgagggcgagagcagctgcgagggtagcgatcgcgaagtaggcacctcggagccgaaacagtgggatgagcacgaggccgacgacgacggcaccgaggccgccgacgagcacactcgcaagtgccgggacgtgcaggtggatgatggcgaggccggaggcgtaggcgccggctccgaagaggccgaagtaaccgaacggaagataaccggtgaaaccgtagatgacgttgatgccttgagcgagcgcgacgtaacccatcatatagacgagcaggagttcgttgccgtagatgtggaggccgaacgcaaagccgacgaccgggacgacgacgccaaggccatcggcgatggctcggcgccccaggcgtcgtcgtgagcgccgttcggtcgtggggcgttgggcgagcgcaggctcaggcaacgcgggccctccttccgaagagaccttcgggtcgtagcagcatcgtaccgagaacgaggacgtaggggacgaggttcgaccattccgggaggtagacctgcgcgagctgcgacaagacgccgaaggcgatgccggcgacgatggtgccgatcgggttgccaagcgatccgaagacgatgatggcgaacgcggtgatcgtgaggctcgctccctcggacgggtcgacccccgagaagacgacgatggcgagaaccccggcggcggccgccagcgcgatgccgacgccgaaggtgatcgcggagatccgacgagtgtcgatgccgacggcgagggcctcgcgcgcgtcggccatcacggctcgagtctcgaggccgagtggggtgcgatagaggtagaggagaaagagtacgagcagcggcagtgacaccgcgccgacgatccagaggtaggcggggtagctctcgccgaggaagcggatcggatgcgaggggagcgccgcgatcggcagtgtccgttcgttcgggccgaacccgatcgccccgagtgcctcgatgacctgcgagatgccgaagaagaggacgagcgacatggtctcgatgtcccgagcgcgtgcgagcctggggacgacgaggcggtggaaaccgtagccaacggcgacgccgaagggaaggacgatcaccgcggcgaggacggggctcatgtggagggcgctgtagagatcccaggccgcgaagccaccgagcatgacgacgtcgccgtgggcgaggttgatgatgcgttggacaccaaagacgatgttgaggcccatcgcgaagagggcatagaagagcccgagcaggacccctccgatgatcgcaaagagggcgagcacggcggtacggttcctccagccagtcatgcgcggatccgccaccgagcaccggtggcggatccgcgtgaggtggtcgttacggtgcggggtagacggcgctgaccgggttcggtgcaggcgatgtgaccggcttcagggcgaccgtgttgcccgatcccgggaacagctgcgcgagcggcagcaactctcccgtctgtgctccctcggagttgatctggaacgtgccgtcgacggtcgtgaggttacccgagaccgaggtcagcgcgttgcgcagcgccaactgggacaacgaggtcgcgtgccggagcgcggcttcgaccaccagaccggtgttgtagccgagcaggcccagtgtgttcaccgcgctcgggtaggtgctctgcagcttggccatgaacgccgaggtggtgaggccttcggtcacggagttgtaggtgttgtagaagttggtcccgtaggtgtaggtgtactggagaccggtcttgccgagctgcgactcgaacagcgagagcagctgccccgggaagacggtgaacaccatggggaagtggtcaccggagctctcgagttgctgcaagaacgcggtgtcgttcggctggtagccgagttcgagcacggcgccaggcttcttcgcggcgaggctcgagatgatggtcgagtagctcgtcgtcgacgtcgggacctcttcgtaggcggccagcgagacgtgggccgcggtcagcttggccttgagcgtctcggcctgcgagccgtcgaagtcattgcccccgtagacgatggccacgttgttgatgtgcttcgagatgatgaagttcgccaacggatccggccagatcgacgacaccggtaggtcgcagagcacgatgtagggattgcccggggtgaagaacgggatgccggttccggactggtcgaagagcaggtagtgatgcgcctgggcgatcgagacggccggtgcggtgagcacggacccgaagtcggcgacgaggatgttgaccttgtcctgcgtgatcagctggttggtgagcacgccggccgtcgatgggttggactggtcgttcagggcgatgagcttgaccggaatgcgcttgtggtaggcgcccacgtagacgccacccttcgcgttctcgaggctgacccagagcttcaggccgtcgagttcggggatcgaactcgtcgcgtactcgccggacgaggcgtacgtcgttccgacggtgatctgggacggagccgccggcgcgctcgagctgctcgaactgcttgacgaggagctcgagccgcacgctgcggcggtgagtgccagcgtccccaacgtgagcgccccgagcgacgctcggcgaagacgcggacgaagacgtactcgcatgtggtgttcccccttgtatcccacggagtggtcgccgctgcgccgcactgcggctgcggtgcgccaaaccgacggaagcataggtggtggggtttcgggggccaaggcgatgtcgatactatgcacagtctgcattcaggcaagattcaggttccctgatcacccgcgtcggtgacctgtgtgccgtagactggacgcgcgggtcgcgacgccgtgcgacgtcggtggtccccgacgagtgggtcgggtcgatcggtgggtcgagcggctcgcgagccggtgtcggtcagggcgccgggacagcgcaggagtgggcttcgccggagttggagcggtcagatgatccaaagtgtcgaacaagcgcaggtcgatcgggtcgacgcgcgagcgatcgaagcggtcgcggtggcggcccgggcggcacaaccgcagctcgcggcggcgcccggtgagcagcgccgggcggcactgctcgcggccgcgcgggagctgcgcgcgagcagggctgcgattctcgaggcgaacgagcgtgacgtggccgacgcggtcgatctcacgagtgcccagcgggaccgactgcgcctcgacgatgcgcggatcgaacagatggcccagggggtggaggcggtggcggcccaacccgacgtcgtcggtcgggtcgtcgatggctggacgttgccgaacggcctgcgcgtgcgtcgggttcgcgtcccgctcggtgtcgtgggtgtcatctacgagaatcgaccgaacgtcaccgcggacgccgccgcgctcgcactcgcgtcggggaacgcgatcgtgctccgcggatcgtcccaggcgctcgcgtcgaaccgtgtgatccggggcgcgatcgcgaggggggtcgcctcggtagggctcccggaggcgctcgtcgggctcgtcgaggacacgtcgcgagagggtgctcgggcgttcatgcgcctcgagggcatcatcgatgtgctggtgccgagagggggtccggggttgctccgggcggttcgggacgaggctcgggtgcccgtgatcatcgatggcgacggcaactgccacgtctacgtcgatcgggcagccgatctcgcgaaggcagctgcgatcgtcgagaacgcgaagctccagcgacccggtgtgtgcaacgccgccgagacgctgctcgtccacgcagccgttgccgacgagttcctcccgcagctcgccgagcgactcggttcgtgcgaactgcggggcgacgagcggacgcgagcgctcgtccctcgggcgttgccggccacggccgcggactgggagacggagtatctcgcccccattcttgcggtgcgggtcgtcgacaccctcgaggacgccatcgcccacattcggcgctactcgagcggtcactccgaagcgatcgtcacggaggacctggctgcagcgacgcgcttcacgggcgaggtggacgccgcagccgtcctcgtcaacgcctcgacgcgcttcgtggacgggggccagctcggcttcggtgcggagatcggtatctcgacccagaagctgcactggcgcgggccgatggggaccgaggcgctcacgagcgtcaagctggtcatctggggcgacgggcacgtgcggacctgattgggggcgctagcctggggtggacatggtcgcttttggctcgccccaggtggtcgcggaccggcttcgagaggtcgggtacctcccgaccgatgagatcgcgacgacgatcttcctcgccagtgtgctcggcaaacccgtgctcgtggagggacccgcaggaaccggcaagaccgaactcgccaaggcggtcgcgagggcgtgggggctcgacctggtgcgcctgcagtgctacgagggtctcgacgagtccaaggcgctgtacgagtgggattaccgcaagcaactcctggcgctccagagccacgacgatgacctcggctccgtcttcgacgaggcgttcctcctcgagcgtccgctgctgcgcgcattgcggatgacgagcgaccgactgctgctcatcgacgaggtcgatcgtctcgagatcgagaccgaggcgctcctgctcgaggtccttgcggagttccaggtcacgatcccagaactcggcacgctcgcggcgacgagtcgaccgctcgtcgtgctcacctcgaacggcgtgcgtgacctctccgaggcgctcaagcggcgagccttgttcctcttcctcgactatccggatcccgagcgcgagcgtgcgatcgtcctcgaggcggtgccggggatcgaggcgagtctcgccgatgccatcgcacggttcgtcgcaagcgtgcgcgagctcgacgtgaagaagcgaccatcgatcgcagagaccatcgactgggctcgtgcgttggtcgtgctcggtgccgatgtgctcgatcgcgagaccgtggagacgacgctctcgctgctcctcaagcatcgtcacgacatcgagcgagtccggcgcgagctgctcggggcggccagcgcgtgatcggtcgcgtcctcggcctcgggcgcgcactcgcggaggcgggcgcaccggtgagcccggccgagctcgtcgatgcgctgcgtgccgtggctgcgctcgaggatctggcgcgctcgccgctcagggctgcgttgcgcgccacgatggtcaaggacgtctcggcgcttcccatcttcgacgtgctgttcgacatctatttcccgatggcgaacccgacggaccaggacctcgcggagctcgacgatgcagcgatgcgcgccgagctggaggttgcgttgcgcgatggcgatgacgagcgactcgctgcgctggctgctgccgcggtcgagcgtttcggcgaggtgcactctggcgccgcggtcgctggcgcctactacgcctatcggacccagcgcgggctcgatctcgagcgggtgcgcgaggaactccttgcgggcttggcccgcccccacgacgccgaactcgactggcgcgagcgagaacgcgaggcgaggcgtcgtctccagtcgttctcgcgccacatcgacgatgcggtacgcgcgcgtcttgctcgcgagcgcgatcccgacgaactcgcgcacagcctcggcctgcgcatcgccgacgacgtcgacatcatgaacgcatcacgcgaggagttggcggcgattcgcgaggccgtgcgtccactggctgccaaactggtcgcacggctcgagcggcgtaggacacgccggggcggtccactggagctgcgtcgcacgatccgtcggtcgctctcgaccggtggggtgcccctcgagcccgtgttccggccgcggcgaccgcatcggcccgacgtggttgtcctcaccgacatctccggttcggtggcgtcgttcgcccgcttcacgctccagctgctctgggcgctcgcaggggagctgcgtcgacttcgagccttcgccttcatcgacgccgtcgacgaggtcacccccctcgtcggggggtcgtgggacctcgacgctgcgcttcgagcggtggcagagcgcgccgcggtggtcggcaagcagggtcactcggactatggcgccgtgtttgcccagttcgaagagcgcttcgtcgacgccgtcagtccgaggaccacgctgatcgtcctcggcgatgcccgcgcgaactaccacgagccgcgagccgaggtgctcgatcggctggcgcgacgagcgcgcgccacccactggctgaacccggagccggcacgctactgggacagcggggactcggtcatgggcgcctacgccccatcgtgcacgtcggtcgtcgagtgtcggacgctcgcgcagctggagcgcttcgtcgaggaggtgctgtaggctctggccggcgaggcgcccggcggcgacgatgtcacgaacgcgacgatgtcacgaacgcgacggcgtcacaaacgcgtcaaggtcgcacgagggctcccgcgtcaggggcatgccgtgtcgaggtcgaccgcggtgccgttgccgttggcagagaaggccgtcgtggctccgtactggacgtagcgaatggtgccgccgccgaagggggcatactcggtcccggcggtgcccgcgcagacgctggctgggtccgccccgggatcgggaacccagaggggcgtgccggcaggcagggtcgcgccgccggtgatgtcaccccactggtagttggtcgagtagacgcctgcgctcacgccgaccgattcgaggaacgcgagggccccgtagaccgcgtcgcggttggcggtcgtcgagctcgtccacgatccgctgagctcgacgtccagccaccacgcgttgcgcagcgtgctcgaagtggagccgagatcgacgaaggaggtcgcgtaggcgtactcggcttcgtcgtagccgtaggagaagtaggcaccgggcccgctcgccgacgtggcgctcgtgtagagctgaccggccggcgtcgagagtgctgcctggggcaccgggttgaaggaggtgccgttccacgtcgaccagcttgcggtgccggcgggcgggatcgcgagcggcgccatgttggtgccctgggggatggtgttgctcgcgccggcaaagacgtagagctgggtgctggagccccccaggccgaccgcctgttggaacgcgtccggggcgcagccggagttgctcgtccagtcgtacgagaagggccagccgttcgactcgacgagcagcagtgggtcaccgacaggaaggtaggggaggttcgagcagttgaagttgctgaggtcgaccccgctcatggcgggcagttcgatcgccccgacgatggcgccagggagcgggtgcgaccccgcaagtcccgtgtagcccatcgagtaggtggtgccgtcgaagctcgcgtccccgaaggtgaacaccccgccgtcggctgcgaccaaggtgtagccggcaccggtagggctcgggtcgatcccgacgacgggagctgcgagcggacgagacccaccgagaccggtgagccccaaggtgtaggtgttgccgtagaagccagcatctccgaagctgaacaccccgccgtcggccgccaccagccaatagcccttgccgtcgggggttgtggccatcccgacgaccggggctgcgagcggacgtgacccaccgagaccggtgagccccaaggtgtaggtgttgccgtagaagccggcgtctccgaagctgaagacgcccccgtccttggccaccagccaatagcccttgccgtcgggggtgggcacgatcccgacgatgggggctgcgagcggacgagacccaccgaggcccgtgagccccaaggtgtaggtgttgccgtagaagccagcatctccgaagctgaacaccccgccgtcggccgccaccagccaatagcccttgccgtcgggggttgcggccatcccgacgatgggagctgcgagcggacgtgacccaccgaggcccgtgagtcccaaggtgtaggtgttgccgtagaagccggcatctccgaaactgaacaccccaccgtccgcgccgaccagccaatagccgccaccgcctggcacggcggctgccccgacgacaggagcagcgagcgggcgagacccgtagagacccgtcagcccgaggttgtagaccgagccgaaggtctgtgtcgcgaacgggtacgaggagccatccgccccgacgagaacatagccatcggctggcgtggtcgacgaggccagggtggccgccgtgtgcggggcttgcgccgtgagggggcggtcggtcgcgagtccggcggcggtgacggccaagaggctcgtcgcggcaagtgttccgagcgagcgtcgtagcaaccggtgcgacatgagcggtgcgatcctccgtgcgtgcgtcgtgtagcagaggggatatcggcacgccggctcgaaacgttgagccgagcgcgtggcgcgcccacgaggtcggccgcttcgcgccatcgaggtggttccctacgagtggtgctcggtgtggccggcgtctggcgcgacgaactcgttgcgcatcgtgccgatcccctcgacggagctctccaccacgtcaccgggccggaggaagacgggcggccttcgaccggcaccgacaccatcgggtgtgcccatggcgatgagatctcctggctccagggtcatgatctcggagaggtaggcgatggtggtcgggacgtcgaagagcatgtctcgtgatcggccatcttgcatcgtggtcccgttgacgcgcgtggtgagagccacgtcacggacgtcatcgacctcgtcgcgggtcaccatccatggcccgacgggcgtcgaggcctcgaagatcttgccttggaggaactggctcgtgcgatgttggtagtcgcgcatggagacgtcgttgacgacgacgtagcctgcgacgtgctcgagtgcatgggcgacatcgacgtggcgagctcggcgaccgatgacgacgccgatctcgacctcccagtcgacctcatgggacgtgaccgggagcgtgatctgatcgaaggggcccgtgagggaccgtgggaacttcgcgaacaaggtcgggaaggcgggacgctcgtcgtgacccatctcgtccatgtgcttggcgtagttcagccccaggcagatgatggctccgggggtcgtcacggtcggggcgaaacgggcgtcggcggcttcgacggcttcggctgcacgcagctcgccgaacgcgccgaggtctccctcgacggcgcggagcgccgccgcgaggtccgggaatggtaacagccgccaatgggtaccgaaatccatcgcggcgtgcgttcccgttgctgtgcggatagtggcgaggcgcacggttccctccttgtgcgacgcggtgcgtgggtggaacgctagttggactggtcggcgtcgtcggagctggcccggatggtctcgagctcgatggtgagcggtgccgccgactcgctcgagcagcgcgggcaggggtcccgatgaatcatggagcgtaggatgcgagatcccgatggattgaggcgaacgaggaaggcgcccgagaccgggtcgacgacgacggagtcatacggctcccaccgagacgggggcaccatcgccgctgcatcggggtgtgcttggttgcggggcaggcgcacgaaccgatgctcgctcgtgtcgaagatccacgtggagttgcaggtgtcgatcgtctcgtagcgcccgacgtcgttggagggctgaggtgtcatgtgtcggctcccggtcggcgggttggcccccacagtgtacccggtgggcgctgctcgcgaagagagagtgcgcgggtggagttggctagtcttagggctttgcccgccgcaccaaacggcctcgaggaaggagcacgtcatggccgaagaggaacagccagcgagtccggaagaagaggagctcgccgccttcttcgacgacgaggacgcgcccgaggatcgcatgacgttctctgccttcgatgggtttgcgaccggcatcgcgctcgcccccgaggcggtcccacaggcggcgtgggtcgcggtcgcgcttggcgaggcggccgatgaggcaccaccgcgggtcatcgagttgatggcgcactacgtcgacgagatgcgatcggtgctcgactcgaccgacgtgagcgagcgattcgtacccgtcttcgacctcgtgggcgaggacgacggcgaagagctcgtctcgccgtcggattggtgcgcgggatttctgatcgcgaccgagttctaccgtgacacgctcgatgcgctcgccgagacgaacgacgaggtggccgaactcctcgtgccgatcatcagtttcggtaccgatgagggtctcgacgcgctcgaggagagcggcgacgaggacagcctcgcggacgaactcatcgacgcgatccaacccagcgtgatcgccctgcgcggatacctgcgctcggcttagtcgacccgcgcgacggaagcgtcgtccgcgtcgaggggcgcgcttgcggcgcctgtcgcgatggtcggtgcgtccgcccagaggcgctcgagctgatagaactggcgagcctcgggtgcgaggacgtggatcacgatgtccatgcagtcgaggacgacccaggggtctcccgggcgtccttcgacgcgtgggtggagtccgagatcgcgacggatctggcgaacgagatcggtgacgagcgaggcgccgaggcggggatttcgcgccgtcgcgaggatgaagtgcgtcgcgatcgcggtgagttccgccacttccaagaccacgacgtcatcagcatgcttgtcctcggccatgcgggcgatcgcgagcgcgtgcgtgcgctgatcggagagccggaggcggtgaagatcgtggtcggtgctcacaccagggtcgtggaatgggcgcagggtgctgtcggcgatgtcgatgatggggcctcctcgtcgtgatcgttcggttgggcgcgacggcactcgagactcgtgattgccgagcggtcctcggccgagagcacggcatcgcgcagcggcgggcgacaccgaccgaggcgatggaactgacccagtcgatgcagacgaggacggacggacgcttgctcgccgagagctatctcggagcgaccgctgcacgcgagcctgcggtgctcgggcctgctcgaggtcgtaggagatggtgacgccacgcaccagtcagtctagcccggcttgggctgtatcgccgagtgtggcgggggcgcgtcgtggtagagcccgaagcgattgatggcggcgatggcctcgtcgggcaacaggaactggagggggcgacgatcgcgcacgcgttcgcgcagatcggtcgaggagatgtcgagccagggcatctcggcgaagatcggatcgcgaaagccctcgagcacggtcgggctcgggtagccatagcgattgacgacgacgatgcgagagaggagcgggagctcgtcggctcgttcccaggtcctcatctggttcgcggcgtcggagccgacgatcaagaagagctcgtcgttcgggtgctgagcccgcagctcgcggagcgtgtcgaccgtgtaggagcgacccccacgacggatctcgaggtccgatgcctcgaatccgtcgatggtctcgatgaccgcgcgcaccaccgcgagccgcagcgcagggtcggtcacttcgcgagcggcctccttctgccagggcacgttggccaccacgaagagaacgcggtcgagggcggcagcgtactgcgcgttctgagcggcaacgaggtgtccgatgtggagagggtcgaaggtgcccccgaagaccccgatgcgcatcagtggttctgctcgaggagctcgatgacttcgccgaaagcctcgcgttctggctcgtggaccacccattcgtcgacgccgagcgtctcggagacggcctggatcttctcggcaacctcggccgcggtaccgatcaggaccgccggcatggcgagcgcgtcggcgacgtcgacgttgtaggcgcgactgaggtcgcgcacgacggatgcggcgtcgttgccgaggtgcacgaacgcggtgcgcagctggatgcgtggcgatcgatcagcgagggcggcagcctcacgcaccttggcgagcttgcggcgataggaggcggccgagagctgatcggcgaccgcgcgccgcgagtcgggtcgtgcgagcgatgggttgacgctgacgacgtcggcgtagcgtgccgccagtgtcagcacgcgcggccccccgccgccggcgaccagttcgaagcccgccgcccccatggggaggcggaatccgttgagctgataggcccgaccgtggaaagtgacctcgccgtgcgatcgcagccgatcgacgatcgcgagtgcctcggccagacggtcgacgcgagcggcggcgacgtcgaagcgcgcgccgaggtggtcgaagtcgctgcgctgccaaccagctccgagtccgagcgcgatgcgacccgggaacgccgaggcgatggtcgcgaactcggcggcgatgatcgcgggatggcgcaggtcgttattcatgacgagcgccgcaaccgtgaggcgtcgtgacgctgcggcggcgagcgccaccgaggcgatgggagcggtgcgctcctcgatgtggtcggggaacgacacgccgtcgtagccggcggcttcgatggatgcaaggagcgcggggagctcggcgagctgtgtgctcgcgccaagttggacgacgaagtgtgggcgcgtcacgagacgattccttcgcgagggctggagagcggggagtcctggggcatggtcgggtgagcacctagactaccgctaggaggcttcatgaacgcgcttgacgacgccggttggcagccgtgggactggcagcagcgtgtggccgcgcagcagcccgagtggcccgatcccgaggcgttggacgcggtcatcaaggagttggctcagcgcccagccctcgtggtcgccaaggacgtcgaccggctacgagccgcactggcgcgtgcggcccgtggacgtgccttcgtgctccaagccggtgactgcgcggagagcttccacgatcactccgcgagttcgctgcgcgccaagctgaagatcatcttgcagatggccgtggtcctgacctactcgtcgggcgtgtcggtggtcaagatcgggcgtatcgccggccagttcgccaagccgaggtcggcgcccgtcgaggtcgtcgacggggcgaccttgccgtcgtttcgcgggcacatcgtccatgatgacgccccgacactggacgcgcgtcgtcccaaccccgaacgcctactctgggcctacgatcagtcccgagcgacggtgagcgtgttgcgagccctcaccgaggggggcttcgcggatctctccggggcgcatcggtggaacctcgacttcgtcgcctcgtcgccggaagggcagcgctaccaggcgatcgccgatggggtcgatcgggcacttcgcttcatggcaggctgcgggatcgatctcgagcgcgaggccgttctgcaccaagtgaacgtgtggacctcgcacgaggcgctcttactgccctacgaggcggcgctcacccggcgcgatcctgcctcgcagcgctactacgacctctcggcccacatggtctgggtgggcgagcgcacgcgccagctcgacggcgcacacctgcgttttgcatcggggatcgccaatccggtcggactgaaggtcggccccacgatggagcccgacaccctcgtcgaggcctgccggatcctcgatcctgatcggacgccgggtcggctggtgctcatctcacgcatgggtcacgacgccgtgcgtgatcgcctcggaggtctcgtcgaggccgtacgtgaggcgggctatccggtggtgtggctgtgcgatccgatgcacggcaacaccttcgtctcccagtcaggctacaagacgcgccgcttcgaggacgtgatggacgagatcgccggtttcttcgaggtccatcgacggcttggtacccacgcaggtgggatccacctcgagctcaccggagaggacgtgacggagtgtcttggcggctcggaggcggtgctcgagtcggaactgtgtcgtgcctacgacaccatctgcgatcctcggttgaacgcgcgccaatcactcgacttggcgtttcgcgtcgctgaactcctgatccgctgagttctgctcagctcagatccccatccgttgtgcgaccacgccgcgccgggtggcgcggggcgccgctctcgagctacgcgttggcgaccagcgtggtgcggccccggcgtacgaacacgacgagcacgccaagcaaggcgacggtagggacgagcacgacgacctccatccctcggtaccctgcggcactcgcgatcgccccgagcgcggccggtgcgccgaccccgacgatgttggagaacccgatcagataggagttcgccttcggtagcgcaatgggttcgagggtgtcggcgagcatggagagcacgatcgggaagatcgccccgtgcgggatgccaaggaccgccatcgcgatcgcaaagacggcgaacgacggagcgacgaccgcgatcgcgagtccggccacggtgagcaatccggagacgacgagcatgcgctgcttgtgcgcgatcgggctgcgcgcggcgacgacgccgcgtgatgcgaacgacgtgacgaagaaggcggtgaaggcgtactgtgcttctgcggcgctgacgtgagggagcgagcgcgcaatggccgcgccaaaggcggtcaccgcggcaaagggcaaggcgtacatgagctgagcgatcagtgcctggcgggccgctcgatggcgaaacgggtgcacgtcggcgatggcggcgcgctcggaggcgtggtcgttggcggatggtcgggagaggtggatggtcgccatggcgccgaccacgaccagcgggaagacgccgaagacgaggaggggcgcacgaacgtcctggtgcgcgacgaccaggatgcctgactcgatgagcggggcgacggcgagcgaggccgagagtacgagcgtgaagatggcaagctgacgttctcggtcgggtgccccggccgagacgagttggctcagtccggtcaggctcggcatcccgagcccgcccgcgatgccgacgagggccgctccgaggctcgccacggcgaggttggggctgagcgcgaggaccacgagccccgcgagcaggatcagggctgccgcgagaaccgcgtcgcgcaggcgcgatgggtgcaggcgcgacgagaacccgaggttgacgacgacggtggctgctccggcgatggcaccgacgacgccgatcgccgtcgcgccggcgtggagctgatcgcggagcaagagcgcgatggtggtaagggccatgttctgcgtcccgcggaaggacgccgtggcgccgaggagagcgacgggacgacgagaggactgagccatgattctgatagtgtagcggtcattacggttgcatgcgcaacgactatcttgcggtgagtagttatctggcagtgtgcagttgccgaggttggatgcgtcgccacagcgcccaggcgagtcgcggaccgaccaggaagaggccgaggaacgagccggccacggcgacgaagagccacaccacgccttgatggctgagaagacgcaacaccataccgagcgttacggtgctggcccagacgacgatccctcctggccagacctggcctgtacgtcgacgtacgagcaggaatccgacgagcgtcccgacgaggaacggccaccacgtgcgccagacgccgatcagctgctcgctgtggccgtgcgcgtggcgtccgatcacgacgaagatcagtgtcgcgacgatgtcccacgcaatccagcttcgccagcgcatgtcgctccccttcgcgtcgggttctcagcgtcgatcgacctcgggcgatgcacgatgacgcgtcgatcgctctcgacgcagcgtaggcgacctcgatggcgaggctgtccgacaccgttgacggggctctgtgtgctcgggctcgtcggtcctccggtgcggttggcggactgccatgcggcgcgggcagggcctcgggggcctcacggtgtcggtcccccgtgcgcgtgtggtgggggctcacatccttggaggctcacgcgctggcgtgcgagcacccagcgggcggagcgatcgtaggaggtccgtggtggtgctggaggagcgtcacggcctcgatgctctggtgcacgagtgcgaaacccgagccccgccagcgaaggctcacgacgtagtaggcgacgtgttcggccgcgttggagggggccgggccatagctgcccatgaggcagagggtgagcctggagccgttgtgggcaatccaggcagcgctcacggggacgggtggcagcgcgagcggctggtcaggatgcggggcgagaagcgttggcgtcacgactgccgtgacgtggtgcggcaggagcgcagggtacgcggtgtagagagcctcgacgagcgatgcctggtggtcgcgcgtggctcgaaagagcagaatggaagcgggcgtgatgctcgcgaagttggtggcttcgtaggcgagcacggcgaccgtctggcccccctccacgagatacaccggtcgttgccgcgacaggcgctcgtcgacgtgcatgaacggagggttcgggaccgggagcggaaggttgagccgttgccagtcgaccgaggaaaacgcggccgggttcggttgttcgggggccgcgggcgacgtcgagccgcacgccccgagcgcggccccgacggccaacgcgccgaggatgccgaggatgctccgggcccggtgcgctcgaaccgatgcgaacctgatcacctcggtggcgcgagccgaggcgcgaggctcgcgctgcaggtgcgaccgtgtgagcctcgccacctggaggctccggcgaggacgactcgacgtcgtgatcgacatgacgagactctagctcggcagggggaacgcgtcacggagcgtggagcgtgctccacgctcggccactcgtcaggatcaggggcgcgatgtcctcggctctgtcgacgggcgcacccggcgctcgagtcgttccgtcggcgaactcatcgcgacggccggtgagcgaagccgacggcgcgaggccgcggacgcacgcctccgagggtcgctgtggtggcacgatggagctcgggtggggggtgtgtgtcgcagagcgacatgtggtcacaagggggcacgggtgcacgggacgcgttccgggcgcccccggcaggattcgaacctgcgaccgactgcttagaaggcagctgctctctccactgagctacgggggcggcactcagcatgctaccgatccgatgtggcgacgtggcgtccaggttgtagcatcgccagccagatcaggaggagtatgcatgcgctgcattccgggtgagctgacccttgccgagctgcggtcgttgtgggcgggggaaacctcgttcgaactcgacgcgagtgcctgggaggtgatcgatcgcgccgcgcgtaccgtggccgaactcgccgatcgtgacgacccggcctacggcatcaatacggggttcggtcgcttggcatcgacgaagatcccgcgcgaccaactcgagctcctccagcgcaatctcatcttgtcgcacgcggtgggcgtcggcgatccgctcgacccgccgaccgtgcgactcgtcctcgcgctgaaggtcgcaagcctcgcacgtggtgcttcgggggttcgccgcgagctcgtcgaggctctcctcgcgctcctcgagcacgacgtgttgccgatcatccctgagaagggatcggtcggggcctccggtgacctcgcgccactggcgcacgtcggcgcgctgctcatgggtgtcggtgatgcgctcgtcgcgggtgcgcgcgtcccagccatcgatgcgctcgccgaggcggggcttgctccgctgtcgttcgctcccaaggagggtctcgcgctcatcaacggcacccaagtctcgacggcgatcgcgctcgcgggactgttcgccctcgagcgtacgctcgccgctgccgtcgtggcgggtgcgctcgccgtcgatgcggccgctggctccatggtgccgttcgacgctcgcatccacgcgctccgtggccatccgacccaagcagacgtggccgccgcgctgacgacgctgctcgcggggtcaggcatcgtccagagtcatcaggactgtggcaaagtgcaggacccctactccctgcgttgtcagccccaggtcctcggcgcggtgctcgatctcgtgcggatgcaggccgccgtgctcgagcgagaggccaacggcgtcacggacaatccgttggtcttcgtcgagaccggagaggtgctctcgggcggcaacttccacgccgagccggtcgcctttgccgccgatgtgctcgcgatcggcgctgcggagatcggcggcctcgccgagcgtcagctcgcgctgctcatcgaccactcgctgtcgggcctacctccgtttctcgtgcgcgagggcggtgtgaactcgggcttcatgatcgcgcaggtgaccgccgcggcgctcgcgagcgagaacaagacgctcgcacacccggcgtcggtcgattccttgccgacgtcggctaaccaggaagaccacgtgtcgatggccaccttcgcggcgcgcaagctccacgaggtcgtcgccaacacgcagacggtggttgcgatcacgctgctcgctgcggtccaaggcgtcgagctccgtcgacccttgcgcagttcggatcggctcgaacaggtgatcgcgctcgtgcgcgagtacgtgccacactacgacctcgatcactacctcgccccggacatcgctcgagccacagagctcgtacgggcgggcgccatcgcggagcacgcaccgttgcgcattctcgagcagcgctaggcggtcgacgttcagggagagggctgctcgagccgctcgatcgccgtgaccgagctcgggccctcatcgtcaccgaccacgacggtgagcggatcggttccccacagcgagaccgtggccgccgagcctcctggcagtgagcgcgggaactcgatgcggacatgggtcggtcccgtgagcgccgccgagaggccggcgcgccacagtgcctcttcgacgagggcgagatgaatggcgttgttgacgtggtcgacgatgtcgagatcgctgcggcgtaggtcgagatgccaggtcgcctcgggctcggtgtctggtgtcgtgatgacgaggctcgggcggacgcgacgaccagcggcggcctcgccatagacctcgtcgaagccatcggggagtgacgcaggtgccccagtgtcggggcgggtgttcacccagacggcggcggcgctgacgaggagttcgccgcgaaccaacaggtcggtacgacgctctgcccacgcgcgcccggtcccggagaccgccgtggcgaggtcgacggcgtcgagatagcgaggccaggagaagatctcgatgtcgatcgagcggatgacccatagacccttgtccaccagcggggcatcggtgttgtcgagggtcgcgatgtcgtggaggaagcgggcgatcgcgtcgagccgaagacgtccgtccggcgtcgtgtcagacagcagcacgcggcggtggtcgtcgtagcgacgaccctggtctggcagaggggcgagcggcacgcgcccacgctagtcgggaggggctgacgcgggcaatgacgagctgggacgctcgtcggccagcgatgcgagttgcgcccggagcaccttcttgtcgaacttgccgacgctcgtgcgagggatctcgtcgacgacgacgaggtgatcgggcagctgccaacgcgggacgccatgggtctcgagccacgcccgtgcggcggcgagcgagagcgaggtgccgggtgcgagcacgaccgctgcggcgggcctctcgccccatcgcgcatcggcgatcgcgacgaccgcagcctcgacgacgtcgggatgtcccatcagggtcgactcgagcagcaccgagctgatccattcaccgcccgacttgatgagatccttggtccgatcgacgatgcggagccggccgccggggtcgatggtgccgacgtcgccggtgcggaaccaccctggccgtgccgtgaacgactctgggcccgccccgtggaggtagccatcgagcacccatggtccccgcacgtagatgtcgcccatgtgcgcgccgtcgtgcggaacctcgctgccggtctcgtcgacgacggcgagggtgatgccagcgacgggagcccctgcgctggcgatgtggtcgagctggtcggccaaggggagctcacccatggcgtgcgggagtcgcgaggtggtggcgatcggggaggtctcggtcatgccccaggcctggagcatgcggatcccgtaacgctcggcgaaggtcgtgatcaacgagggtggcggcgccgacccgccacagaggagttcgcgtagtgctccgaggtcgccgccgttcgcctcgagcgcctctgccaccgcaatccagacggtcgggacgccgcccgccttcgtgacgcgctcggcgcggatcagctcgatgaggaccgcggggttgagggtcggtggcgggaagacgagcttcgcgcctgccgccaccgcgccgaagggcagtccccaggcgtagacgtggaacatcggcacgaccggcatgacgcactcgctgcgcgagagggccggcccgttgccggcgttcaccgcgagcgcggtgtggagcacgagggaacgatgagtcgaggccacgcccttcggccgtccggtggtgccggaggtgtagcagatgccggcgcgctggcgctcgtcgagggtgcgcgtgccgggggcgggatcggcgctcgtgacgagcgcgtcgtagtcgagcacctcgccaagggcgttcgcggccccggggtcgacgggaccgatggcgatgatccgtgggatctgtcgaaggcgcggtgcgatgcgcgccacggtcgcaaccagatcgccgcttgcgatgatgacctcgtcgccggcgtcgtcgatgatccaggcgagatcgtcgtcgccaagacgcggattgagcgtgtggagcgtcctccccgagagcgtgatgccgaagtaggcctcgaggtgctcggcgctgttccacgcgagcgtccccacgatggcctccggcggagccaggtcgtcgaggacggtgatgaggcgccgggcgcggtcggcgaagtcgccgaagcgagagcggtgctgctcggtgggcgagcgctgggtgacgatctcggtgtcggcataggccccttcggcgtgctcgaacaggagccacgtcgtcaacgcaacgtccatcatcatggcgacaccccccttcgccacttcggatggtagcgaagggctccgcgccctgtcagctcagtcggcctctggttcgtcctgcatcacgcagaactgtacgccgtcggggtcggcgaggacgcaccaggcgcccccgtcgacaccctcgcgtcggtcggagcgctcctctgcgccaagggcgagggcccgctcgcggagcgtctcgcggctcgcgccgtagaggtcgaggtggacgcggttggcgcgagggtccgccgtctcgatgcgctggaggaacaccggcggcagggacccatcgggcgccacgaggtcgagataggtgccggtgctgtcgagatcgccgatgcgatagcccaggaggcgtgcccagaacgcggccgcgcgccccgggtcgggggtgtcgatgccgatctcgatgcggcgcagatccccgtggtctgcgatgggaggtggtggtgagaacggggggcgccatcgacaggtgtcgcagctcgatcgaacctggcgccaggcgtcctcgatgccgtaccagacggcgtcgaggacggcgggatcggggccgaagcgctctgcgacctggaggtcgagcccgagcgcgcttgcgcgctccgtcgcctcttgttcggcccgctcgaggaggacgccggcgaacagccaccacggcacgaggaggacgctccgggccccgaggcgccagaggcgttccacaccctcaccgacgctgggttgggccagcgagacgaaggcctcttcgacgaggtcgacgccgagacgttcgccgacgaggcgcgcgatcgcggcgagctcggcgttggcgctcgggtcggtcgatccccgtcccacgacgagaacggcctcgggcggcatcggcgagaccgcacgagctcggcgtacggcgagctcgaggagctcgttcgaggcaccgagctggggggcaaggcgcacgtcggcgtcgggggcgagtgctcggatgcgcgccgcgaccgatgccgcgtcgtccttcaagtgacccgcaccgacgagcaccacgggcgcgacggtgatgcgtcgcgcgccagaacgagcggcagcgtcggcagcgtcggcgagggttgggtcggcgaactcgatgaagcctgcctcgacgcgggtcgggaggcgccgagcggcaagctcgacgaaggcgcggaactcagcctgaccgtgctcgagacgcgtgccgtggccgacgaggacgacgagatcggttggggcgcgatgtgtcatgtctcctccgtagcgagttcggcgagcgcattgagtgccgcggcggcgacgggactgcctccgcgacggccacggagggtgaggcacgcgaggccgctcgcgaggaggcgttccttggcttccgccgcgcccacgtagccgacgcagaagccgaggacgacgccgacgttgacggggtgctcgaggagcgccgagagagcggtcggggcgttgccgatcgccaccacggccgggttcgcgagagcggagagcgacgcgcgcatcgctcgcgccgagcgggtctcgacggcgtcaccttgctcgaccgcatcgagcgtcacgatggtcgggagccgcggagcccctgcggcaaccatgcgcgcgtcgacgaggatcggcgcgccggtgcgaaggagacggaccgcctcggtgacgaccgcctcgtcgagtacgaggtcgtcaacgagcgaggggtcggccgtggcgtggacgatgcgcgcggcgacgcggcgcgcgccgggaccgaaacgcgcgagatcgacctcggcgcagatgcgctcgaagctctcgcgagtgatgcgtgctccggcgtcggtcgtcatcgtcgctcccagctccccacgatcgcgtcggtggggcagacttcgatgcaggcgccgcagtcgtcgcaacgtgaggcgacgagctccgggcgccccggagcaggtcgaagggcgtgggtgtggcaggtcgggatgcacacgccgcacccgacgcaggtacccagtgcgatcgccacgctcatcgcgcaggctggtagccacggggtgtcaccgcgagtcctccgaggactcgggtcgccgactggcccacgatgacgatgctcgtcatgtcgacggtcgtgacgtcgaggtcgtcgagcgtgccgagttcgaggtgttcgtcgacgcgttcgacgttgcggccgacgaggacgggcgtcgtcgggggtcgatgtgccgcgaggatcgcgagcgccttctcgagctgccacccgcgtcgtcccgaacgggggttgtagagcaccacggtgagatcggcgcgagcggccgcttcgagccgctgctggatggtctcccacggcgtgaggaggtcggagagcgagatgacggcgtgatcatgggcgaggatcgcgccggcgcgggccgcggtcgcgagggatgcggtgacaccgggcacgacggacaccggcacgcgaccatcggccacctcgtggacgagggtcgcgagcgcgtagataccagggtcgccggaggcgagcaccacgactcgggcgcccgcctcggcgcgggcgaccgcggccatggcgcgctcacgttcggctccgagggcaaagccctgctggagagcgtggcgaccaatgagaggttgggcctggtcgaggtagccgtggtaggcgatcacgacgtccgcgttggcgatggcgccccgtgcccgcggcgtgacgagatcgagcgagcccggtccgagcccgaccaccgttacctcaccgagtggcgcgtcacggaccgccacggcgacggtgacgggcccgtcgatccgcttgggcagcacgagcgttgcgtcgggtccggcgagccgaagggccgcggcctctgccacggatggcgtgtgcacggcgcgctccacgatcggcgatggcgtcggtaccgccacctcacggaggacggcggcctcgtagccgacgatcggaagtccgagcgcgccgagcgctggatgcaagcggcggcggtcgatggtggcgagcgctgccacggcggctggctcgaggtcggcctcctcgagcgccgcgtcgatggcagcgcgcaggtcatcggccgttgcccgctgttccagcccgaccccgaccacgaccgtgcgcgcgatgatgcggggtgcggcgagaccgcgagactcaccgacgttgacctcgaccgctggggctcggcccggtcgtgcacggcgagcgagccagtcggagatcgcaaggccaggccgcggtgcgaagctgagggcagcgccgtcattgaggcgttgctggagccgtgcagggagcggttctgggccgagagcaggcagctcgtcgagcgcgggtgcatcgatgagatcggcactcgtcgtcacgaccgcgaccgcgcccgtcgcacgggagacggcctcggcgaggtcgttcgcacctcgatgggcgcccgtcagcacgacgcagtagcgccgggcgctgtcgagggcgacgatcgcgggcgtgacgcgcttcggggcgaggccgacctcgacgatcgcgcgtacgaccaccgggatcggggcgacgacgacgagcgcgtcgtagctgacgagcgcctcacggagcatggccatcgacgcgtgggcgaccgacgcaaagccgagcgtcttggcgaggtcagcgagctcggctccgatggcgaccacggcgccgccggcggcgccggtgacgctacgcgaactggggcatgaggtggacggggtggtctcgatggcttggcagcctacccgcttggcgagggcaggacgagggagcgcctcctctgcgaccgagatcgccggacgcccgtggcgatggcgggcacacggagcacctcgttgctagagtcgcgctgtggcgccgctgacgagctggatcgacacggatctcgagcacggctacggcctcgaccacctgccgctgggggtggacgccgagggcgtggtggtgcgcatcggggatgtcgccctacggctcgcgccgctcgtcgacgacgggttgctgaggagcgtgtcgcacgggctcgttgctgcacggacgctcggtccgctctttgcggccggctcggccaccatggcgcgactgcgagacgagatcgtggtcctcgcgagcggacgcccggacgacgccgtcgcacgtcggttggtctcgatcgatgcgctcgagctctctgtgccgatacgaccacgcacctacgtcgacttctacgcgtccgaggcccacgccacgaacgccggcaggatcttccgtcccgacggggatccgctgccggctgcgtggcgtcggctcccgatcggctaccacggccgtgcgtccaccgtcgtcgtgtcaggcacccccatcgtgcgcccctggggtctgcgccgcgagggcgagggtgtcgtgctcgggccgagcgcgatgctcgatctcgaggccgaggtgggattcgtcgtcggacgcgcgagcgagcgtggtcggccagtgtcggccggcgcgttcgcggagatggtcggcggcgtcgtgctcgcgaacgactggagcgctcgcgacatccaggcgctcgagtcgttcccgctcggccccttcgccggcaagtcgttcgccaccagcattagcgcctgggtcaccccactctcggcactcgacgcagcgcgggtgacgccgccggtgcaagatccggcaccgagtgccaacctcgtcgatccggacccatggtgcctcgatcttcggctcgagcttcgcctcaatggaaccgtcctcacgcgtccgccggccgccacgacctactggaccccgggccagctccttgcacacctcaccgacaacggtgcacccgtcgagccggaggatctcttctgctctgggacggtgtcgggcgcggcgcccgacgaggtcggttcgctgctcgagctcacctggggtgggacgcggcccgtgcgcctcgatgacgggcacatgcgtacctggctcgtcgacggcgacgaggtcaccatcacggccacggcaccggccctcgacggcggcttcatccgactcggcgaggtgacgggccgggtggtctcggccatcgcgtcgccttggtgagtggctctcgggactcgctgctggcggcggagctcgcgcattaggctcgcccgcgtgcctgttccatcgcgcttgctggtcaacaccggagatggcaaggggaagtcgtctgccgcgttcggggtcatgggtcgtgcatgggcgcgcggctggacggtgctcgtcgtccagttcttgaagagcgggacctggaaggtcggcgagcgcaagctcgccgagcatctcggcatcgagttctacgcactcggggacggcttcacctgggagtcgacggacctcgagcgtactgcggaactggggcgcgaggcctgggcattcgcggccgagcgcctcgcgagtggtgcctacgacctcgtgatcctcgatgagctcacctatccggtgcgctacggctgggtgagcgaggatgcggtggtggaggcgttgcgctcgcgtccttcccgtaccaacgtgatcgtcaccgggcggggggcgcccgagggcgtggtcgagctcgccgacaccgtgaccgagatgcgcaaggtcaagcacgcctacgaccaggggattcgtgcgcgcaaggggatcgagtactgacccggggcctcatcgtcggcgccgcacgctcgggcgcgggcaagaccgcggtcacgctcgggctcgtcgcagcgctgcgcgcgcggggcctgcgcgtcggggtggccaaggcgggtcccgactacctcgacacacgcttgttaggtcgagccgctcgccgtccggcgttcaacctcgacgcgttcctgaccggtcgtgacgggccggcgcgttcgctcgcgttggcggcgcgaggtgccgatgtcgtgatcgccgagggtgcgatggggctgctcgacggcgcgccgaccgccagcacgccacccgtcgcctcgagcgcacacctcgcgcgcacgctgggactggggctcgtcttggtcctcgatgcgacctcaacggcgcagacggtgggggcggtcgcgctcggtctggcgacggcgtctggcgtcgcaccgctcggtgtcatcgcgaaccgggtgcgctcggcgcaccatggggacctcgtagctgaaggtcttgctcgtgtcggtatcgcgctcctcggtcacatcgccgagggagcgctcgacggtcttgcgcagcgacacctcggcctcgtcgacccgagtgagctcgacgggttcgatgcgtggctcgagcgtgctcggtacgtggtggaggagtcggtcgacctcgaagccctggtgcgtcgggcgcctgagctccgcctggtcgaccccgaactcggcgaggcgcggtcccgggtgccggtcgcactctccgtggggccgagcgcgcgctttcgctacgaggagaacctgctcaggctggaggcagcgggagctgagctgctcccgttcgatccgctcgaggaggtccccgacccacacgcacggctgctgtggcttcatggcggctatccagagcattaccaggcggcgctcgccgacaacgggccgctgtggccggcgctgcgtcgggcggcgaacgagatcacggtgatcgccgagtgcggtgggtatgcgctgctcgcacgctcgctcgagggttctcagatggcaggtgtcgtgcccgtcgccatgcggttgggctcgcgtccggtcctcggctatcggtcggctcgcctggttgacggtcctttcggggctcggtcgctgccggctcacgagttccactacctggtaccggaggacgacccaggtgagatcgacgtcgtggacgcccgaggcgagccgcgcccaggcggggtggtgagcccgaggctcctggcgagcttcctgcacttccacctcggtgtggacccggggcttgcgggcgatctgctgcgtcgtgccggcgggggtgggtcgtccgagacggcgtaggatgcgccccgtgagtgggctcatcagcttcgtgggtgcagggccgggcgcgtccgatctgttgacgcttcgtgcggttgagcgcttacgcgcagccgacatcgtcgtctgggcgtcgtcgctgatcccagacgacgtcctcggcttctgtgcccctggcgcacagatccacgattcggccctcatgaccttggaggacgtgctcggcgtctacgcggccaatcccgaggcggccatcgtccggctccactccggcgatccgtcgctctacggggcgatccaagagcagctcgactggtgcatcgccaatgatcgcgccgtcgagatcgtccctggcgttacgagcgttgcggcgtgcgccgccgtgctcggacgcgagctcaccgtgccccaggtcgcccagagcgtcgtaatcacgagggtggcggcccgtacgagcgcctcgatgcccgaacgcgagcgactgcgggcctacgcggcactcggtgggaccctggcgatcctgctctcgggtgcgcatcccgagcgtgtggtcgaggagctgctcgcggagggttcggccttcaccgcgtcgacgccagcggcggtcgtcgtgcgggcgagttggccggaggagcgcttcgagcgcaccaccatcgcaggcatcccggaggccgttcgccgtctcggggcatcgcgcagcgtgaccatcgtcgtcggggatgcgctcgtcgcgcccggagcccgatcgcacctctacgcaccttcgttctcgcatcgtttccgagcacgctcgacggcgggcacgacgcaggggcgcccgcgggcccgcctgcgtcgctccgttcggtgagggcgtcgtgccaggcctgcggaccgggttcacgaccggtacctgtgcggccgcggccgccaaggcagcggccatttggctcgtccatcgtgagcacgtctcgcgcgttgagatcgccctgccgacggggcggcgagtcgagcttccggtcgagtgggatgcgctcgggcgggcctacgtcgagaaggacgcaggtgacgaccctgactgcacccacggggctcatgtgacggtgtcgctgaccccgctcgccgaggcacagctgcgcttcgtggccggtgagggtgtcggcacggtcacgcgccccggtctcgggctcgaggttggtgagccggcgatcaacccggtgccgcgccgccagatcaccgacgccattcgcgaggtgactgacgagggcttcgcggtcgtcgtcagcgttccaggtggcgaggcgatggccgagcggacgacgaacgcccgcctcggcatcgtcggtggtatctcgatcctcggcacgacggggatcgtgcgcccgttctccacggcgtcgtatcgcgcaagcgtcgtgcagcagatcgacgtggcggccgccgccgggcttggcgagatggtgctcgcgaccggttctcgcacggaggcgagggccatggccgagcgttccgatctcgacccggtcggcatcgtcgaggtcggtgacttcaccggcgtggcggtccgacgggccgcccaccaccacatggacccgatcacgtggtatgccatggtgggcaaggtgacgaaggtggcccaaggtctcatcatgacgcacttccaccgcgccgacgtggacacgtcggtgctgcgggaggccgcgatcgcggcgggagctccggcggcggtggtcgaggctgcggatgcgaccaacacggctcgacacttctacgaggtctgtcgtgaactcggcgtggttgcgccgctcgagctgcttgccgaacgcgcggcggtcacgttgtccgaggcgatcgggggccgggccacggtcgaggtcgtgctgtgcgacgtggacgatgccgccgtcgtcgtgcggcgttcggtgcctggcgagcgatgagcgtcgtggtcggctgggtcggtgacgacccctcgaacttgacgggtcgccagctgggcgccctcgagcgcgctcgtctcgtcgtggcgcctcgacggttgcacgaggtgctcggctcactcgcgccgcaggcgacggtcatcgcttatccgacaccgatcaccgagctcgtcgatctcgtccacgagaacccggacgtggtcgtggtcgcgagtggggacccgggattcttcggcatctcgcgcgtgctcgccgatgcgggcctcgacctcgagatcctgcccggaccgacgaccgcagccgtcgcggcggcgcggctcgggcgctcctgggagggcgcgagcgtggtgtcgttcgtcggtcgtgaccatgacgtggccctccaggtcctcgacgaggtgctcgctggtgacggtccggtgatcgcgctcttgtgtcccggccaggcactcgtcgacctcgcgaatgctgtggcggcttcgggtcgacggtcctggctcgccgttgccctcgggacggcagaggaggtcctcgacgaggcgtggcaggcccgctccgaggcgccgcgtgtgccgagtctgctgtggatcgatggagctctctcgcgccgtgaggtggtccatcggatgcgcggtctcgacgtcttcgccgatcgacctcgagactcggacggcgtcttcacgagtctcgaggtacgcctcgtcgcggtcgcacgactcgctccggatcgactcccaccgggcgcgcgggtgctcgaggtcggcgcgggcacgggatacgtgggtctcaccctgtggcgcctacgtcccgacatcaccatcgtgcagctcgagccccgcgcggagcgtgcggctcgagcacgcgagcatgcgcgagcgttgggtgcgcgtgtcgaggttctcgaggcacgcgtcgaagagcatgctcccgagggcgactacgacgccgccttcgtcggcggtggcgggccgcgtgcgctgcgagcgacgctcgatcgcgtccgaggtgggggtcgcgtcgtcgccacgttcgtcgatcccggacgagccgcggtcgcccgagagctgctcggcaacctcgaactcatcgaggtcgcggacgcgtctcctgtcgcgccggaaggggtccgcttcgttccccgtagtccgatcttcctcgcgtggaggtaggagtcgggggagctggctcgagggccgaccgtgcgagctcgtacagtgatggatcgttgcccgcgctcgatggatcgtggctctcgcggttcgacgacgagccggcgcgcggaggcccgtgccgggctgagggagcggtcctcgctcaggtagccgttgtgggtgctgccacggtcgggcgtggccggtgacccctccagcgaatgttgacgggggtcagagggagctgggcacgcgcgtccgctccggcacggtgtcgacaggcacggccgaacggtggtggggctggaagcgagtctcgtcgctcctctctcgcgcggcaacgatgccaacggatcgatcgggtccgagacctctggcgaggcttcgtaccggcgcgacaaccgtgccgctacgcggctcgctgggggggaccggggaggtagcgatgcgtcacagtggctcgagcacgacgcctgcgtaaggtggggcttgccgaatgccgatagacagtgggtcctcggcggactcgcggatcaggggtgcgggtgcggttgcgaggtgccggaggaggtgcgcacatgacgtcgtggtacgggcggagtcggttgcacgctgggatattggtcgcggtcgcggggatcgggctcgccgcttgcggacaggcgacctcgtcgacgcattccacgagctcgtctcgctcgtcgtcgactccgaagcgttcctcctcgcagacttcgtccactcgctcatcgtccgggtcgtcatcgacccccgcagcggtcgccccatgcgatacggcggcgttgtccgcgtcactcggccaaccaagtggggcggcgggaacgacctactatccgctcctcctgacgaacgtgtcgtcgcggtcgtgcacgctctacggctacccgggggtgtcgctcgtcgtgtcggcgagtggttcgcaggtgggccgatcagccagccgcgtcgcggggagcgagcagacggcgacgctcgagccaggacagtccgcgcaggccatcctcggcatcgaagtcgcgcagaactacccgacctcgacgtgccagccaaccaaggtcggaggcgttcgcgtctaccccccggatcagacgactgcactgtacgtatcggcgcctgagctctatggatgcgccaaccgctcagtcgacctgctgaccatcgaaccgctgacacgggcccaatccggtaccggcagtggttcggggggtgcgacgtcctgaagcgtcgggatggggcaacagacgtggtggagaggggtcgcgaactgctccaacagaagtccgtgcaacccatgcgtacgcagagtcgagtgcgagcgtggccctgtgaacctgaccgagtgggcacgtcgccaggggatccacccgcagaccgcctccactggatccatgctggtggctagctccctgcaacgagaccccccgctctgtgaggagcccgaccagcatggacaggcggagggagcgcacatgaagggcacgaacgccacacctcggagcagatcctccggaggctggccgaagggggacgagagccaacgaggggccacggtcgccgaggtcgctcgcgccctcgcacatcaccgagacgacctggcagcggctggaagcagaccgacggccccatgaaggggcccgacgtgaagagggtgaaggagctctcggccgagaaccggcgcccgaagaagctggtggctgatctcgccctcgacaacgacagctctgaggagctggccgagggaaacgtctgaccccggaccgccagcggggagccgtgcacctactccgccagcggttcgcaggtcacctgagcgacagcgtgcgaggcgcaggtcgggcgggccacctgactgcaccttctcacagcctcggccaagcgttggaaggctgctacggtcgagagcatcggcgcccaacgggaccagcgagcggacgtgcgcgaacgtggtctcgcggggaaggcggacgtggttctggagccggccagcgacaccacggtctcgggcgtgacccaggtcggcagctgcctccggcgttcgactcgactgcctggttagagtgcttcctatggttgcacccggcatcgatctcgacgacctcgaccccaccgttcgccctcaggatgatctgttcggtcacgtcaacaaccgctggtttcaacggacggccatccccgacgatcgagcacgctacggcgcgttcagcgagctcgccgacgctgcagagatcgcggtgcgcgaactgtgcgagcaggcccgtgaggctccggccgggtctgaggagcgcaagctcggcgacctctacgcgagtttcatggatgccgaacgcatcgaagagcaaggcgccgcacccatcgctccgctccttgcggcgatcgacgacgtcgccgattacggatcgttctggcacctgctcggcagtctcgagcgcgatggtgtgcgcggcctcgtcgacctcttcgtcgacacggatcctggtgacccttctcgctatctcgtcttcgtctcgcaaggtgggatctcgctgccggacgagcgctacttccgtgaggaacgcttcgcatcggttcgtgccctgcatcgacagcacgtggcgacgatgttcgagcttgctggcctgacgaacgcggccgcgagggccgcagcggtcgtcgagctcgaggcggcgatcgctgctcgccatctcgacaacgtcgcgagtcgcgacgcgctcgccacctacaacctcatgacgtacgaggacctcgtcgggttggtcgcgcagggccaccgcgaggccgaggcgttcctcgaggcctggatcgacggtatgggcgtcgatcgtgcggtggtccgtgaggtcgtggtgcgccagcccgccttcctcggctcggtcggtgagctgttcgaggatggtcgaatcgatgtctggcgcgactggctggcctggcacgtcattgcccacagtgctccgctgctctcgacacgcttcgtcgaggagagctttgccttctacggcactgcactcaccggtgctccgacgttgcgggcgcgctggaagcgtgcggtgtcattcgtcgagggggcgatgggggaggcggtcgggcgcctctacgtcgcgcgccacttctccgagcctgcaaggcatgcggtgcgcgagctcgtcgaccacctgctcgatgcgtaccgtgagagcatcgcctccttggagtggatgcgcgaggagacgcgggccgaagcgctcgccaagctcgaggcgatcgtggtcaaggtcggctatcccgacgcctggcgtgactacggcgcgctcgtcgtcgacccggaggatctcatcggcaacgctcggcgcgcggcgtcgttcgccatggacttcgaactcgccaagatcggtcggccggtcgatcggtcggagtggttcatgacccctcagacggtgaacgcgtactacaacccaggcttcaacgagatcgtcttcccggcagccatcttgcagccgccgttcttcgatgccgaacgggacgccgcggcgaactacggggcgatcggcgcggtcattggtcacgagatcgggcacgcattcgacgatcagggctctcgttacgacggtgagggccgtctgcgcaactggtggaccgacgacgatcgggcgaacttcgagcatcggacgaaggcgctgatcgaacagtacagcgcgctcacacctcgacagatccccgagcaccacgtggacggggcactcaccgtgggcgagaacatcggcgacatcggtgggctcgcgatcgcgtggcgtgcctacgagctcgccctcgacggcgcggagccccctgtactcgaggggacgtcaggtggagagcgcttcttcttctcatgggccatctgttggcgagagcaacgccgtgacgaagaggcgctgcgattgctcgcgatcgacccacactcgccgccagagtttcgctgcaatcaggctgcgcgcaacgtcgacgccttccaccagacgtttcacaccgatccgtcgtcggggctctggcttgaccccgaggagcgcgtgcggatctggcgtgcctagctgaccgcgagaaccgagactgcatgcccgagtgacgtctcgcgggctgtcggccccggtgctaccatcggctcgagcacaggggggaccatgccgtactaccgtcgcgtgggtgaggtgccgcgcaagcgccaccagtacgtacgtgcgcacacaggcgcgcgtatcgccgaggagctgatgggcaaggagggcttcgcggcggagtcgtcgctgctctaccacctggggcggccgacggccatcgtggatgcagcacccgtcgcgattgcgggcaccaccctcgtcgcgaatcgtccactgctccctcgacaccttcgcacgcccaagctcgccggcctcggtggcgacgctgccacggaccggcacctcttgctcggcaacgacgacgtgtggatctcgtgggtggtggcggatcgtccgagctcgctgcagcgacacgccgtcggggacgagtgctactacgtccatcgtggtacgggcgcgtgcgagtcggtcttcggcaccatccgagtaggtcccggcgactatctcgtgttgcctgcgtcgacgacctatcggctcgtcccggacgaaggttcggtcctcgagtgtctggtgctcgaggcccggggtcatatcgagatcccggaccgctacctctcccagcggggtcagctgctcgaggcggcacccctgtgcgagcgagacctgcggggccccgagggcccgctcgtcgtcgagggcgaggacgtggacgtgatcgtgcgtacccgtctggacgccacgcgttacacctacgcgacacaccccttcgacgtcgtgggttgggacgggtgctgctatccgttcgcgttccagatccgcgacttcgagccgatcgtgaagcgattccacgcgccaccgcccgtgcatcagacgttcgccggaccgaacttcgtcgtgtgctcgttcgtcccgaggccgttcgacttcgatccggaggcggtcgcggtgccctaccaccatgcgaacgtcgactccgatgaggtcctcttctacgccgacgggaacttcatgtcgcgggcgggctccgggatcgaggcgggttcgatctcgctgcatccgtcgggcttcgtccacgggccccaaccgggttcggtggacgcagcacggggtcagccaggcaccgaggaggtggccgtgatggtcgataccttccggccgctcatgctgtcggagacggcactcgcgatcgacgacgacgcctacccgtggacctggtcgaggcgcggtcctggagcgcagtcgtgagcaccaagccgttcgcctcctcggcagacctcgcgcccaagcacgaggtcctcgagcatctcgccgatggtgtcgtcgccttgaccgccgaaggtgaccccaacgtcggtgcgatcgcgacgagcgaggggctggtctgcgtggaggcgcgtgcgacgccagtggcggctcggcgctggctcgagcgactgcacggcgtgctggatgggccggtgagctacctggtgctctcgcactaccacgctgtgcgggtgctcggggcgagcgccttcgacgcgggtgcgatcgtggcacacaccgccaccgccgaactgatcgaggagcgaggtgccgaggactgggccagtgagcaggctcgcatgcctcgactgttcgaagagccggcgtcgatcccgggcttgacgcggccgacgctcaccttcgccgacgagctgcgtcttggccgtgggggtggacgaggcgacatctggctgtggtggcttggtcggggccatacccgtggagacatcgtcgtgtggttgccgcgcgagcgggtgctcttcgccggcgatctcgtcgaggcccgggccgcgctctacacgggcgatgcctaccaccgcgagtggtcgggcccgacgctcgatgcgatcgccgacctcggtgccgaggtgctcgtcgggggtcgaggggccgtcgttcggggcagggaggccgtggcggcggcgatcgcgcagtcgcggcgcttcctccaggtcctcatcgacgagtcctcgcgcgcgctggacgccggtggcggcctccgcgaggccttcggcgcctgctacgaggctctcgcgccgacctatggctcctggccgatcttcgagcacaccatcccgttcgacgtcgcccgtgtcgtcgaggaactccaaggggtcgagcaccccacgatctggacgacggagcgcgatcgggccgtctgggacgagctgcaggggtcacggtgacgagggcctggccggtcgcgatcgtcggtggcggtccggtcgggctcaccctcgcactgtgcctcgcgcgccagggcgtgtcctcggtgatcctcgagcgcaacgacggcgcgacgggcgagggctcgcgcgcgatctgtcagcagcgcgacgtgctcgatacctgggacgcggtcggtgcgtcggcgatctggcgagagggcctgacgtggtcgagggggcgtacgtacgtgcgcgatcgggaggtgcgcacggtcgagctcgccgatgtgggtcgcagcgagctaccggcgttcgtcaacatctcacagctgcgcgtcgagtcgatcctgcgcgcgctcgtcgctgagcgtccgatgatcaccctccggactgggttctgtgccacgagcatcgtcgacgacgacgcgggtgtgcgcgtcgtcgggtctcgcggtgaggtcgtcgaggcagcgtgggtcgctgtgtgcgctggcgcgcacgccgatggcctgcgacgtgcactcggcgtcgagctcgctggcgagacccaccccgatcgcttcttgatctgcgatgtgaaggtggatctcgacaccgagagccctgagcgtcgcttctggttcgatcccgagtggaaccccggccgacaggtgctcctccacgcccagccggacggcctcgtacggatcgactggcaggtacccgaggcgttcgatctcgaggccgaggcgcacaccggccgactcgacgagcggatccgagccgtcgttggcgaacgcccctacgacctcgtgtgggcgagcgtctatcgcttccatagtcggctcgccaccggtttcgtcgtgggacggagcgcgctcgtgggcgatgcggcgcacctcatggcacccttcggcgctcgcggtctcaacagcggggtgcacgacgcggagaatctcgcgtggaaactcgccgcggtcctgcggtcgacagctcccgcgtcgctcgttcgcacctacgacgaggagcggcgccaggccgctcggcgcaacctcgaggtgaccgctgcgaccatgcgctttctggcaccgagggacccccacgaccgccagcgacgcgaggcgatcctcgccggcgccttcgctggcgacgccgaggcgatggccgcggtcgactccggtcggctctacgagccggcgtgctacgacggatcgtcgctcaccaccgacgatccccggcgcgcatggttgggctatgacgacgccggtcgacccatcggtccggcggcgggcatgctgctccccgacgtaccgacggccgacggtacccgggtgcgcgcgcagctgcgcttcaccggcgggatcatcggaccgggctgggttcgcgaggcaaccgagcgagtgcacgcagacctcggcctcgcgatggtcggcctcgagcgggctcacgccgaccccgacggcgtcctcgcagacgcgctcggactcgaccccgacgaaggggtcgtcgtgcgtcccgactgccacgtcgcgggctttgcgaccagcccgtcgtcggcggtcgcggtcgccgcacgcgcttggggctggggaggaggtgtcggcgggtcgtaggctgggccgacgtgactggcgcgctgctcgtggtcgggaccggctcgaacgtcggcaagtcgaccatcgtcaccggcctcgtgcggatcctcgcgcgccgtggggtcgcggtcgctccgttcaagggtcagaacatggccctcaacgccgccgtcaccgtcgagggaggcgagatcggcagagcacaggcggtccaggcgcgtgcggcgtggcgcgacccgagcgtcctcatgaacccgatcctcgtcaagcccaccggtccaggccgcagccagctcgtcgtgctcggcaagccggccggcgagctccgtgctgcggcgtggctcgagggacgtcgggggctgtggccgatcgtgctcgacgccttcgacgagctgcgcagcagcgtcgacgtggtgatcgccgagggtgcggggtccgcagccgagatcaacctgctcagtggcgacctcacgaacctcgccctcgccgaggctcgtggcgtgccggcggtactggtgggtgacgtcgaccgtggtggcgtcttcgcgtcgatctacgggcactacaccgtgctgccgccctcgctggctcgccacctgcacggcttcgtgatcaccaagctccgtggtgaccccggcctcctcggcccgggcgttcgcgagctcgaggatcgcctcgcgacccgttgctacggggtcgtgccctggcacgagatcgccctgccagcggaggactcgctcgtgcgccaccgcgccacggcgccgcgggcaccagggcagctccgtgtcggggtggtggcgctcccgcacctcgccaacgagaccgatctcgatccgctcgttgccgagggggtcgcgctgtcgtggatcgacgacccgagtcgtctctcgggtgtcgacctcgtcatcgtgccgggatcgaaggcgaccgtggccgatctcggctggctccgagcctcaggcattgcggccgccctcgaggaccaccttcgtgagggcggatggctcttggggatctgcgctggctaccagatgctggtcgacgtcatcgacgatccggtcgaatcgggggaggggaccgtggcaggactcggcctcgtgcgagggagggtgcgttttgggcccgagaaggtcctcgcgctcgtcgaagggtccctgcggtggccagaggctgcctcggttcgtggctacctgatgcaccatgggcgcgtggtgagcgaggaagagccgttcgtcgcgctcggcgacggtcagctcgagggtgcccgacgcggtcggatcctcgccaccgccgtccacgggatcctcgacgacgaccgggcgcgccgggcgctcctcgaggccgtcgccgaggatcgaggtcgcacgctgccccctccggtggccttcgccgcctaccaggaggcgcgcatcgacgaggtggccgatctgctcgaggaacacctcgcgctcgacgcactctgggggctcctcgggtcctaggctcgctgggccgtagggtggccacgagggggccacgaggggagggacgcatgcgcatcacggtcgcgacgaacgccgacaccgaggtgcttgcgctgcgcatggcctgggaggatctcccctcgaccatcgagctccacgtcgccgcgctcggcgagctgctcgagacctggcatcccatcgagggcgacgtgctcgtcgtgcgcgcgctcggcgggatcgcggcggtgcccgacccggcacagctcgcgaccagggcacgcgctggaggagctcacctcgtcgtccttccgggcgaggcgaccttcgacgtaccgacggcacaggcttccacggtgccgatggccgtcgtggagcgcgccttcgcctacgcccgtgaggggggtgctgccaacctcgcgtcgctctgtcgctacctcgccgtccggctcggcggtgtcgaactcgacgtcgcagagccggtgagtatcccgttcgtcgggagcatgggccacacgtcctggtgcgagcgtcatagcgggccgcgcatcgcggtcgtggtctatcgcgcccatctcatcgccggcaacacgcagttcgtcaccgatctcctcgacctcgccgagcagacgggcgtcgcgctcgaggcctggtgggcctactccgcacgcggagaggcgggtcaggtcctcgcggccgagctcgaggcgtccggtgtcgacgtcgtcatcaccacggtgctcgcgggcggcgagaccgaggggctcggttgggatgcgggtccgctcggcgggctcgacgtgccggtcgtccaggcgccgatctcgaccgtgtcgcggcaggagtgggcggcctctgctatgggtctcgtcccgttggacgtcgccatgtcggttgcgattcccgagtacgacggtcggatcatcgcggtgccgatcgcctacaaggagctgatcgatgccgacgaggtcttcggggcgccggtgcacgcctatcgcctcgatcgcgagcgagcgcatcgtgtcctcgaacttgctcgccgcctcggtgcgctgcgccgtcgcgccaacgacgccaagcgcgtggccatcgtgctgtcggcgtacccgaccaagcgctcccgcatcggtaacgccgtgggtctcgacacgccccagagtctcgtgcgcctgctgtcgatgctcgcggagcggggttggcggctcgagacccccgacgatcccgacgcactcatggcgcgccttggtgcgttgctcgatcccgaggccccgagcgagcgtgctcgcggaggcgcgaccctctcgatcgatgcctacctggcgtggtacgcgacgctccccggtgagctccgcgacgaggtcgaggcggcctgggggccgccgccgggctcgcgctacatcgcggagggatcgttgtggttccccgcgatctggatgggcgatgcgctcgttgcgatccagcctcctcgcggctacggcgagcacgagatcgcgatctaccattcgcccgagctcccgccgtcgcatcactacctggccttctaccactacctcacggcggttgctggcgtcgacgccgtcgtgcacctcggcaagcacggcacgctggagtggttgccgggcaagagcgtcgggttgtcgtcgtcgtgctggccggacgtcgcgctcggctcggtgcccctcgtctacccgttcgtggtcaacgacccaggtgagggcgtgcaggcgaagcgtcggagccacgcggtgatcgtggaccacctcgtaccgccgctcacccgagccgacagctacggagccatcgccgatctcgagtcgctgctcgacgagcaccagcgggtcgcggccctggacccatcgaagctccccgagctgcgagcggcgatctggtcgctgctcaccgagtcgcgcatccacgaggacctcggtatcgacgaggccccgagcgtgcgcgacgacgccttcgacgacctgctgctcgacgtcgacggctacctgtgcgagctcaaggacgccacgatccgtggtggcctccacatcctgggcgcgccaccggtcggcgaggcactcgtcgatctcgtggcccagatcgttcgggtgccgcagttggacgtgccgagccttgccgaggagctcgatcgcctcgaaggccgtctcggcgacgggagccgtgcggcgcgcgacgcctctgacgggcgcctccacgagatcctgtgggccctcgccgagcgcgattgggatccggaggtgctcgatgacgccgagtggtgtgcgagcgtcggtcttgaggccgccccggacgacctgcgtacggcgctcgcctgggtcgccggatcgctggtgccgaggatccgcggggcgagccgagagctcgcggccgttgcggacgcactcgaggggcggccgatcgcacccggtccggctggtgcgccgtctcgagggatggcgcacgtcttgccgactggtcggaacttctacgggctcgatccacgagcggtgccgagtcggctcgcctggcgtaccggccagcgtgcggcagccgcactgtgcgagcgctttcgacgcgacagcggcggcgagctccgtcacgcgagcatcgtgctctggggtaccgcggcgattcggaccggtggtgacgacgtcgcgctcgccctcgcgctgctcggggtggagccacgatgggacgcgatctcgggccgtgtggtcggcctcgagctcgtgccgctcgaacggctcggccgagcgcgtgtggatgtgaccgtgcggatctctgggctgttccgcgatgccttcgcccacgccattgcgctcatcgacgaggccgtcgagttggtcgccaaggcagccgacgagggcgatgcgaacccggtggctcagagcggggcgggccctcgcatcttcggcccaccgccgcgtgcctatggttcgggggtgctcgagctgatcgagcacggggcatgggagagttcggcagatctcgggcgcacatgggtgcgctggtcgcagcatgcctacgggcgcgggcgcagcggcgaggaggcgactggggcgctctgggatcgacttcgtagcgtcgaggcgatcgtgaaggcgcaggacaaccgggagcacgacatcttcgactccgacgactacctccaagagcacggcgggatgatcgccgcggcgcgcgcagccggcaacgtctcggttcggggctacttcggtgacacctcgcgaccggatgcacccacggtcaggagcatcgaggaggaggctgcgcgggtcgtccgtcagcgggtcgtgaacccgaagtggctcgaggggatgcgccgtcacggctacaagggcgcgttcgagatggcggcgacggtcgattatctcttcggctacgacgcgaccgccggggtcgcgcgcgactggatgtacgacgcggtgacggatgcgttcgttcgcgatcgcgagaaccgatcgttcctgctgcgcgtgaacccctcggcgctcggggcgatctgtgcgcgcttgctcgaggccgctcggcgcggcctgtggcacgccgacgacgaacgcctggctgcgctcgcggagggcagcctcgaggcagagggggccgaggagtgatccgcatcgacagcgtcgagggcaacgacgaggccaagctcgccatcgcactgctcgcggtcgatccgaccattggcggcgtcttgttcgtcggacctcctggcgtggcgaagtcgacgctcgcgcgttcgctcgccgaccttggcgaggacgcccccttcgtcgaggtgccgctcggtgcgaccgaggacagggtcaagggttcgatcgacgtcacgagtgcgctgcgcgacggcgacgtggtgctgcgccgaggtcttctcggcgctgccgacggtggcgtgctctatctcgacgaggtgaacctccagcccgatcacatcgtggatctgctgctcgatgcggcggcgaccggcgtcaatcgcgtcgagcgagacgggctgtcggccacggagccggcacgtttcgccctggtcgccaccatgaaccccgaggagggggccttgcgtccccagctacgcgatcgcttcgccatgctggtcgaggtcgggccgccccccacgcgagaggcgcgcctgcgggcgcttcggcgagcactgcgcggcgagaacccgagtgtcgacgccgaccgcagcaccgtcgtcgccgcacgagaacgtctctcgcaggtcgacatcggcgacgccatcgaggcagcggtcgacgccgcgatcgctgccgacgtagcctccttgcgtgcggacgtcgcgatggtgcgagcagcacgtgcgcacgctgcgctctcggggaagacggccgctggagccgacgacgtgagggcggtcgcgcccctgatcgtacgcgggcgaacagggagcgcaccacgcgtctcgtcggcgacgggagcctcccgcgctccgtccacgacgccacctccgccagcggtgcgttcgcccggggatgctcgcggtgagctcggcggtggggcagcggatcgcggcggctcggcgagctcggtgacgtcgtcctcggcgcgtcgaggtcccgatgaccgcgagggggtctcgtccgagggggtctcgtccgagggggtcgcgtcgacgagtgcgggtggcgaagccggcgacgctgccggcaccgataccgatggcgaggctgtagctggggagcgatgggcggcgggccagcgccacccgctggtcgggggagcgctctcgcgtgtgcgcgctcactcgggggcgttggggcgcgaggcccacgaactcggtgcctccaacgacgccggtgccatttcggtggcgcggagcgtgctcgcgcgactcgagcgtcaagggggaggcccgctgggtccggaggacctgcgccgaaccgagcgagcacgccgcgaggcgcgctgtgtcgtgctcctcgtcgacgcctcgggctcacaggctgccgaggtcgcgttggagatcgcttcgcaggttgccgaggaactgctcctgcatgcctaccaggcgagggcacacgtcgcggcggtggccttcggcggcgacggtgccaccgtcgtgctgcggcccacgcggtcgatcgaggtcgcccgggcgcgactcggtgcgatcgagcgccgcggtgcgacgccgctcgccgctggtttcgacgtcacggccgagctcgtggtgcagctgcgccatcgaggcatggagccgctcgtggtcgtggtgaccgatgggcgtccgacggtcggtgggcgcgggctcgggccgatcgaagcggccctcagcgctgctcgcgagctgggtcgcctcggtgtcgacggagtgatggtggaggtgggtcgcgcgtcgcgtgatggcctcgaactcgccgcgcgactcgcggccgaggccggtctcggtcacgtcgtcgctgctgatgcgtgagccagggcgtcggcgagcacggtgtcgagcatggctggcgtgaggcgtcgaggcgcggtgttctgcggactcgggtggtagctcgcgaggacgaggcggccacgtccgagttcgatgcgttctccatgtcggaaccggccgagcggctcgccgagcgctgcggccagagccgaccatgcgatcgcaccgagcgcgaccgcgcttcgccacggcacgagctcgagctcgcggacgaggtagggtctgcaggcggcgagctcgccagcacgaggccggttgtcggggggtgcgcagcgagcggcggcgctcagccagacgtcggtgaggacaaggccgtcgtcgcgactggtcgaggtcggctgattcgcaaggccgagtcgccacagcgctgcggtcaagaaggcggccgacgggtcgccggtgaacatgcggccgtgcgcgttcgcccctcggcgcgacggcgcgaggccgacgacgaggatgcgagcagccggatcgccgaagcctggcaccgggagggcgacccagtcggattggctggtggttcgccgccactcgacgagacgatcgcatcgacagcacgtgaggatgtcctgagcgagctgctcgagtgccgtggccatgtgcggagcctatccgtcgcggccggaatggcgacggccgcgcgagtgttacagacaataggcacaccgttgaggtacgaaaggagacgctatgcacgtccttggactcactgtgctggtagcacttggtatttggatcatcgtcgcgcttggagcacggtggtacaggtctgccgttgaggcccggtcgctggttgcgctggtgctcggcgtcgtcgtcgcctggctcgccaacatcgatctgtggcgcttgtggtcgctgcccgacctccgctacggctgggtgggcgtgacgctcaccggcctcgcactcggcgggctcgccctcctgtgggatggcgtgatcggactcgtgagcggcctgtaccgcaaggtcgaggacgaggccgagaccttggagcgacgtgatctgaagcgcgtcgcctgagccgaagctccacttcagcgggcgtcgtcggacgacgagcgtccagatgccagtcccgaggcggcaggcgtgtgcctgccgcctcgctcgcgtcgagcgcccgatcgcctcgcggggttcgtgcgctcggcggtgatggcagcgacgaggcgctcgagtagctccttgaggccgacgggttcgtcggcccggccgcactggtgttcgtggacctcggcgagctcctcgaagctcgcaagatcgccgtagcgtccctctcgctggcggagccacgaggcgatggggcagcgctcgtcacgctggtgcgcaaggggccgaccggcgcgtgctgcgacgaggctcgccagcaggggcaggtcgtcgagggggaagggcgcgatggaggcgaggagcgcccgtgcaccggagcggagcctggtcgggaccgtcggttgtggacgaccgagtccgtagccttggacgaagcgtcccccaatcgctcgccacatggcgaggtcctcggtggtctcgatcccttcgccgacgacctcgaccccggcgtagctcccgagcgcgagtgcagagagcgagcttgcgaacgaccgtgggtccgtcgcgagggaggccaccagcgagcggtcgaccttgagctggtcgatggggaggctgtggacgtaggccatcgacgcccagcctcggccgaagtcgtcgatcgcgatgcgagccccgagggcccggatcgcctcaagccgactcaccgcgctcgcgagatcgtcaccgagcgagtgggcctcggtgatctcgaggacgaggcgctcggtcgatgcggtgcggatgacgcgcgcgacgtcggccgcgaaggtgggcgtgaggaggtgacgcgccgcgatgttgacggccacggcgggcagtgaggggcgctcggcgaggagcgtgcaggcgtgctcgagcgcgtccaggtcgaggcgtcgggccaggtatgcatcgcgctcgaccacgtccatgaacgcatccgcggggacgacctctgccccgtcgtaccaacgcgcgaggagctcgacgccggcgagacggcccgcgacgaggtcgacctggggctgataccagaagcggacctggtcggtgccgatcgccgaggcgagcttcgtgcgcagacggtggcgacgatcggcaagccttgccatctcgtcttcgaagatgcgtgtgcgacctccaccctggctcttggcgtggtacatggcctcgtcggcgtgcgcgagcagcgtctccacgtcgacgccgacaggaccccagagcgcccaaccgaggctcgcgctgagcggtccgccgggggtgggcacggcggccgcggcgtgcaccgcctgcgacagggtcccgagatccatgctgtcgaggcgcgcgaggagtccgaactcgtcgccgccgaggcgcgccacgtagagctcaggagggagtgcggcgagcgacgcgccgacctcggcaaggatgcggtcgccctcggagtgtcggtagacgtcgttccattccttgaacccgtcgaggtcgaggatgccgagtgcgaggccgacaccgtcctcttcgacgcgacggcagcgtgcctcggcttcttcgaggaacgcccgtcggttcggcaggccggtcagcgcgtcgcgcagcgcgacggtccgttgggcatcgcgttcggcgcgcaaggtcgcctcgaggcggatgcgtgctcgctgggccgcgaggctggcggcaacgcgctcgagcagcagcaactcgcgattgccactgaccgggctgcgcacggctcgagcgcacaggacgaggtcggtggcgtcggggaccggggtggcgaacagccagtcttcggcaccggcacgggcttcggcccatcggacgggtcgtggcgagaggcggacctgtccggagtgaccttcgcgtcgcactcgctcgcacagacgtgacaaggcggtgcggcacggggcggcgaggtcgcgctcggacgagcgcgagagcccgagcgtcgtcgaaccggcgacgagcgccgcaaggtcgaagacgcctgtgtccacgaggctcttcgtcgtgacgtcggcgagttcggtctcggtccgacaggcaaggaggcgatccgagccggttgcgagcgcgtcgaagagtgccgcgagcgccacgcgttctgcgaagccggccgcggtctcgagcgcctcggtcgccgtgcgtccgatctgctcgagcagcgcggcgatccgttcggggtcgggcgccccgggttcgacgagcgcgacgagcactgctcggacctcgtcggcgaggacgagcgggatcgcgaccgcgagcggcacctggcggaggcgtggttcggctcgccagtggtcggggagctcgaggtgggaggccggtcggcgcaccacgtagcagcggcgcgcgtcgcgcgcgaggtcggggatggtgagctgtgtgccgtcggttcgtggttcggggagcagtccgacgacgctgcgcatcgtcccgtaggtggcgaggcgctcgaagcgtcgctccccgtcgctcgtggcgagcgcgtcgacagcaccaacgccgggcagctcggcgaggtggcgcgcgagctcgaggatcgtcgactcgggaggttggtcggtggtggagcggagccaggcgaccagtcgatccgtcgccgcctcgagctcgcgcgcccgcgcgcgacgctgctcttggtggagctcggctgcggcctgggcgagggcgtcgagcaccagcgccgtctcggggggcaggcgcgccaggtcggagcggtagagcgagaggagatagcgggtcccgtcgtcgcaggccgcggccgccgagagcgaaccttcgatgccgaagggtcgggctcgctcacgccagggcgcaaagatcgcatcgtcgaccgtggccacgacgggggagagcgaccggagggtcgtgcccgccggcccctgccccgagagcgaggtggggtcgtcggagagctcgaggtccgcacagtacgccttggccgtgccactggtggcgagaatggtcgcgtggtgctctccgggatcgaggcgcgcccagaacccggcgagcgtgggtgggacacacaaggtctcgagggcgtcggcgaggcgttcctcgaagcttcgtccgtcggcgcgccggagcacccgctgggcctggaaggcctgcagcacgagctcgaggaccgctgacggtcgctcgagcgcggggtcgacgacgctcatggtactcctcgcatacgctgcaactcagtatcgtacgccccagggcgctcttgagccctcggcgacggtcgagccctcggcgacggtcgagcccccggcgacggtcgagccggtgcggtaggctcccaccatgaacaagaccgagatcgtgcgagctcgcatcgacgacgacgaggttcgagcgccgatcggcacacttctcgtcgagctcgtggggcgcgacgtcccgcacgtgtgctatcacccgcagctcggcaccatcggtacgtgcgatacgtgcctcgtcgaggtcgatggccagctggcgcgagcctgtgaggtgtcgctccgcgaggggatgcaggtgcgtacgcgaggtgtggatgtgcgtgcggctcgcctgcgtgccgccggcgccctgctcgccaaccacgagctctactgcaccgtctgcgacaactccaacggcgactgtgtgctccacgagagcgtccgcgacctcggggtgaacgaggagctggtgccctttacgcccaagccctacgaggtcgacgcctcgcaccccatgtatcgctacgacccctcgcagtgcatcctctgcgggcgctgcgtgcaggcctgccaggaggtgcaggtcaacgagacgctcagcatcgattggtcgctggagcggccgcgggtcgtctgggacgggggcaagcccgccggcgaatcgagctgcgtgagctgtggccattgcgtgagcgtgtgtccgtgcaacgcgctcatggagaagagcatgctcggtcgcgccggcaccctcacggggctcggccgagctgcgctcggtccgctgatcgagctcaccaaggcgaccgagcctgcgatcggcctcgggcccatcttcgcgctctcggacgccgaggcgcagatccgtcgcggcctcgtgcaacggaccaagaccgtgtgtacctactgcggcgtcggctgcagtttcgatgtctggacgcgaggccgcgacgttctgcggatcgcgcccgagcgaggccccgccaacgggatctcgacctgcgtcaagggcaagttcggttggggcttcgtcgacgcgccagaccgcctggtgcggccgctcgtacgacgtgagggccacttcgaggaggcgagctgggacgacgcgctcgacgaggtcgccggccggttgcgtgcgatcgtcgccgagcacgggcctgacgccgtcggcatcatcgcctcctccaagtgctcgaacgaggaggcctatctcgcccagaagcttgcgcgggccgtcatcgggacgaacaacatcgacaactgctcgcgctactgtcagtcgccggccaccatgggcctgtggcgaaccgtgggctatggcggtgacgccggttcgatcagcgacatcgccgcagcagatctcgtggtcatcgttggctccaacaccgccgagagccaccctgtcatcgcgacgagggtgaagcgcgcgcacaaggaggggcgatcgaagttcatcgttgccgacctgcgccgccacgagatggcggagcgagcggacctgttcttgcgtccccggccgggtacggacctcgtgtggctggcggccgtgacgcgactgatcatcgaggagggactggccgacacgagctttctcgacgagcgcgtcgagggtttcgacgcctacgtcgagagccttgcggccttcgacctcgcgaccgcgacgcgcctcactggcctctccgaagagcagctgcgcctcacggcgcgcatgatcgccgaggccgaacgcgtgtgcgtgctctgggcgatgggagtcacccagcacgagggtggttcggacacctcgacggcgatctcgaacttgctcctcgtcaccggcaactatggccgaccgggcacgggggcctaccccttgcgtggccacaacaatgtccagggcgcgagcgactttggcgccatgcccacgtacttgcccggctatgagcccatcgccgacgacgaggtccgccagaagtggtcgacgctgtggggtgtggaggtcccggatcgacccggactcgacaaccaccagatgatcgacgcgatccacgccggctcgctgcgggcgctcgtcgtcatcggcgaggagctcggcatcgtggatgccaacgcgacctacgtccaagaagccctcggctcgctcgagctcttggtggtggctgatctcttcctgtcgcgaacggcgtcgtttgccgacgtcgtcctcccggccgcgccatcgctggagaaggaggggacgttcaccaacaccgagcgtcgcatccagcgcttctatcgggcgatggatccgctcggtgaggcacgtgcggactgggtctggctctgcgacctcgccaaccgcctgggcgccgggtggagctacgaccatccaggggccgtgatggccgaggctgccgcaggggctgcgatcttcgctggcgtcgactacgaacgactcgaggggtatgcgtccctccagtggccggtggcggccgacggaaccgattcgcccctgctctataccgagcgcttcgcgttcccatcggggcgcgctcgcctcgttcccgtgccctgggtcgagcccaccgagcaggtcgacgatgacttcgatctccatctgaacaatggccgcttgctcgagcacttccacgagggcaacatgacctatcgcaccgccgggatcgccgaggtgacgccggggcccttcgtcgaggtgtccgaagagctggccgccgaacgacacatccgcgacggagcgctcgtgcgcttggtgtcgcgccgaggtgccgtccgggttcgtgccctcgtgacggaccgtgtgcgaggacacgagctgtacttgccgatgaacgggcgtgccaacgaggaggcggtcaacgtcttgacgagctcgtcgaccgaccgggcgacccacacgcccgccttcaaggagctcgcggtgcgcctcgaggtgctcgacgaccccgtcgccgtcgcgctcccgaggcggaactggcgctacggccagcggacgccgcaacgaggcgtggacatcgccgctcgccgtgcccgacccgactacgtcgatcccacactgatccaaggaggtcgtcgccgtggctgaaccgctgacacgtgtgcccgcccgcgcggtggcgagctcgctggagcgcgagcgagccgacctcgcgcgtctcgtcgagacgatgggcgccccagcacgcgacgccgtcgcagcactcgctgcacggctcgacacgcccgcaggacgtcggggtgtcgagacgttgtcgtggctcgtacggctggtggtgacgctgccaccggagatggtcgctggacttgcgcgaggcctcgcagcggcgaatggcgccctctcggactcgtcgccgccgacggtcgccgagctcattcggctggcgagaagccccggggttcgtcggggcgtcaaggcgatcctgagcatcgtccacgagctcggcaccgccgaagcggcgcgtcggctgtaaccgcggacgcgtttcgaacgtcggacaagaggtgctgtgtcgaccgatgtcgtcgaggtgacatcgagcggcaacagggcgccttgcccgagcggcgttctctggttaccatgaggacgtggctcgggcggtggtgatcccacgcccgcggcccaccagcgcgggcggctccgcacagagcgtccggtggcagagcccagaaagggggtcggagccgatggaggctggcacgatcgaggagcagttcccgctcctccagcgcctgaacgaggatggtgaactcgtcggcgatctcggtgtggtcgacctcgaccgtctcgccgaggtctatcgccacatggtgatgttgcggcgcttcgacgagcgcgcgtggaacctccagcgtcaaggcgtcatcgggacctacgcgccctacaaggggcaagaggcggcgcagctcggtgcggcccacggcctcgcggagcaggactggttggtgccgacctatcgcgactgggccgcctcctgggcacgaggggtcccactcgagcacggcctcttcttcgcaaagggccatccccgtatgggcctggtgccagaggaggcgaccgtgctcccggcccaggtggtcatcgctgcccagacactccacggcgtcggtgtggcctggtcgctgaagctccgccacgagccgaaggttgcactcgtgacgttcggcgacggggccgccagccagggcgacacgcacgaggccatgaactttgcatcggtgtttcgagtcccgctcgtgttcttctgtgagaacaaccactgggcgatctcggtgccgctcgagcggcagatgcattctgagaccatcgcccagcgagccgtcgcctacggcatggagggcttccgtgtcgacggcaacgactacgtcgcggtcgtcaacctcgttcacgatctcgccgaacgcgcgcgccagggcgagggcccgttcctcgtcgaggcggtgacctatcggctcggggcgcacaccaccgccgacgatccctcgaagtatcgagagagcgcggaggaagagcgctgggaggcgaaggatccgatccggcgcatcgagcggctgctccagcgagagggtcgcctcgacgatgacgccatcgccgctgcggaggcgagcgctgccgaggcggtcgaaggcgtgctggagcggttccacagcgcgctcgacgacgagccggccacgctgttcgaccatgtctatgccgagctgaccccgcagctcgcggcccagcgcgatcggttcgtcgcgcgggtcaaggaggtcgagcgctgatggcgaagctcaccatggcccaggccctgaatcaagcgctcgcccaggcgctcgagggtgacgagcgcgtgctgatcctcggcgaggacgtcggacgcgacggcggtgtctttcgcattacggacggcctgatcgaccgattcggtcccgagcgggtcgtcgacacgccgctcgcggagtccgggatcgtgggaacgtccgtcggcctggcgatgggcggcatgcgacccatcgccgagatccagttcttcgggttcatctacgagaccatggaccagatcgcctcgcaggcggcccgcgtgcggtttcggtcgatggggcgcttcagcgcgccgctcgtgatccggaccccctacggcggtggtgtcaaggccccggagattcactccgattcactcgaggccttgttcgtacacacgccgggtatcaaggtcgtcacgccgtcgaacccctacgacgcgaagggtctcctgctcgccgccgtcgacgatcccgacccggtgctgttcctcgagccgatgcggttgtaccgtgcgttccgcgacgaggtgcccgaggaaccctatcgggtgcccctcggcgtcgcgaatgtcgttcgcgaggggcgcgacgtcaccttgatcggatggggcgcctcgatgcccgtggtgctccaggccgccgacgagctgatcgcacgccacgacgtcatgcccgaggtgatcgaccttcggacgctctctccgctcgacgaggcgacgatcgtccagagcgtgcagcacacccagcgagccgtggtcgtgcacgaggcggtgcgcaccgggggactcggcgcggaggtcgctgcgctcgtccaagagcgcgcgttcttgtatctcgaggcgccggtcggcagggtctcgggctacgacacgccctaccccatgaccatgttcgaggacctgtggctccctgacgcgacccaggtggtgagcgccgcgctggcagcggttcgctactagcccacgggcgctgggactcgtcgtcgggatcgttgcggccgtggcgccgcgtgagaggagcgcgcatggagtggaagtttccggacgttggcgagggcctgcacgaagcacaggtcgtcgcctggcacgtccacgagggcgacgcgatcgaacgggatgccccgctggtcgacgtcgagactgacaagtcggtggtgaccattccggcgccggtggccgggacggtcgagaagatcctcttccacgagggcgacaccgttcacgttggtgaggtcgtcgtggtgttcggcgacggcagcgcgccggcgccatcgccgctccagccgacggcgtccccggctcatgtcccggcaccgccggttgctccggcgccgacgcccgcgagtgagccgctagcgcgtggggtcgatcgaggcatcgtgctcgcgacgcctgccgtgcggcgcctcgcgcgagagctcggtgtcgaccttgcgagcgtcgtcgggagcggagaacgcggccgagtcctcgccgacgacgttcggcgcttcgcggcgtcgcccgagagcaccgagtcggccgtggccgcggtgtcgacgctgtcgaccggggcgcctcgcgccgatcgaggcgccggcgacgacggtgtcgcgccgctggccgtcgaggccgacgagcgtcggccgctggtcgggatccgcaagcgtatcgcggagaacatggcgcgttcgtggtcgcacgctgtgcaggtcacggtcgtcgaggaggtcgtcgtcgacgagctcgtggcgctccgtgagcgcatcaacgcccacctcggcgagcaacgcatcagctacctgccgattttcgtgaaggccgccgcgagcctgctggcgcgcttcccagagctcaacgcatcgctcgacgaggaggcatccgagctcgtctaccacgcccatcgcaacatcgggatcgccgtcgacgatccccaaggtctcatggtgcccgtggtgcgcgatgccgatcgccgctcgatcagggagctcggcctcgagctcgagcgcctcatccaaggtgcccgggcgcacaccttggggccgcgggacctgaccggctcgaccttcacgatcacgaacttcggttcgatcggcggcatcgtggcgacgccgatcatcaactatcccgacgtcgcgattctgggcgtcgggccgattcgccgccgtgctgtcgtgggcccggacgacgtcatcgtgccggcgtcggtgctgttcgtctcgttgaccttcgaccatcgcgtggtcgacggcgggacggcctcgcgctttctcgtcgcgctctcggagctgctccgagacccggctgccctcgtcgcggagctcgtgtgatggtggtcggggagctgatcgagacggtcgatctcctcgtcgtcggcgggggtccgggtggctacaccgccgcactccgagccgcacagctcggtcgggacgtggtcctcgtcgaggagggcgccatcggtggcgtctgcttgaacgtcgggtgcattccgtcaaaggcgctcatcgagacctcacgcgcctggcacggcctcggtgagctcgccgagcggggcgtgatggtcgcagacgcgtcgctcgatcgtgcgcgcgtccgccagagcgtcgaggcggcgcgcgatcgcctgacgggcggggtcgcgcagctgctcaaggcggcgggcgtcgaggtcgtcgagggccgagcggccttcgtcggcgcgaaccacgcgcgcgtccagagcgcgcacgaggcgacccaggtccagttccgtcaggcggtcgtggcgacggggtctgcggctcggcgtgtgccggggctcgaggtcgaccacgagcacatcctcgactcgacggatctgctgttccgggacgcaccgatcgagcggctcatcgtggtgggcggcggctacatcgggctcgaactcggcgcggcgtgggctcgtctcggtgcgaaggtcaccatcgtcgaggcgatggacgatgtgctcatgggggccgagccggaggtgcgtcgcgcgctgcgcgacgggctgggtcggctcggggtcgaggtgcggacccgcgcggtggtgtcgtcggtcgaggcggtcgccgacggggtcgtcgtcgggatcgagcagggcgcgggcgtcgacaagctcgcagccgacgtcgtcgcggtggtcgtgggtcgagagcctcgcctcgagccagagctcggcctcgaggctgcgggcgtcgcggtcgccgacggcagggtcgtggtcgatgtggcgcgccgcaccacgaaccccgcgatcttcgccatcggcgacattacgcccggtccgatgcttgctcacaaggcctacctcgaagccaaggttgcggccgaggcggcgagtggccacccgagcggcttcgatgctcgcgtcatcccggccgtcgtgttcgccgaacccgaggcggcctgggccggactcggagaggccgaggcacgggctcgctacggatcgatcgtcgtcggtcgcttcccgtatcgggccaacggccgggcggttgcggtgggctcgacctggggcgaggtcaaggtgatcgcacgcgccgatggcgaggtggtcggggtctggatcgtgggtgcggacgcctccaatctcatcagtgaggcagccctcgccatcgagatgggcgccacactcgacgacatcgcgctcaccatccacccgcatccgacgctgagcgagatgctgcccgaagccgcagaggtgggtctcggccggccgacgcacatcatcgtccgtacgcagtcgggcggtcgttagggggttcccggcgcatagctccgggggcggctatgcgcgcccgtggtcggcgcgagcgtcggctgcgagttcgtcgcgagctcgcggatcggcgaccatggtgatgatgcgttgcgcttgttcagtcgcgctcgcgccgaagaggtgggcgacaccgtgctccgaaacgatcgcggagtgctggaacgacgtcaccggcgtgtcgaggcaggcgcgcacgttcgaggcgtcggttggggagtgccaggagcgcagtgcgatgatggactggccctcgcgcgcatggagcgcaccgacggtgaagtcgggttgtccgccaaagccggagatgacgcgagggccgaggtggcacgcgttcgcctgcgcgaacagatccacctggagggcggcgttgatcgcggtcatgcgtggctggcgcatgatcatggcagggtcgttgatcgtctcggtccgaaggagacggagcctcgggttgcggtcggcccacgcatagagttcagccgagccaaagaggaacgacgcggtgatgggctcgctccgatcgagggcggctcgccgctccagggcgaggacgccgtcgctgatcatctcgctccagatcctcaagccacgtcgatcctccaagcgcgccaggacgcgatcggggatggcgccgataccgagctggagcgtggcgccgctcgggacaagacgtgcgacgtgctcggcgatggctgctgcctggggatcgtcggcgttgcgcgcgtccggcgaggacagcggcgcctctgcctcgatggcccagtcgatggcgtcggtctcgatctctccgtcgccgaagacgtagggcacatgagggttgagctgggcgatgacgaggccaccgtgcgagcgaacggcctcgatcgccgcaggcaagatgttgacctccgttccgagtgagacccgacccgcgatcggaagggacgtctggaccatcacgacgtcgggtacgagcgtggtggcgaggagggtcggcaccagcgacaggcgcatgggcagatagcgcagggcgtcgccttggtcgcggatggctgggccgaggaagggcgactcgtaggtgatgcccgggcgagccgggatcgggtgctgggcgttcaggatgaacaggcgccagcgttcgagttcggcctcggcggcgccgaggagggccgttggggtgaggaagttcccgcctgccacgatgcgcggctcacgacggccgatggcggcgagccgcttgcgtaacgtgtcgtctccgatgatctccatggcgggtgctcctacgggattggtcaatggttgggatcgtggtcggacacgtcggggtcgggtcggccgaggttcgggtcgatccgatcgagctcgagcgtcacgtcctcgccgcgctggacgcgcagtgagacgtaggcggcgacgccgacggggatcgggagccagaagttgaagatccgccacgtgaggacgccgaggatcgcgacacctcggggcgcaccgaatccggtcaggagggtgatcgcgagggtctcgacgaccccgagtccgctcggcgtgagcggcagcaccgcagcgacgttggcgatgccgtaggcgacgatgagcgcgaccgggttcatgagctggccgaacgccgccagcatgatccacagggtcgttgcatcgaagagccagttggcgagcgcccacgctgacgcgcgccggaggagctgcgggtcgcgcccgagtgcgcggagtcgctcggccgtttgagcgatggcgtgttcgatggagcgacgacgatgggcgagcggagggacgtggtcgatcaccgtaccgaccgcgtgctgggtgcgacggttgccacgggtgagcaggatcacgaccgcaatggagatcgccatcagcgcgacgccgaggacggcgacgacgaggtagacctcgttgaagccgtagaacgggagcgacacgagcagggcgagccacagcagtgcgttcaagatgagggcagatccgacgctctgggtcgcgagcgcgacaccggtgtcggccccgcgaacccccaggttcgacagcagccgcgcggtgagcccgacgccgctcgcggagccaccagggaggacgtgcgagaccgcaaggcccgcgaggtcgaccttggcgagctgcccgatgctcggcgtggggcgcgggagtaccgtctcggtgagcttcgcatacgcgaacagcgacagagcctcggccaaggcggcgagcggtaccagccaatagttggcgcggtcgaggagcgacagcgtcttgcgaaagcccgcgaattcgggaacgacgaggtactcgatcacgagcaggatgacgaaccctgcgagccctcgaatcgcgaagtgtcgtatgagcttgccgaggctcctacgggttccgcgcaggaccggtcgcggtgatgctgagtgtgatgccgcacgcgacgacgcagatgacgacccagaacgtgatgacgcagcgcgcccgagcgcgggaagcgtcagaccgagccacgaggggccgagtcgagcacgcggcgatgccccccgtccttcggtgctcacaacctcgtcagtctaacctgtcgagaggcgtcttggggcaatcggcgaggaggactcgatggtcgagcgacggagcctctcgctccgtgacctcctcatcgccgaggccgtggccgccgggctcggcgtcgcggtgtgggcgttcgccgtgcttcgtcacctcgagctcgagatcgtcgtggcgggtgttctcgcgctcgtcatcgaaccgatcgtctcgaggctcgtgcgtctcggactgccccgtgtcgtcgcggtgctcgtcaccgcggtgttggtgctcgccgcgctcgtcggcctcgcggccgcgttcgtcgttccgctcgtgaacgccggtcagcggctgctcggagatctcccgggcctgctcagccgcttgcgtgcccatcgagccgcgatcgaggcgctgctcgtgcgccttcacctccagcacgcgctcgacgtgggtgcgcagtcgatcgcccacgcggcgcagttggcggtgaccccggcgctgtccgtggcgagcggtgcggtcggttcgctcgccacgctcgcggtgatcggcacgctcgccgtgttcctctcgctcgaggcgccgaaagcgatcgcctggctggtggcgcagctcgatgcgtcgcggcgtcctcgtgtcgagggcgtcctgcacgacgtcgcgatcgcggtggcgggctacgtgctcggcaacctcgcgacttcggtggttgccggtctggtgatcggggtgacctatgcgatcctcggtctcccggacccagcactcatcggactgtgggtcgggctcgtcgatctcctgccgttggtcggtgggctcgcaggcggagtaccggcggtcgcgctcgcgctcgtcggcggacccgaggacgtcgtcatcgtgctgatcgtggtcctggcctaccagcagatcgaaaatcacgtgctcaatccggtcgtctatgcgaagacggtccggttgagtcccctctgggtcctcgtggccatcttggtcggcgcacaggctgcgtcgctgccgggagcgctcatcgccataccgatcgcgagtgcgatccaggtgatcgcgcgtgagacgctgcgcgatccgttgcggcgttggcttgggcgtggctcaggcgccgtggtcgcgcaggggaccgatctgccaaccccgagcacggacacgggcgacgagctcgtccaggctggcgagggtggcaaggggagccccgggggcgctggtgacgtcggagtcgtgcagcagcagcgtggcaccggggccgagccggtgcgtgaggtcggcgaggatcgaggtgctggacgcggcaaaccgccagtcgcgcccccagcttgaccaggtgacgaggcgaacgccttgctcgtgtgctgccagtcgcgttcctcgactcacgaccccgtaggggggtcggaaccacgtcggacgctggccgaccacctcttcgatcgcaccgacggcgcgggcgaggtcataacgcaccgagcgcgcggaacgcccgagatggttgcggtgccagtggccgtgcacggcgatctcgtgtccgcgctcggccaccaggcgcgcgacccatgggtagcgctcgacctcagagccgagcaggaagaaggtcgcgtggacgtcgagccgctcgagcgcgtcgaggatccgaggcgtggtcaccggactcggtccgtcgtcgaaggtcaaggcgacgtggtcgtcgaggccgatgccagcgacggctgggttgagccgccgtgcgatccaccagtggtgggtgagcgccgggccagcgtggttgacgagcgctgccgtacccacgacggcggcggcatggccccacttcatgggtgcgacctcacgcgctcagctccggggcgcgcgcgagctcgctcaccggagcgccgacgaggtggcgtgctgccagcgcctggcgggtggacgccgcgagcgccagtgcactcgcgacggaggcggtgggatcagcgacttcgacgatggaaccgggcgcgatcgtgcttgcgagcgctcgtggcgggatgatgcgggcggggatcacgctctggtggtgcagcgccgcccaggcgagatcgaccgcgttgatggtgttctgcggcacgtacacgttgacggggctgccaaggacggcgctgagcgccgcgcgtccgagctgaagatcattgacggggacgatgaggctgaggtcgccgatacgcgaacccgcgcccccgttgacgagcgcgacgcccgctgctccggccatcgccacggcggctgggtcacgacgaaccccgcgttcggtcacgacgacggcgatgtggtcgttgtgcagggcggcgtcgagtgccggcgacgcgaggtccggtgtcggcaggagcgccgcgagataggcaacgtgggtcggccgtgcggctgcggacaggttgaggccctcgtagccgatgaggcccgatgcgacgttgaccgcgacgaagacggacgcggcgctcgcgaccccgacgagtcctcgacggagcacaacgcgctggggggagagtgctggtcgcggcggagcctctgtcagcaggtcgaggatgggtgcttcgggggttgcctggaactgtgcgagcgccgggagcgtgagctcttcgggcgcggaggcgtagtggacgaccgcgtcgcggagttcgcgtacgttgcgtgcccagaacgtcacgccgctctcggccatcgcggcgacgttctcggcaccgtggccgacgatcggttcgtaggagatcaccggacggcgtgcggccatcgcctcgagcgatgacagtcctcccgcgttctggacgaccacgtccgaggcggcgagccagaggtcgacctcgttcgtccaaccgacggcgacgatcccgtcggccgcggctgcgcgcgctcggagctcctcgttgtgaccggcgagcacgacgggcaggacgtcgcccgtgctggccaacgctgcggcggtctcgacgagtttgcccaccccccacgaaccgccgacgatgagggcgatgcgcgcgtcaggcggcaagccgaggtggcgacgcgcgctggctcgctccggcagcatccggaagcgctcgtcgacgaagggcccgacgcgcacgacgggtccacgcaggtggccgcggcgcttggcctggacagcggcggtctcggcgaccgcgaggtggacgtcgatgtcggggtggatccacatcggatggacggagaagtcggtgaggaaggtgacgaggtggcggtccgcgacgcacgggtcacgccgcctgcggaactcgccgagcagctgcgcggggaagggatgggtcgcgatgacgatgtccgggtcgatcgtctggagccattcgcgaaccttcgcgccgaaggctcgtcggaacactgcgcgcgcgaccttggtcagtgcagggatgtgtgaccagagctcgaattcgagccgatacgcccagggcgcacgctcgacctcgacgcggaagacggtctcgagcatcgtgccgagacgtggggctgcgtcgaggaagtcgacgatgctgacgtcggcgccgtgacggccaagatgatcggcgatggcccttgccgccccgtcgtggccgccgccaaggcgcgcggacacgatcaggacgcgtggttgggacatcggggccagtgtatcgcatcgccgtacactgggcgaacagtggctctcttgctcgctctcggcgcggcgctcgcgtttgcgggggcgaccgtgctgcagttcgaggcgagccaggctgcgccgcgatcggcgtcgttgcggatcggactcgttcgccatctggtcggcgatcgtcgcttcaatctcggagcattgctcgacgtcgccgggggtgtggcacagttcttcgcgctcaaggtggggtcggtggaggtggtgatgccggtggtggcgagcggtctcgtgatcgcgatcgtggcgcaccacgtccaacgtcggctcgcgatcgtcccccgcgacgccgtggcgttggcggggtcggtcctcgcgctcgtcgtcgtgttggtcgtggcgccccagggaggctcgcgcctgggatcggtcgcggcccagctcgccgtcgccgcggcgggactcggtggcggcgccgtcgcgttgacggtcgggcgtcgggtgctgctgcgtcggggttggtacctcgccgcggccggcgggctcctgctcggggtggtgagtgtcgtggaacgctcggtcgggctcgtgtggagccaacggggaacgctcggcgtcctcgagagctggcagctgtggacactgctcgcagtgggtgcgctcgcgctcctcgtcgtccagagcgcgttcggcgctgcacggctgctcaccgtggcgccgatcgtcgcggtggcagagccgatcgtcgggagtgcgctcgccgtgtgggtcgagggggctggtccaggctttggccctggcaggctcgcgatcgtgttcggagcgatcgtgctcgaggcggtgtcgatcatcgcgttggcgcgaggagcccgcgacgagggaggggtccggtgagcggagtgcgcaaggtgctcgcgctgcacggtcagccgggttcgggtcggagtttcgatcctgtggccaggtggctcgggcgtctcgaattcgacgctcccgaccgaccgggatggggatccaatccattggcgcctcgggagctcgtcgcgcaggcatcgtgggccaaggagcggatcgacggcccgacggtgctcgtgggctactcgttcggtgcggcgatcgcggcgctcgtggcgccgacgtgcccggcggtggccggtgtcgtgctggtggctcctgccgtgacccgcgccgcgttggtctggagcgatcgcctcctcgccagggccggcgtcggacacgtcgcgggatcgttgatcgccgcagtggcggagcggtccgtgccggcggcgctgagtgcgcgggctcgccaggcgttcctggtcgagcagcgatcgctgctcgacaccatcgaccaggtggagacgtcgcttcggcggctcgacgtcccggtcatcgtcgtcgcgggtgctcgcgaccgcgtggtgcctccgcgcggcgccctacggctcctcgagtgcgtgccacaggctcggctcgtcgtctcccgcggtggtcacgatcagcttgcggacgaggcggccgtcgtcgccgatgccgttcgatccctggcctccgaacggagtgcgtgaccggggtgggaggtcttctgtatacgaatgggatccgccggctcgggcgatcggataacattggtacggacgaccggagcagtgggggcgtgctgcggacgtcgtggtgcggggggcacctggagcggcgaaggagccgggtgtcgtggagtcgatgaagctggcgacgtgggactgcgaagattggcgggtgcgtgcgcactgtcgcgacgttgatccgggtttgttctttcccgtgggcgtgacgggtgaggcagaggtccagatccgccgggccaagcgcgtctgtgcggactgtgacgtgcggctcgaatgcctcgagttcgcgttgcgcaccaaccaggagttcggtatctggggtggcaaagacgaggaggagcgtcgcgtgatacggcgtatccgtcgtttgcagcggcgagccgtgtcgcgagcgatctagccggcggcccggtttcgcctcgggcacgcggcggagccgtcgcgggtcctcgggccctggcgcactgtgatgggagcgcgggcgagtccgtcgaccgatctggacagcgctgtgtgcgtccgctgcgatgcgtgcggttgcgcggagacgacggcaaccgctgacgtcgggacgtcgccccgcgagtgtcaaggaggtgagcgccgcacggtaggacgtcgcgctggcgagccccaggtgtcgacctcacaacgtcggaaccggtgctccgtgcagtcggacacggtcggcgtgcgcgtagagacgaaatccctcggcacggagtccgccgacgaggacgatcccggcgtcctcggctgtggtgatcgcgcggtggctgggcgagccgagggcgatcaccgatcgggccccgatcgccgcggccttcaagacgagatcggtgccgatgcgacccgagaggatcacgtccgaaccggtcgcaagcgtgccggccagtgcagcgtgaccgatcgccttgtcgagggcgttgtggcggccgacatcttcgcctacagcgaccggcgacccctgtcgtgcaagaatcgccgagtgcgcggcacgtgtcaaggcaaacaagccgtctgcctcgctcacgagctcgtggagcgcgagaaggtcgtcgacgtcgatcggttccccgtgcggcgacgcggagacctggtgcaggcgccgttccagatcgtcggtaccgcaccagccgcacgagctcgtccgtacgctcggctgaggtgggacggcaaccgggtggcggaggacgaccgtcgcctgacggtaggcgggttcgcccgcactcggtggcggacagagcgacactccgacgacgtcgcgtggcgagatggcgagttcggtcacgacgagacccacggcgagcgcggtgtcctcacctggcgttcgcagtgtcgtggtcacaagctcgggcgctgcgtcagggcctttgacgaggatcgcaagtggctcctccgcgatcacccgctcggcgcggagccgaacgccacctgtccgatcgacaagtgtcacgcgtcttcgtggcgacgcgctctcgactgaccggttgcgctccaccgcaccatgctagctcaccggctcgatagcctgatgaccatggatcagctcgagctcttcgtcgacccggtctgtccgtggacgtggctgacctcgaggtggctcgagtccgtggaggccgagctcggcctcacagtgcgctactcggtggtctcgctcctcgagctcaacggcgacgatccgtcgaatccgtggatcgaggcgatgcgccagggtcgacgcctccaacgagtcatggtgcggctgctggcggccggtgatgacgctcgcgtgagcgcgctctaccgtgccgcaggtcgcgcgacgttcgagggtggtcgtacgctcgacgccgagctcgtccgcgagctcggggagggcctggggctgagcgatgaggacatcgcggccgcagacgatggtcggctcgacgccgccgtggtcacagagcaccagcgcgcgatgcgactcgcaggtccggacgtcggctccccgatcctggctcgtcgcggcggcgagaggggcttctacgggccgatcgtcgaccgccccctggcgccggacgaggcggttcgactctggcacatcgtcgaaggagtgctggataccccggcgttgttcgagatcaagcgcggacgggccgtcgagccccgattcgcctgaacgagcctcctcaggtaactgtggccccgaccaggtgaccaatcccaaaggtgacggcggcggccaacgcggcgagggcaagctgtcgaagggcactcgagacgaccggccgagccgacaacgctccgagcgcgcccccgaggccgagagccgcgagaccggcgagcccgatcgagagtcccgtcgcgagggtgccctgcgtgaagatccagggaacgagcggtacggctgcaccgagggagaacagcgcgaacgatgcgagcgccgcctggacgggagatccggtggcttcgggagcgacgccgagctcctcttgggcgtgaatgcgcagggctacgtcgggatcgcgcatgagatagcccgcgacggcggcggcgagatcgctcgggacgccacgctgctcgtagagctgctggagctcgagtgtctcggcttcgggtcgatgacggatctcggtgcgttccacgtcgagttcgcgctcgaggagttcacgctgcgcacgcatcgacacgtattcaccaatgcccatggagaacgccccggccacgaggccggcgataccggtgaggagcaccgtgtgccctgcgtgggaagccccgaggacgcccaggatcaacgcaacgttggtcaagagaccgtcggaagctccgaacaccgcagctctcgcgccgccaccggtgacgtcgcggtgctcgacgtggtgtgcctccatagctcctgaggctagccgcggaggccgagttcgccgagcgattcgtgccgcggtaggctgggcgtatgcgtgaactgaagctgatcgatcggtcgcaacctcagacgctggtgatcgcgtcgatcttgctgtatctgaacgccttgttcacgctgttcgagatgctgttcgtggggctctcgccgctcgagctgttgaccatggtggtgctcccgatcgtgggcgcgtacggaatcgcgaactctcggcgcatcggctactacctcgcgatcgcggctgccgcgatcccgttgctgacctacctctacttcggcatcctcggcgggatcggaaccatcctgtcctccggcgtgatcatcatcatctttgcgatcgtcccgttcgctctgttgctgcacccgatgtcgcgtgagtatcagcgcgtctggttccactagtcctcttcggcgcccctcgctggcgccatgtgaggccgacgaggcgtccgtagcctctgtctgcgtaccgacgggtgggggcgccggctcgtggtgcattcgacggtgtctcttcacaggccgctggtcacgggcagccgtgcagccccgcgcgcatgcttggcgtgccttcccacctgacgcgagcgtggcggtagcgcgatgagccccgacggacggcttcgccgagctcggctggtggcctcgagggcgttggatggccgcggtctacggcgccgcggagcgatcgacgggcggtgggagggcggcctgggtggcgccgcgtggcgtccgctcgccgtcggcgctctcggcaccctcgacgatctcggcgcgcaggcgtggcaggcaccacggataggtgcgctgcaggtaggcgatcagccgctcacgaacttcgcactggagattccacgacgccgtggagtcccgggcgctcatgaggaggcgcagctgcatcgtggacgtcccgaggctcgtgacctggaggcgtgcggtcttgccgtcccagtcgggagagtcagccacgatgtggaggaacgcctcgcgaatggcgtcgacgggagcggtgtagtcgacctcgacgtgcacccatccgaggatgtcggcggtggtcttcgtccagttctcgaaggcgttggaggtgaagtacgagatcgggagcacgaggcggcgcaggtcccagacccggaccaccacgtaggtcaggttgatctcttcgatccgaccccagtggccgtccacgacgacgacgtcgtcgaggcggatcggctgggcaagcgcaatctggatgcccgcgatgacgttggaggcgatcggtcgcgacgcgacgccggcgacgagggagacgatgccagcgctggcgaggaggccggctccggcgatgcgaacgctcgggaacgagaacagggcaagggccagtgcaacgatgacgatcacgacgaggaggatccggcggaagacgcgcagctgcgtctggaggcggcgggctcgaaggttgtccggaccctcgatgtggtagtggtacaagatggcgtcttcggcggcttcgagcaggcgagcgagggcccaggttccgaccgcatcgagtgcgagttcgatcccgtgggtgaggtcgccgatggtggcaccgggcaagcgcagcgagcgcaccaccatggccatggcgaggagcgggatcccggagcgcaccggtccgatgagtcggcgcagcgcggcggtgcgcacgctgttcgggtgccgacggttgacgacccgggtgatgcgcacgagggcagcagcgatgacgagccccacgacggtggcggcaccgagcgacggtaggatcaccaacagctggtgggcgatgctcacggcctgctcctttggctcgcacctcggcggcatcaggctagcgttggcatcacggctgacgaggcggcttcggagcggcctgctaccatcggctcatggcgtcaacgtctgtcgactcgctcgaagcgctccacgggctcgtcggtacccatctcggctactcggcctggttgacgatcactcaagagcgcatcgatcagtttgccgaggccacaggtgaccaccaatggatccatgtcgacccagtccgagcagcgtcgggaccgtttgggaccacgattgcccatggctacttgacgctgtcgctggtctcggccttgttgccggaggtgctcgacgtacgaggcgtcggtatggtggtcaactacggcgcgaatcgcatccggtttccagcgccggtgccggtcggatcgcgggttcggcttggggcggtgctcgcgagcttgagcgaaattgccggcggtgcgcaatcgcaggtcgacgtcacgatcgaggtcgagggatcgaccaagcctgccttggtcgccgagatcttgtttcgctactaccaggtctgacgggacaccgagccagcagctaggctcgtgtccgtgaagcggcgcgtgctctcagctgctctcgcggatgcgaccctcgtgccgcctcgccagggacgatctgaccgtatcgacggtgtcgatctggatcgcaccgaggccaagcgcctgcgtgcctgggcgacccgtcacatcacggcgcggcaggaggccttgtgggccgaggggcgacgatccctccttgtggtgctccaagggcttgacacggcgggcaaggacggcacgacgcgagcggtgtttcgcggggccgatccacaaggcgtgcgggtcgcctcgttcaaggctccgaccgcactcgagcttcgtcacgatttcctctggcgagtgcacgaggtcgccccagcggccggcgagatcgtcgtcttcaatcggtcgcactacgaagacctcatcgtgccgttggcgaacgggcagctcgacgacgcgggactcgacgagcgtgtggccgcgatcgaggcctttgaacgccatctccttgactcggctacagcgatcgtcaagttcttcttggacgtctcctacgaggtccagggcgagcgactgttggctcggttggagcgcccggagaagcactggaagttctctgagggtgaccttgccacgcgagagcgcttcggtcggtttcgggcggcctacgacaccgtgctggctcggaccagcttcgacttcgcaccgtggcgtcggatcccggctgatcgtcgctggtatcgcaacgcggtcgcggccgccatcgttgcccacgtcctcgaggtgatggatccggcgcctccggccgtggcgatcgagcatctccaccacatcgagcacgtcttgcgttccgaactggcgacgccgggagctgagccgtgatcgggttcgtcgttcgcaactggttccgtgactcgctcgagaccatgttcgtgatcgctatcggtggcatggtgacctcggtcctgcgccaggcccggcgtgggaacctgccgatctatcgctgcgaggcctgtggcggtgtgacgtcgcgtgcgtacgcggtgtgtcgtcactgcggtgcgccggtgcgctcctgaccgttgtggccgatgcgcaggaatgccacgccgggtgcgtaggttggcgggtctgatgagccaactgatcccgcccaagttcgagtcgcccgacgcaaagttgcgcgcggtcggcgcgatgttcgatcgagtcgcacctcgctacgacgcagccaatcgtgcgatgacgctcggactcgatctcaggtggcgtcggcgtctgctgcgtgagctcgccctggcccccggtgcccgcgtcctggatctcgcctgcggtacgggcgatttcttgcgcctgctcgccgaggagggtgccgcgccgatcggcctcgacctctccggtagaatgttgcgtgaagtccctccccacttcgatcgggtccaagccgcgggtgagtcgctcccgtttcgcgatgagagcttcgatgctgtggtgacagggttcgctgttcgaaactttgcgtcgccagaagcggtgttctcggaggtggcacgggtgctacgaccgggtggagcgctcgggatcatcgaggttgccactccacactggaggccggctcgtgccgttcatgcgtggtacttccagcgcgtggcgccgatcatcggctgggttgtcggtcgcgaccgtgaggcgtatcggtatctgcccgcgtcggtggcgttcttgcccgagccgttcgcgttcgctcgcatgctcgtcgaacgggacttcctgccgccgaagcggatgctggtcggcatgggtgcttcccagttgctcgtgacgcacaagaggcacggatgaggcagctcgtcggcctccgcgaggtgcgctcgctgggagggatgcggtccctctacggcatcatccatcgggccgagcagctcggtcggcccttcgaactcgtggaactcgacggtggtatcgtgctcggactcggggagccgagggtggccgagtccggagctccgggtccacggttccatgcgctccggttcggcgagtcgaccctcggccctggtcgctggtatcccgtggtcgtcgcggcggattggtcgcgcatcgccgtggtcggctacgaggccgaggacggcgcgttctcgagcgagcctgcggtctgggacatcgaggagcttgcctacgaccgagcgccgctcgtcggagcgttgatcgaccacgacctcgcgggtgcgcgagcgcgcatcgaggcggccatcgaaatggtgcgccagggcgcgctgcgcaagatcgtggttgcgagttgggcgtgctggcaaccctcggagcgtttctcgatcgctgcggcggcatcacgcctgaagcgtgagcacccgcacgcgcacctctatgcgagcccccactgggtcggtgcgaccccggagctgctcgcgaagacgtcggggtcgtgggcgcgtctcgagccactcgcggggacggcgcgtcggggggcgcaggcacgcctgctcgcgtcccgcaaggaccggctcgagcacgagctgatggtccagcagctcatcgaggatctcgctcaggtggccaaggagctgaagcgccccagcgcgccgttgctcttcgatgccggcccgtttgtgcatctcgcgacacccatcgcggccacgctcctgccaggtctcggttacgccgacctgctcgcggcgatcgtcccgaccgcagcggtcggtggtgtcccgcgtccggtcgctgctgacctcctcgccacgtgggagccgtggcgagggcagtacggaggcgccgtcggcgtgagcgatccgtctggtgacggcgagttctacctctcgatccgaggtgcgacgatcgacgacggcgggtgcgtccgcgtcgcagccggcggaggagtcgtcgagagctcctcggtcgatggcgaactcgccgagaccgtcgcgaaaatcaatgccgtcgctggcgtgttgggcgccgccaccttgtatgcctgagtggatccgcgttcgcggcgcgcgagagcacaacctccagaacgtctcggtggacgtgccacgcgatcgtctcgtggtcatcacgggtctgtcgggctcgggcaagagttcgctcgcgttcgacacgatcttcgccgagggacagcgtcgctacgtcgagtcgctgtcgtcgtatgcccggcagttcctcggtctcatggagaagcccgacgtcgatgtcatcgatgggctctcacctgccatcgcgatcgaccagaagtcggcttcgcacaatccccgctcgaccgtcgcgaccgtcacggagatctacgactacctgcgtttgctctacgcgcgcgtcggtcatccccactgcccatcgtgcggacgtgaggtgagccggcagacgccccaggacatcgtggactgggtcctcgcacgttatgagaacaggcgtttgctggtcgtggcgccgctcgttcgcggccgcaagggaacctacgacgagctgctcgaccgactggcgcgcgagggatggtcgcgcgtgctcgtggacggggtgctgtggtcgctcgacgaccgaggctccatcaacctggcgcgctacgaggcgcacaccatcgcggtggtcgtcgaccggatcgtgcccaagtccgccgaccgccagcgtctgaccgagtcggtggagacggcgctcaaggccgctggcggcgtcgtcgaggtcgtgccggtcggcgacgacggcgagctcggagcgggcgagcgcttctccgagacgctcgcctgtgccgtctgcggcatctcgctgggcgagctcgaacctcggagcttctcgttcaacagccccttcggtgcctgtccggcttgtggggggctcggggtccgcttcgtcgtcgacgaggatctcgtcatgcccgacccgaatcgctcggtcctccagggcggcgtcgtcgcgctcgggacgctgcgggccgatctcgttcgtcggcagatggagcgcgccctgcgcgccgcgggtttctcgctctcgactccggtcggcaagcttcccgaggcggcccgacgcctcatcctcgagggcgcttccgagccgatcgaggagcgctgggtcgatcgtgccggtcgtgagcgcagggcccaggtgacgttccagggcgtcgccgccttcctcgagcgacggcggagcgaggccgagtcggaggtggctcgtcagctcgccgagagcttcatgcgtgaggtgccgtgcgatgcctgcggcggcacccggttgcggccagaggcccggagcgtgaccgtcgatggggtgagcctcgacacgctcgtcaacgcctcgatccgccgtgcggtcgaggtggtggatgcgatgcgcttcggggagcgcgaggcgaccatcgccacccctgtgctgcgcgagattcgcgcacggctgcagttcctctgcgacgtggggctcgactacctgacgctcggtcgggcggcgagaacgctgtcgggcggggaggcccagcgcatccggcttgcctcgcagatcggctcgggcctcgccggggtgctctacgtgctcgacgagccgtcgatcgggctccaccagcgggacaatcgacgcttgatcgacacgctggtgcacctacgggatctcggcaacacggtgatcgtcgtcgagcacgacgaggagacgattcgcgccgcggactgggtggtcgatgtcggaccgggcgcgggcgagcacggcggcacgatcgtgcacgccggcacggtcgccgaactcgagacggtcgagtcctccctcaccggtgcctacctctcggggcgccgtgcgatcgacgtgccggtggctcggcgcatgcccgagcggggatggttgcgggtgctgggcgctcgcgagcacaacctggccgacatcgacgctgcgttcccgatcggccttttgacctgtgtgaccggggtatcggggtcgggcaagtcgacgttggtgaacgagatcttgttccgggcactcagggcgcagctgcaccgctcgcacgacgtccccggtcgccacaaggccatcgagggcatcgaactcgtcgacaaggtgatcgacatcgatcaggcaccgatcggccgcaccccgcgctcgaatcctgcgacctacaccggtctgttcgaccacgttcgccgtctcttcgccgagacacccgaagcgcgggctcgtggctatcgaccaggtcgcttctcgttcaacgtcaagggggggcgctgcgaggcgtgccaaggcgagggaacggttcgcatcgagatgaacttcctcgccgacgtgtacgtgacctgcgatgtctgtggcggctcgcgctacaaccgtgacaccctggagatccgctaccgtgggctcaccatcgccgacgtgctcgcgctctcggtcgaggaggcgttggcgttcttcgcgaagcagccggcgatcgcgcgccacctcacgacgctggccgaggtgggacttggttacgtccgtctcggtcaggcggccacgaccctttcgggcggcgaggcccagcgcgtcaagctcgcaaccgaactcgcgcggcgagcgaccgggcgaacggtctacatcctcgacgagccgacgacgggactgcacttcgaggacgtgcgcagcttgctcggggtgctgcactcgctggtggatcagggcaacacggtgatcgtgatcgagcacaacctcgacgtgatcaagacggccgactggatcatcgatctcggacccgaaggtggcagtggcggcggcaccgtcgtggcgcagggtacgccggaggacgtggcccaggtgcccagctcgcacacgggggccttcctcgctccgttgcttgggcgatgatggaccgtccggatctcgcagcgattcccgaggcgccaggcagctaccagttccgcgatggcgaggatcgggtcatctacgtcggcaaggcgcgcaacctgcgcgcgcgggtcggaagctacttccaagacccccgtcagctctcgccgaagacgcgggcgatgctcgcggtcgcgagccggctcacctggatcgtggtcccgagcgagcaggacgccctgctcctcgagtactcgctcatcaaggaacaccatccgcgctacaacatccgcctgcgagacgacaagtcctacccgatgatcgccgtgacggtcggggagcgctggccgcgcgcgatgatctatcgaggcaagcgtcgacgtggcgcccgctacttcggaccctacgccgacgccggggccgctcgcgaggtcctcgagctgttgcgtcgggcgttgccgctgcgcacgtgctcgccggccaagcttgcccagcacgaacgggccgggcgtccctgtctctacttcgacatcggacgctgcgtcgggccctgcatcggcgccgtggacgaggcaacgtaccgaggcctggtggacgaggtgacggggtttctcgagggccgagccggctcgctcgtcgacgccctcgagaccgagatgcacgccgccgcctcccgcctggagttcgaagaggccgcgaggctccgcgatcggctctcggcgatcgaagcggtgctcgagcgccagtcggtggcgctcgggcacgagcgagacctcgacgcgatcggggtgcatcgcgacgaactcgatctctacctcgaggtcgtgcgcgtacgccacgggcgcatcgtgggcgtgggtggcgcgcgggccgagcgagactcgggtgcgatgctcttcgacgaactcctcgacctggttcggagctactacgacgaccaggccatcgacgttcccccgaggatcgttgcgcgggtcgaggtcgccgaggcgagggaggcgacggacgccctgacctcgctccttggacgcccggtgcgcgtcgtgacgccgtaccgtcgtgagctcgccgtgctcgtcgagatcgccgagcgcaacgccgccctcgcgcaccagcgtgcccgcagagaacgcgccactgacctcgcgacgcgttcgaggggcttgaccgagctcggcgagctggcgggccttggggcgcctccggtccgcatcgagtgcttcgacatgagccacctgcaagggcgctcctacgtggggtcgatggtggtgatggaggacggcctcatgcgccacggggcctatcggcacttccgggtcagcgtgccgcacaacgacgacgtcggggccatgcgcgaggtgctctcgcgacgtctcgatcgtctcgatgaccggcgcttcggtgggcgccccgacctcatcgtgctcgatggcggggcaccgcagctcaacggcgtgctgcggctgctcgaggagcgcggcatggccggcacggtgcccgtggtcgcgctcgccaagtcgttcgaagagctctatgtccccgatcggagcgagccggtgcgcgtacctcgcgggacgctcgcgctctacctgctccaacagctccgggacgaggcccatcgcttcgcgatcacctatcaccgccggcgccgccagctcgatgccgagcgctccacgctcgagtccatcccgggactcggaccggcgagacgggcgcgcctgctcgccgagttcggatcgatctacgagatcgccgaggcaagtgaggcggagctcgtccgtgcgggtgtgccggctcgggtggcgagtgctgtccgcgagcgtctcgggccgctctatcgtcgagagcctgagagcgaccccgatgaggaggtcagatgaacctcgaggagttccgggccatgccggacgccgaggcgatggtgcgcgacctgtgggagacgcacgctcgctggtggcacgaccacttcaccgagggcgctgacgtcgagtacgtcgatcaggtgatccccgaggtgctggctcgggtcggtcaccctcgtcgcgtcgccgatatcggtggcggtgaggggcaggtcgcgagggcgatcgcgcgcgcgaccgcggccgaggtcgtggtcgtcgagccaagtggagcccaggcggccgcggcacgttcgcgcggatcgcaggtcgtccgtgggagcgccgaggccgttccgctcgcgtcgtccagcgtggacgtcgtcaccatcgtgctcgtgctcgagcacgtcctcgaccatgcggcggcgatgcgcgaggtcgctcggatactgcgaccgggaggtcggctcgtgttggcgctcaaccatccgatcatccaggtgcccgactctggactcgtcgaggacgtcgacgcgggcgagacctactggcgctttggtcactacctcgcgagcgacgcatcggtcgaggaggttgccgacggggtgtacatcccgttcgtccatcgtcccctcgaggcctacgtgcgggccgcgctcgatgcgggtctcgtgctgcgcgacttccgtgaaccggcgccgccggagcgatggctgcgcggccagagcggcggcggcttgctcgctgcgttgccgcgcctgctcatcaccgtgtgggagcgtgcgtgaacgcggtcgccttcgtcaccggcatgtccggagcgggccgctccacggtggccgaagcgctcgaggatgccggctggtacgtgatcgacaatgtgccgctctcgttggtgtcgaaggtggtggagctcgcgacccagggcggtgaggagcgcctcgcgctcgtcgtcgggcgcccgtacggggccgagttcgtgcggctcacggaactgctcgacgagctgcgcgctgccgacgtcgcggtgcgcgtgctgttcctcgacgccgaggacgacgtcttggtcgctcgcttcgaggcgaccaagcgccctcacccgcttggcggctccggcgggatcgccgccgccgtggagcaggagcggcgcctcctggagcccgctcgcgaactcgccgacaccatcgtcgacacctccgagctctccacgcacgagctgcgggcacgggtgctggccttcttcgagggccccggagagcggccgtcgctgcgggtcctcgtgtcctcgttcggtttcaagtacgggacgccccgtgacctcgacctcctcttcgacgtgcggttcctgcccaatccctactggcgccgcgagctgcgagcgctgagcggacgcgaccaggcggtgagggagttcgtcctcgagagcgccgatacgcgtggtttcctcgagcggctcgatgggctcctcgccttcgtcgtgccgcgctacgtggccgaggggcgggcctacctccacctcgggatcggatgcacaggcggtcgtcatcgctcagtcgtggtcgccgacgaggttgcgaccatgctgagcgctggggggctctcggtcgaggtccgtcatcgtgacatggagcggggctcgtgaacgcggtcgtcatcggcggtggccatggcatcggtgcgaccattcaggccatgcgggcgctcggcgcctcgatgagcgtggtggtcggggtagcggacgacggcggttcgacgggcctgctgcgcgctcgcgaaccggcgctccccgggatcggcgatgcgcgccacgcgctctcgagcttgatcggtccggacgagccgttcgcgcgcctcctggagcaccgtgttcgccacgcgtcgctccagccccatcccatcggcaatgcggccctggttgcgctctgggagcagacgggctcgctcgtggaggcactccgcgtgctcggggacctcgctggcgtgacggagcgactgctgcccgccgcagaggcgccgctcgtgctgcgagcgacgacggccgatggcgggaccatcactggtcagctggccatccaccttgcccggggcgttcgggaggtctcggtggatcccgcggacgcggtgtgtccgctcacggtggatgccatcgtgcgtgccgatgtcgtggtgctcggtccggggtcgctcttcacgtccgtcctcgcggccgcggtgtcgccggggatccgcgaggcgctctcgatcgcccgggcccgcgtcgtgttcgtcgccaatctcgcgcgccaggaggccgagacgatggagctcgatgccgacggtcacctcgagcgggtcctcgcacacggggtgcgcgtggatgccgtggtcgcggaccacggcttcacgccgagggctgcacgccatcgcgacgtgctcgtacgctcgtggcgtcttcgcggccaggagggcgcgcacgaccccacgcggctcgccgaagcgctcggggaagtgctcgacgcgctcggcgtccatcgatcgggggatcgcaaggggtagcgcgctgcgacgccacgtggtgtcaccaccgtgcttgactaaccttggggcggcgagtgggccactcggctgctcgagggaaaggagaggcgcatgcgggtcgcgatcaatggctttggtcgtatcgggcggatgttcctgcgcgcgatcgagcgaaccggttcggatctcgaggtggtggccatcaacgacctgacctcaccggccgtcaacgcgcagctgctgcggcgcgactcgacgcatgggccgttcccggcgcacgtggcgatcgagggcaacgatctcgtcgtcggagagcggcgaattcgtgtgctcgccgagcgtaaccctgctgacctgccgtggaaggagctcgaggtcgacatcgtcgtcgagtcgacgggcatcttcaccgacggcgacaaggctcgggcgcacctcgaggcgggcgctcgctccgtggtgatctcggcgcccgcgacgaacgtggacggtacgttcgtggtcggcgtgaacgacacgctctacgaccccgaacggcaccacatcatctcgaacgcgtcgtgcaccacgaactgtttcgtccccatggtcaaggtcatcaacgacgcgttcggtatcgagcgcggtctcatgacgaccgtgcacgcctacacgaacgaccagaacctgctcgatctgccgcacaaggacctgcggcgcgcacgggcggcggcgatcaacatcgtccccaccagcacgggcgcggctcgcgcgacgtcgctcgtcatccccgagatgcaggggcgtctcgacgggggcgcgatccgtgtgccggtcgtcgatgggtcgatcaccgacgtcaacgtggtggtgcgggccgaggtcggccgcgacgacgtgaacgaggcctttgcccgagcagctgcggcgggaccgctcgtcggcaagctcgtctactcggaggagccgctcgtctcgagcgacatcgtcgggtccccggcctcgtgcaccttcgatgctccgctgaccatgacgatgccgctcggcaacgggacgacgctcgtcaaggcgttcggctggtacgacaacgagaccggctactcgcaccggctcctcgacctcgtcgagatcgtcgccggtgggctcggagcgcgttgatggagctgccccgcatcgaggacctcggtgacctcaggggacgtcgggtcctcgttcgtgctgatctcaacgtcccgctcgccgtggaacgcggtgagtgggtggtggccgacgacttccggatccgcgcggcgttgccgacggtggagttcctgcgcactcgcggggccgacgtcacgctgtgctcgcacctcgggcggccgaagggtatcgatgctcgctactcgatggcgccggtcgccaaggttctcgagcagctcgcgcctggggtcgaggtactcgagaaccttcggttcgacccccgagagaccgcgaacgatccgagctttgcccaggagctcgcccacggccacgatgcgttcgtgctcgatgcctttggctctgcccaccgagcccacgcttcggtggtcggggtcccagcgctgctgccatcggcggcagggctgacgttgctggacgaagtagagcacctcagcgtgctcctcgaggacccgcctcggccctacgtcgcgatcgtcggtggcgcgaaggtctccgacaagctcggactgctcaccgcgcttgccgagcgtgtcgacgcggtgctcgtggggggtgcgatggccttcacgttcctcctcgctctcgggcacgaggtcggggactcgctggtcgaggaggaccatgtggaggcgtgtcgtgccctgatggaccgcgcgaccatccacctgcccgaagacctcgtcgtcctcgagagcaccgagccggtcggggccgaggtccacggccctgccggcagagtggtgggccgtgacgtgccgcgtggcacgcgcggcctcgacgtcggtcctcggacggtcgagcgcttcggcgaggtgatcctcggggcgcgctcgatcctctggaacggcccgatgggcctcttcgaggatccgcgcttcgccgtcggcactacgggtatcgcgcgagcggtcgctggttcgtcggcctacagcgtcgtgggtggcggcgactcggcgcgagcgctgcgcgaggctggcctcgccgaccaggtgagccacttgtccacgggcggtggggcgtcgctcgagttcctcgaacacggtgatctaccgggcctcgccgcactgcggcaagcggcggagcggcgtccatgagtcggcgggctcccgagcccgagccccaggcgggatccggacgggtgcgtctcgtcgtcgccaactggaagctgcaccacacgcacctcgaagccatcgcgttcttggagcggctgtggcacctgttggatgtcgaggactaccggcgcgcggagatcgcgatctgccctgcattcacggcgctgcggtcggcgcagctgacgatcgagaccgatggcatgccctatcggctcggtgcccaagacgtcttctgggaaccctcgggggcctacacgggggaggtgagcgtccccatgctcgccaagctggacgtcaagtacgtgatcgtggggcactctgagcgccggcgcttgttcggcgagaccgacgacgtggtcgccaagaaggcggcggcggtcgcgtccggtgggttggtaccgatcgtgtgcgtgggtgaggtcgccgaagagcgcgctgggggtaccacggaggccgtgctcgagcgccaactcgacacggtgctcacgacgtatccggtcgaggcgctcggagagctcgtgatcgcctacgaacccgtctgggcgatcggttcgggaacgcccgcgacgcccgaagacgccgagcacgtcgctcgcttcctccgggaccgcctcgcgcgccgggcgagcgaggcggtggctgctcgcgtccgcatcctctacggtggctccgtcgacgtgggcaatgcggtcgcgttcctcgcgcaggccgacatcgatggtctcctcgtcgggggtgcctcgctcgatccggagcgtttcgcgcagctgctcggcggccgaccccgcatcgcgtcgacgtcctagactgccattgttcgcagggaggaggactcatgttgaccgtcgtgctcgtcgtcgtgcaggtcgtcagcgcgatcgggatggtggtcttcgtcctgctgcactcgggcaagggtggtggattgtcggacctcatgggcggctcgagcttgagctcggccgcgagttcgtcggtggctgagcgcaatctcgaccacatcaccatcgtgctggcactggcgttcgccctgtcgagcatcgcgctcgggctccgcctgtagcgcgctcgggctccacggcgtgcgctggcgctgtcgtgcggctgtggcgggttctcgggtccctagggttgcgggtactgcggcgtgcgtctgctccggcggccagcgggtgcgggtcgagcagcacgggagcacggcgcgaaggtgtcctctccgccggcgggcatctctggggcgttctcgtccgaggtgcgcggcggggtggtggctctggcgggtgctgtcgcacgggtaccgacgccttcgggcgatgccacggccgaccgtcgtgggtgaggcgagatccgacgtcgcgcatgctcgtggcgaccccggtgagcagggtattgttggtgctttgcgactcaacctttggtgaaagtcgtcgatacgtccactatggaagcgttcgaggcatacctagctcggtgcccacgcgcactggtgctcctcgaggaggggctcgtgcgctgggtgaacgaggccgctgcccgattgcttcttcgtgacgcgtccgcgctgatcggtcagccattggacctggtcggaggggttcgcctcgaagagcttggcgatacgagtgtcgaggttgcgctgtgggcaggcgatggatcgctcctcgactgcatcgccgaggtcaccgtgctgggagaggcggtcatggtcgagctggacctggtcgagctgagtggtgtcgacgatgccggtcgagcactgcgggcgctcgccgatacgttgtcgctcggcgtgttcatctccgatcggggcctgcgactcgggtatgtgaatgcggggctcgcgacactgctcgccacgtcacgtgagcgactgagcggagctggctgggtggacatcttcgcaccggaggatcggcctgtcgttcgggagctggcgctgcgcgcactcggtggtgagcgcgtggaggcgatcatcgacgtgcagctcgagtccggtccacggcgtgcattggaggtcacgatcatgccggttcgtgcgagcgatggacgtttgagcttcgtcggcacggtcgctgaccggagtgtgcagcggcgagacgacgagcttgggagccggcccgcgacacgacaaggatgagcgtccatggagattcgcttcgatatcacctccggggatgcggtcgtcctcgctcgcttccttcggaccctcggcgatgacgaggccggcttcgccgagctcgctcaggtggcggctgcagaccccgggctcgctgcgagcatcctcaagctcgcgaactcgtcgtactatggactcgccggctccgtcgagcgactcgagttcgcgtgtgcgatcgtgggcatcctggggcttcgctcgctgaccgtggccgaactcgcgcggcgccaggggccctatcccgaggggcttgcggccttcacgacgttgctggccgcccagatggcggagcgctcgccccacacgagcgtcgacccgcaagtggcgctctcgaccgggctcgtggcgacgctcggttggatcctcgccgcgcagcaagatcccgtcggctatgcgacgtggcacgacctcgcgctcgaggatcgtcgagccttcgaggtggagcgttggggacgaccacttgcgagtctctcccaagaggcgcttcggcactgggcgtttcccgaagtgatcctcgatgccgtcggcgaactcgacgcggccggcgacgtgtcgaccctcgggcgtctccttcgagagagctggcgcgcggcgagcgagcgtctcgggcccgatggggccatgttgatgagcgtgtgagtccaaccaggcacgcggtcgccggaggcggcgtgcctagctcgggagtaccgtcaccagcgtgccgatgtggacctgcggatagagcacccccgcggtcgcgatgggcagctcgacgcagccgaggctctggggaaagccgtacgaggcacgggggaacccgtgcacggcgacggagccgttgaagtagttgatccagtgcacaaggtcgtggtagggggtgccgttcgggttcgtgccgctcatgtagttctcgacgaagcggaggtagatcggccaggtgccgacgggggtgttgagcccagcgatgccggtattgaccggactcgtcagcgtcacctgcccgttcacgtacagccagagcgtctccggtcgaaccttggacacgaggatgtaggagtagggatgcggatccatcgtccccgtcatcgcgtcgtgaatcagggtgggccagaggagcggattggagagcccggtatcgtcgaggccctcggcgtgctcgaacgacatgatcgcaccttgggtcatcaccgtgtcctggccgggctgccacaggctcgtgagcgcactcggcatcgtccagcgccatgagaacgtgccttgtggcgcgtccacgctcgcggcggcctgcgccgccagcgtcgatggggccgcctgggtcggcgtgaaggtcaaggggaggtagccgagctgagcgagcagctcctggaggcgcaggatcgacggggacgctccagcgagggtcacggcgtcggtggtctggccgagcgtaccgctcgagctcgccaacgtgacggcgtgagggaggtgcagtgtgaacgtctcaccgggccagaaatcgggcgtctggggggtgaagacgagggtgtagggggtcggtcgactccaggatcccgagaccgggtcggcgccggcgacagttggcgtgatggtggggttggtcgcgccgaagaccgtcgaggtcggggcggacagcgtgatcgagatcggcgtcgacggcgtgagaccggaggttcccggggagataatcgcgatcggagacgccgacccggtgcggaagaacgtcagctcgctcggtgcggcgagtgactcccacggggctggggcggccgcgatcgtgacgacgccagcgtgcaggccgctcgccgacgacacgacggtcaggcgccgcgatggctttgcgaggtggatgacctgcgaactcgtcggcgtcgtgatgcgcacggtactaacgggcgtcgagaagtagccagcgatcgacccatgggtcgagatcaccacgggatcgaggaggcgcgtcgtcggcgcgatgatcgtctgggtgacgttggtgcgggacccgaggagccaacgcagccagctcggcggtgcgagcgtcgcacgcacggtgatggtggtgccctgcgcgatggcgacacgggggacgatgcggccccggcgatcgacgacggagatggccttgccattcgcctcggccgagatcgccacgatgcgctcggcgatgccttgatgttccaggcgtacgatcccacgctcgctcgcactgagggacgttcgtggcagttcgagatacgcgatgccagcggcggccgcggcaacaacgacgccggccccgaccacgatgcgggtgttgcgccttcggacacgtctcgaacgatgcacgcccctcggtacctcctcgtcccctcgcgcagtcaacggcgcgggtggagtgtcgttgctagtgtaacgacactcggtggcgatttcctgagagacagggcggctgggaggggatgtggtcacgaagttcttcgtcgaggctctggtgacgttgctcgtgatcatcgatcccatcggcaacatcccgaccttcctggtcgtcacccgtggtcgggaccagcgtgcgcgccggcgcctcgccacggaggcggtgctcgtcgcggcggcggtgctcgcggtcttcgcgctcgccggttcccagatcctcgactatctcgggatctcgattcccgctcttgaggtgtcgggaggcctgttgctgctgatcgtggcgctcgagctgctgaccggtcggggtgggtcgatcggtaccacggaggagggtatctcggtggccgtggttccccttgcaaccccgctcatcgcgggtccgggcgccattgctgcggtgttggtgctggccaagcgagctgcgacagcgccactttcggtggcgctcgctggggcgttggtcggttcgatggtcatcttgtgggtcgtcttgcactacgcctcggccttggtccgcatcctgaaggagtcgggcatcgcgctcttgtcgcgggtgttcggcttgctcctggccgccatcgcggtccagctcgccgccgagggaatccgcggcttcgggctctagctggtccacggcggcctcgcgcggagccctcggtctggggggtcgggcaagaggacgtcgaacgagtctcgctggcgctgtggagtcgcctgtgatcgggatcgaggacgtgccccgatcggcccgaccgcgaccttggtgcgcggtgacgtacatccatggcgcagcccatcgaggcgagcgcacgagcgtgggctgggcgcagcgtgccacgttctcacgggaccgcgacgctgatcgcgtcctgcccacccgttcggcgagcacgcttgccgggaggtcgtcgaactctgcgcgcagggcccttatccgggtctcgtcgctcgcgaaggatctgtcggtcggggttcgccgagagctcggcggctcgctccgagcggccagcttgatgatccttgtgcgcgagatccccagacgcgcggcgatgcgagccttggggacgccctcggctaccagccgcctgacgagtgctcagtcttccacggtgatcacccttccctgttcgggtgttcactgttcaccggcgaagtcgttcagtccttgaacggctcgacagtcgcggccgggggccacccgtgtggggccgtgacgatgaccccacggcgtcgtgggagcgaggctctcgcgacgatctgtgcccgagcctggtgtctcggtgcgctggtcgagccgcgcgcctgtgtgctggtgaggtggccgggtgctcgcgcacgacgatgctcgcgcgccgcagcgagccatgaggtcggggcgccagctcctgggccgtcgagagcacgccgcacgcgccccaggcagcagcgtccctggcgtcgctcacgatcgcgcgtgcatgcgcctcgatgcggtcgcgcacgcgtcatctcagcgaggatggcgcgagccgcgatctgcgctcagaaggcctcatgagctccggtcggcgggtgggagcccgtgcggcgcgatctggtcgtgcgacgatgtcgaggctccgtgggaggctgcctcgcaggcgtggcattcgaactcgagcgtcgcgtgggtgatcccgtgcgcacgcgcgagccgttcgcggatcatgtcggcgagcagctgcgtctggtggagactgagacccgagcgtgcaacgatgtgggccgagagcgcattcgtctgttcgtcgaggcgccacaggtggaggtggtgcgccgcgatgacacccggcgtcgcctcgatcgtggctcgaactgcgctcggcgcgacaccacgtggtgcgagatccagcgagagtgcgacggcatcgcggatcatgcgccatgacgtggcggcgatcgtcgcggcgatgatggtggcagccgccgtttgggcgtcgtgaccgaggcgcgtctgtgtgagggacgctgcaaccagtgttgcgactccagccgcgaggtcggcaaggccatggaggccgagcgctcgcgcggttccggatgtgcggtggagccatgcctgcacgatcagcggagccgcgggcgcgagtgagagaacgcctgcgacgacgaggaccgagacggtgctcggcgtcgcggcgcgagcctgaacgacgacgccccacacgctcgcgagcgtgagggcaagggcaagggtcgcgcccacgaacgcgtccacgcgatgccagccgaaggtattgcgctcgtcgggcccgtgctcggcgaatcgtcgcgctgcgaccccgagggcgagcgtgccgaggtccatcgccacgtgcaccgcgtcttcaccgacgagcgcactgtgggctccgatcgcgagcaccacgagcgcgacggccgcgacgacggcgagcatgacgctcccgatggcactcgcgtggcgatgcatggctcttctagtctaggtcgtcgccgtgggcgacctcggggaatgatcggccgcgaccatcccgcggcgcgtgtggccccgccttcaggtgggagtggagtcacggtcgcgaggtggttgctcccgcgcacgagcgcgtgaatctggtccgtacgcagcgggctaggatcgtcgttggtagatgtccgggtgagccgacgaaaccctaggaggatcgcagtgacagcagatgctcagacgctgggcgtgatcaagcttggtgatattgcgcccgactttgaggccgagacgacgaagggcaagattcgcttccacgagtggctcggcgatgcctggggcatcttgttctcgcacccgcgcgactttacgccggtctgcacgacggagctcggtgaggtggctcgcctgcgctcggagttcgagtcgcgtggtgttcgtgtcatcgggctgtcggtcgacgacgtcgagtcccaccacacgtgggaggccgacatcgccgacatcgccggcgcggagatgtggttcccgatgatcgcggatccagaccggacggtgtcgtcgctctatgggatggtgcaccccaacgagctcgactcggcgacggtgcgctcggtgttcatcatcgaccccgccaagcgcgtacgcctcatgatcacctatcccgcctcggtgggtcggaacttcgccgagatcgtgcgggtgatcgatgctctccagcggacgtcgcgctacccagtggtgaccccagccaactggacgccaggccaacgtgtcatcctcgcgacctcggtgccgaccgatcaggcgcgtgcggcggtgggccacgacgccgaggagattcggccgtacctgcgtctcgtcgccgacccaggcaccaactagtcgacgacgctcgagcctctctccgtcgagtcgtgccgcggggccgtcccgcggcacgacggtattcggggcccctgcgaggtcctggaggcgtgggcgctgtcgtggcgctggccgagtcgttcaccagtcggttccagcgcgccgggttgcccaagcccagggctcggcacgtgctagcgtcgagcgcggagaggaggggcagtgcgtatcgcggcccaagtcgactacgccggggacgtgcgccaggcggccgacacggtcgctcgctgggaggatgcgggcgtcgacgtcgccttcgtgccagaggcctacggtcaagatgcgatcagccttctcggttacctggcggctcgtaccgagcacatgttgctcgggcccggcattcttccgatcttctcgcgaacgccagcgctgattgcacagactgcggtcggtctcgacgtggtctcggggggccgtgcggtgctcgggctcggtgcatcgggtccgcaggtcgtggaggggtggcacggggtcgcctacgatcgcccgttggctcgcacgcgagaggtcgtcgagatttgccgtacgatctggcgccgcgagcctctcgttcaccacggcatctacgaacttcccgcgaccgggcccggcacgacggggctcggcaagccgctcaagctcatcacccacccgccgcgcgagcggatcccgatctacctggccgccatcggggcgcgcaacgtcgcgctcgcggcggagatcgccgaaggttggcttcccatcctgttctcaccggagcgtgcggatgcggtgtggggcgagtctctcgaagccgggcgtgcggcgcgcgatgcctcgctcgggccgctcgacatcgtcgccggggggatcgtctcgatcggtccggatcgcgaggcgctccgtgatctcgctcggccgttcgtcgcgctctacgtggggggtatgggcgctcgcgggcgcaacttctaccacgacgtgctcgtacgttacggattcgaggaggctgcggacgcgatccaagagcgctacctggcccacgatcggcacggcgccgaggcggcggtgcccgaggcgttgctccgcgaactcacgctcgtcggtacggaggcagaagttgcggcgagactcgatgcctgggcccgagctggggtgacgacgctgctcgcgacgccggtcggtccggacccgctcgggacgctgaagcgtctcgcagcgctcgcgcggtagcggtgacgagtcgatcggtgctcgagcgctctctgggtgtgctcggcgtcgtggcaggtgcgtgtggtcttgctcgacttggcgatccgttgcccgtggcacgcgagacccctcgcggccatgtggtggtggccatccctgctcacaacgaggcacgacacatcgatgtcgtgctcgcctcgatccgacgacagcgctgcgagcacctcgatgtgcgcctggtcgtggtcgacgacgcgagcgacgacgagacggcggagcgcgcgcggcgcgccggtgcacacgtcatctccgcgggtcccgtcgccgacggcgtcaatccgaaggcagccgccctcgcacacgtcgacctcggtgatgccgactgggtgctgtttgtcgacgcggacgtcgagttcgttgcggacgacggcctggcgcgcttgatcgcgatggtggagaccaacgatggggggctcgtgtcggtccagccgcgcccacgcctcgacggctggtgggcaccactgacggcctggctgtggctggtgccgatggttgcgagtggggccttctggccgggtgcgcgccatcggtcgcgggtggccttcggcccggtgctcgcgatgcggacgtcgacctgtcggagcatcggtggtcacgcggcacttgcgagtgaggcggtcgacgacgtcgcgatggcggcggcggtacgtcgtcgtggcgagcgcgtcgtggtctgggctgggggcgatgccgtgcagatggacccgtacgagggcctcgccgagacggtggctggtctgcgcaagaacatcgtcatcggcgccggtgcggccggtgcgctcccatccttcggtgcggtcgcttgggtggtcggcacgatcggggcactcgctcgactgcgccgcggtgactggagggctctcccgacggcgctcggaggtcttggtgtcgcggtcctcggagcgcgtcggcttcgacttgctcgttggaggcacgtgtgcctggtcaccgcgggcctgggcctcctcgtcgcgacgaccgcgctgtcggtcgtcgacatgctccgggggcagacacggtggcacgggcgacggctacggcttcgctagcgattcgcgtcgctctcgccatcggctggtgggtgggcctcagcgtcgtggtcggctgggtcgcgtcgcgcctccggccccgaggcctcgcgttggtcggcaccttcttggcgactcgttcgttcgagggcgacggccatggctacgaacggctcggggtgcgtcgctggaagcgcctcttgcccgatgccggcggagccttcggaggccgccgcaagcgtctcttcgggccccgtgggaccggtgggcgcgaggcgctcgcgcgcgaggtcgaccgcgccgaggcggtgcactggtgcctgctcgtcgtgcaatgggctccggcgctctggttgggtccgctgtggtggctcggccctgcgtatgcgatcggtgcgaatgtgccgttcatcttggtcctccgctacgtgcgggcacgattgaccgcgctcgggcgcagacggccctgagtcggcgctgcagttccatgcgatcgtgcgagcgaccgtggcttcgcgtcgtcgagcagggctcgcgcgtgccctggccgccgcgtactgcgtccgccggcgagcgagggaggcggctccggcgcgctgatcgtggccgggctcctctgtgcgcgaggagtcgaacgtcctccgaccgactccggcgccggtgcacgtctcgatcaactctcggaggaggcgaaggtgacgactccgggaacgtcgagctcgccgtgtctctctacgacgattgaccgtctctgtgcagacggggctcggcggcttgctcattcctcgccgtctagcgggtagcaacccggagaagtgttggccaaccaccgggtgcgtccggtaggtgagcggtccccacagccagacgccccggtgcgagcccgggatccccacgccaactctcgctggtgccgctgagcgccgatcaggtcatgggtgcgcagtgacaccagtcactgcgacggcgaggacggaatcgagaggagggcctggttggcgggtccagatccttgcttgccggtgtcgcagacggcttggccgttggcggtgcggtgacacgcgccgccagggagcttggtctggatgacggcccggggtgacgggagcagcctcggaggcgtcggtctcggccggaacgtcccatgcgtgcacgagagagtcgaagtccccggccccgaggcgaggcggtgtcactcgcctcgtgcgtcgacctgtccgccttcgcgagggcgcagcatagagctgcggtagtagcgcagctcggcgatcgagtcccgtacgtcgtcgagcgcgcgatgcgcggggttcttctgcggcatgtgctcgatgacctcggggtaccagcggcgcgcgagctccttgaggctggagacgtcgatcgatcggtagtggagcagggcctcgaccttgggcatgtggcgcgcgagaaaccgacgatcggtgccgatggagttgccgcacaggggcacctggtggggatcgggaagatgggccttcaagaaggcgaggacggtcgattcggcctcgtcgatggtgagcgacgctcgccggacgtcttcgaggaggtggttggcagagtgcatctgcacgacgacgggctccatcaccgccagctcctcgtcggttgcgtggaggacgagcgggccgagctcggcaacggtttcgagttcgtcgtcggtcacgatggcggcgatctcgagaatgacgcaccgctcagggtcgagacctgtcatctcgaggtccatccatgcgagcacgcgcccaggctagccaacgaccaggctaccctggcccgtgggtcaaaggaggacgcgtggaggaggtgccgtcgtcacgaccatgggtcgtgatcccgacgtacaacgaagtcgacaacatcgggcccatgctcggagcggtgctcgcggcggtacccgaggcgcacgtgctggtggtcgatgatggctctcccgatggcaccgcggcggcggtgcgcgccgtctcggagcgggacgagcgcgttcgtttgctggcacgggaacagaagacgggactcggcggcgcctatcgagacggcttcaaggtggcgatctcggagggagcgaccagcgtggtcgagatcgacgccgacttttcgcacgatcccgcggcgattcctgcgctcctcgcggcgctcgacgacggtgccgcgctcgcgattgggtcgcgctacgtgcttgggggtcgctcgccaggattgtcgagagagcgtcttgcactgtcgcgcgggggcaatctctacgcggcgttcatgctcggcctaccggtgcgtgacgcaacggcagggtttcgcgcgtatcggacggacgtcattcacgaggtcggctttcgttcctcgcgtgccgatggctacggcttccaggtggaactcacgcgcctcgtcaacgacgcaggctatcggatcgtggagattccgatcacgtttcgtgatcggcgagcgggcacatcgaagatgtcggccaagatcgtggtcgaggccatggtgctgtgcacgatttggggtatcggacgtcggttcccgtggctcaacgagcaacggcaggaggcgctcatcgaccgcctcggcgccgtcgtcgatcggggagcgcgcctgtggtcgacgaggcgttgagtctgcgggtcaagcggctcagtcccggcgcagtgctgccgtcgtatgcacgggcgctcgacgcggggctcgatctcgccagcatcgaagagaggacactggcgccgggggagcggcacgggtttcgaaccggtctcgcgctcgagcttccggtcgggacgctgggactcgtcttgccccggagtgggagggcgcttcgagagggcctcacggtggtgaatgcgccgggcctgatcgacgcaggctatcgaggcgaagtactcgtggcgctggtgaaccttggcgaggctccagtcgtgattcggccgggcgagcgcatcgcgcagctcgtggtgctgccgttcccgagcgtacgggtgctggaggtcactgaacttgcggcgagcgaacgcggatccggaggctttggccacagcggctgagctcacgtgtgaagcaggctgccgacgcagctgttcgatcggccgggggcctcgctcgctatactgaggggcgctgcggacgtggctcagttggtagagcatcaccttgccaaggtgagggtcgcgggttcgagtcccgtcgtccgctctcagacgacctgcagcgatgcgggtcgtcgttcgttgtgggctgggcctgctcgtgagcaggcgtcgtgtgacgcgcggggatgccttacgccggcccgtgatccacggaagccggccgctgtgtcgttcgaccgctgtcgccgtgatgtggactgttctgcggacaccgcacgcactccttgcgccggagggcgtggccgtgacggtcgcgtaccgcgatggagcggccgtggctcggcgctcgctcggcgcgtcgtggcaggccattcaccgcccgaaccagcctggcgagtgtaacgggcgtgttacgttcgtcgggtggccttcggcgacgctgtggatcgtcgctagggtcttctcgggagggtgagggtggatgcatgtagatgatgcgcaggccgcgacggccacggttgatgatgagtatcgggcgtttcgggtcgagtcacgaggtatcgagctcatcccggagacggagcgacccatgcggccggcagacctgttctggatgtgggctggcggcatctggaacgtcgaatacctcgtctacggcgcgctcatcgtttctttcggtctgtcgttcgctcaagcagtgctggcgatcatcgtcggcaatgtgttcttcgcgttccttggtctcgcgtcgttgcaggggccgctcgcgggcacgactgcgttcggtgtgagccgggcgccctttggtcggctcggcaaccggcttccatcgctgttcaattggatcacccaggtcgggttcgagatcgaagggcttgtgctcatcgtgctcgtcgtcgaggcgatgttcgcccacgaaggcgtgtcggtcggcaccggcctcaaggttgcgctgatcgtggcggctgtgctcgtccagttcatcgtgccgttcctcggtcacgcgacgatcgccaagctgctcaggtacctctcgatcgtcttcatcatcgtgtttgcggtgatgggcgtgctgattgcgccgcacgtccatccctcgagcgaccacaagcatgcctcgtgggccatctggacgaccgccgtcgtgctgttggtctcggctggggggctcgggtggaccgagaacgccaacgactactcccgctatctcccctcatccaccccgaaggcctcgatcttctgggcggcgacccttggcggtgcgatcccagcgatcttggtcgagctcctcggtgctgccgcgttcttggtgagtccgcaggcgacggcggtcaccggcgtcccctcgtcgtttgcgagctggttcttctggccgttcatgatcctcgtgcttccgcaggtcttcgcgatcaactcgctggacctctactcgtcgggtgtcacgctgcaggcgcttggcatcccggtgaaccgctggggtgcggtgatcatcgacaccatcatctccgggctggtcacggcgctcgtcatcttcaagggaaacttctataccgatctgtcggggttcctcgactacatcgtcgtctggctcgcgccgtggttcgccatcgtcttcgtcgactatctgctgcggcgcgggcgctacgaccgtgcgggtcttgccgccgtacgcggtggtgtctattggcgcaatggcggcatcaactggcgtgcgatcgctgcgctcatcgtcggcatgggtgcggcgctcctgtggatcgatgcccagttctacgtcccctcgttcctcggaccgatctcgcgtgcgaccggcgggtctgacctcagctgggtgctcgggatcgtggtgggcggtctcgtgtactacgcgcttgcgcgaggtgaggtgcgccgggaggtcgaagcaaccgagcgaggggtggccggcgcagaggcggtggagtaggacgcgacgcggttcggcggggtcggtgctcgggcgatcgagggtcgaggaaggtcgctgacgcatgtcgccggagactcgctaaggtcctgttcgtcgagggaccagacggatcgcaggaggagttgacggtgggactgaccgctcgcgttggacgcttgctcggacgagtcgcgctggcgcccatcttcatcgtcgctggcttcgaggccctgcgagaccctgggcatcgtccggaggtcgccgcgaaggcgggcctcccgagcccggagctgctggtgcgcctcaacggggctgcgatggtcgcaggcggtcttggtctcgcgaccgggctacggcggcgtctcgcagcccttgggctcatcgcatcgctgggagcgacgacggtcgtcggtcatccgttctggcgcgaggagcccgggccaggccggacgatgcagcgagtgcagtttctgaagaacctcggacttctgggcgggctggccctcgtggtgtgcgatcctggtcgcgaccgcgacgcgtgacgtgtcgttgatggggagccacgtgggtgctccgcgacgttcgctggctgccacgatcgcgacgagttgtgacgctgcgttcacaggatgggactcggccggccttggtgtcggctctacgctggcggtgtgaaggagtggtcaggccgagcgcgtcgccagcaggctcgacgtgctggcgcatcacccgttggcggggcggggatggttggcttaccggcgcgtgccgtcgtctcagcggtggcggcggtgagctggatgatcgtcggggtcgtcatcgtggccgccgttcacgcgagctggcatgtcgaagccggactgttcgcgttcggcgtcggcgtcgtctgggcacggggggcgctcagagccgtcaacgcgcgttgagggcggaggtggcgtgaaccacgccgagggatcggtggtcgatcacttccagctggtggcactgctgggggtcggaggtttcgcggaggtgtggcgagcacacgatctcacgaccggtggcgaggtcgtcctgaagttccccactccacagctggttgccgaccccgtcctcttccagcgctaccagcgggagatcgccatctggcggaagctcgaccacccgggggtcgtgcggtgcgtcgacgatggccaacggcggagcgagccgtatctcgtgctcgagttcgtcgacggggtcacgctgcgacggtggctgaacgatcatccagggccggttccggtgaccctcgtcgtggcctgggctcgtcagctcgccgaagccctcgactacctgcacgggcgtggcgtcgtgcatcgcgacctcaagcctgagaacatcttggtgtcgtcgtccggggtgctcaagatcggcgatttcggaactgcggtcagtcgaggggcgcggaggctgacctgggggcagttgtctccggccatggggacacccgactatatgagccctgagcaggtgcggggacggcgcggcgatgagcgcagcgatctctatgcgtggggtgcgatcgtctacgagcttgcgaccggtcgacctccctttcgtggtgattcgtggctggcggtgatgactgcgcacctgcagcaggcgcccgaaccattgcgccaacggcggccggaactgccgccgggcctcgaggccatcgtcctccatgcgctgcggcggttccccgagcaccgttaccagcatgcacgtgaggtgctggaggatctcgaacgcatcgatgagcttggcagcgatacgtactcgttggcgccggagcagccgatcggtgacgtcgtggccgcgaccacgagcgggcgtcggctggtgtggttcgtggtcggggtcgccgtgggctttctcgcgctcgccgcggcggtgctcgtcgtggcggcgcaccactagggcgagccggttgaaggagggagcagggtgacgggacagcgaacgtggatgcgggcgtgtttcgtggatctctttggcgagctgcgctcggtgacggtgtcgggggtggaggtgacgagccacctggtggtcgatgcgtcggccatcgagggcgggatccgcgtcctcgagtctgactgctcactggatctcaccgccgcggctcgcctcgtaggtccggagggggagcgtctcgtcggcatcgtgcgctcaccggacggggtgccgtcgccgttggatacgcgcgccgcactcgcgcgcatcagtgcggagctcgatcccgagacgcgttggcgcgggatcgcggagctcgagtggtactgcttcgacgagcacggcgatccggtggacgaggcgggctacttcgacgatgtggtgggcatcggtggcgcgatcgcgcgagccgcctacgccaggttgtccgacagtggcataccggtgctagcgtcgcaccacgaggctgggcccggtcagtgggagctcgatctcggcccgctcgatgcgtgtgcactcgccgatgccgtggtgctcgcacgagctgcagtgcgtgacgctgccgtggagttcggggccacggcgtcgttcgcggcccgtccgctgccgggacaaccgggttcggggctccacctccatgaggtgctcgcgcccgaggtgaccgagtcgctgatccgcgcccgtgttgggggcctgctggatcatgcccctggcctgtgcgcgctcgccgctccgacggtcgggtcctatcggcgtctccacgccggcccggaggcaccgagcgcggcgctgtgggcgcacgagcatcgcggtgcgctggtgcgggtcgcgacggcggtcgacgggacccgatccatcgagtaccgcggtgcggacccgtcggcgaacccgtgcatcgcgatcgcagggatcatcgtcgcggcggcccatggcgcccaggagggtagcgaccctggcgaggcgatggacgaagatccggagggcttcgatcccctggcccgaacggcagccttcacgccgctcccgaggagtctcgatgaggccgtcgacgcgctcctggccgatgacgtgctcgtggacgcgttcgacgaccggctcattcatcgcatcgtcgatgccgagcgggcgcttgcccgccgcgcactcgcgggaggtcgtgatccagacgtgcgcccgggatcgatgtcgacgcgtgtgatcgatcggtaacgagctggtaacgctacctcgatgggtggcgtgtgggcgggtctacgatgcgcctagctccgctgcgatcggccgaccaggggagcgaggccagacgccgcaacggcgcggcctggcggtcgtccgaagggtgtcaccggaggtggcgtcctgatcgcgtaccgacaggtgaggagttgtgccatggcagcgagcgagcagcagatgcaccgaacgctcacgctcaccggtgtcacggtcaatgggatggccttgatcgcgcccggagcgtttctttggacaacgtttcaggaacaggcggcccagacgaaccacggtcagccgacgggccttgacatgtggacagggctcctcttcgccttcatcctcgccatgctgaccgcgtggagctacagccagctggctcggatctatcccgatgcgggcacgggctcgacctactacttcgccgaagccgccttcctcgaccagaaccacccgcgcttcaccgccaccgcgagagcggtgaagttcgccttcggctggatcagccacctgtactactggatctatccgggcatcatggtggcgttcatcggtaccctgatcggctacatcatcggcgcggtcggaggggtcacgctgtcgtggctcgaactctcggtgatcgccgtcgtcgccgccgcggggatcggctacatcgcctaccgtggcatcacggggtccacgatgacggcgctcgtcatcaacgtgatccagatcgtgaccctcgtcgcgatgacggctctcttcttcatcgcgttccgcgtcgcgcacccggacggtggctacgtgcaagcgagcgcactctcggtcatcctcccacacagcttcgtgaacctgctctaccagtcgaccatcgccatcttgttgctcgtcggcttcgagtccatcacggccctcggcgccgaggcgcgcaatcccgagcgcgacatccagcgtggggtcttgatcgcgctcgccatccagggaggcttctcgtacctgttggagtacttcggtgcgaacttcgcactcggctctgcgaccatggcaggtcaaccgggcgcaaacgtctttgccaaggccggcaacgatgcggcgccgatcggcacgatggtccagaacgctgccgatcgcatgttccatggcggcggagaggcggctgcgttgatcgtggccgccacggtcctcatcgcactcatcggcacgacgctcgcgtgcatcaacaccgcagttcgcgtgagctactcgatggccagggaccgtgagctgcccagcgtgatcgggtggttgcacgggcgcttcgccacaccccacggcggcatcctcgtgatcagcgcgatcagcgccgtggtggcgatctacggggtgcacacggtcgacaacctgacgcagatcacgctggcgtccaacatcgggacctttctggtctatggcatgacgtgtgtgatcgcgatcgtggcgttctcccgtcgcgccgatcgttccctgctcgctcatgtgctcgcccctggccttggggcgctcatgaatctggccgagctcgctggcgtggtctatctcgccatcgctggcggcggctcgggtgcgaccgatgcggtgaaggccatcggtgtggtgctggcctggaccatcgttgggctcgtgtggtactgggcgaacccgcaccgccatcatgccaagagcatcgtcggcgagcgcgccacgaggcgactcggcggggccgggcgcggcgtgtcggccgcggcggagacgccatagcgttcggtgctccggggggagctgccagctggtgatgcctctggcccgcaagggctggaggcatcacccatgaggaggagacgatggtacgacgctcgctcgaggccgacgagacgagtgggtcgcttcgggcccacgacggctcggtggcggcctgggtgagcgtgcggggtgtggtgcgggctgggaacgaggacgcggttgcggtcgtcccccctggcacctctggcgaggtgctggtggcgtgcgtggccgatggtgtcggcgggcaggcggctggcgaggtcgccagccaggcggccatcgaggcggccacgagcgcgatggggagcgggcgaggggcggtgcgggctcgggtgcgagctgcggttcgggctgcgaacgcggcagtcatcgacgcgcaacatcgcgagcgggctcggatggcaaccacgctcaccctggtcggggtgagtggccgcgacgtcgtcattggccacgtcggcgactcgcgtgcctatcgtgtcggcgacgagcggatccatcagctgacgcaggaccatacccaggcggccgagctgttgcgggcgggcttgatcgatcaggaggaggcagctcggcatccagcgcgctcggtgctgacgcgaagcctgggagcacagatggcggtggcgccggatctcgtcagcgtggcgctggaggatggggagcggatcctcgtctgttcggacggcttctgggggacggttccgcgcggcgcgctcttcgaggcgctgcgcggcgcgcgagagcccgacgcgctcgagggtgcgctctggcgactcgtcgggcttgcctacgaggcgggtgcgcccgacaacgtctccgtcatcgtggtgatcccgagtccgacggccacgagttcgggcgcgagcgtgcgcacctcgtggtggcggaggagccgaggaacctaggcaaggccgacgatacgcgccgccgcgtctcgtgcacgctgagcatcgctcgcggtgcggaccgcttctgctgctcggcgagcggtcgtacgctcgacggaagcgagcagacgggtgacgggtgcgatcgcgctcggcgtcatggacaagctcgtgatgccgaggcccgccagccagacggcggcgaggggatctgcggcgagctcgccgcagacaccgatggggatgcgaccgtcgacgtcgtcgacgaggcgagcgaggagtcgagcgagtggcggcgagaagggatcggcgagggctgcgaccgccgactcctcgcggtcggcggcgaagaggtactgcgcgaggtcgttggtgccgatcgagacgaagtcgacgctgcgggcgagctcgtcgccgagcaggcacagagcagggacctccaccatgacgcctgcactcgggatccctgcggcgtgggctcgctcgaccacctcgcgcgcttcgtcgatcgtcgtcaccatcggggccatgagaccgacctcggcaccggtcgcgcgctgggcgtcggcgatcgctgcgatctgggtgtcgatcacggccggcgccacggcgcgtgccctccatcctcggacgccgagcgcggggttggccgagcgaggcagatcgatgaacgcgagtggcttgtcggcaccggcgtcgagcgtgcggacgatgcaacggcggccccggaatggggtgaggatctcggtgtaggcctcggcttgctcggcgcgagagggagcctcgtcgcggtcgaggaacaagaactcggtgcgcaaaaggccgataccgaccgcgccggcgtcgatcgccccctgcgcgtcggcgacgccggcgacgttggccatgatggcgacggcgccgatggcggcacggtctcgagggagcgtcgttcgcgcgggcgtacgctctgcggctcgcagcccagtgacatcgtcgtcgttggggttcacgatcgcgaccgcgcgcacggtatcgacgagcacggtgtcgccgtcgtgcaccccgtcgaggcccaccacgccggtgagggcggggatgccgagtgctcgggcgaggatggcgacgtgggcggtcgggctggcgccagcgagcaagagcgctgccggccgttcgtgctcgatcgcgaggagatctgctgggccgagctcgttcgcgacgacgaccttgccttcgagcatcggtccttgggtgcccctgaggcgggcgatgaggcgccgttcgatcgcgccgaggtccgccgctcgttcggcgatcgcgccgccgacggaacggaggacgcctgcgacctcgtcgaaggcgtcgtggaccccgacggtggagggatcgtcggcgaggtgacgctccacggcatcgacgagcatggggtctcgcgcgatggctgcgtcggcggcgaggatctgggacagctcgccgctcgcacgtcggctggaagcctcgaggtcgtcggcgacctcctcgagcgctcggcgcacgctggcgggatcgacctcggtgcgctcggcgaccgcgtcgacgcggacggctgtcccgacgccggctccctgggagcctggttgaccgcgaagggtgtgacgttccggcatggaccctcctctccgggcgaggcgcctcgggaccaaagacccttgacgtcgtccacgacgcctgtcatgatacgagcgggcagagtgcacgagagcgcccggacgtgagaggtcgcgtccgggcgctcttcgtgttctggcccgggagcgatgcatgacagggggaaggaggccgtaggtggccacaacacaggcgcgaccggccggcaagaccggctggcgcgcaacgacatggggagagctgctctccgaatatctcggtacgttggtgctgctcgccttcgggacgggctcggtcgcggttgcagtggtgggcctcaccatgtccggccgcaccgtcgtcatcttccagggagcgggcggctggctgctgatcacctggggctgggccatggcggtcgtgatgggcgtctacgtggctggcggggtgtccggcgcacacctgaacccggcggtgacgctggccatggcgatcaagggctcgctgccgtggcgtaaggtgccgggctactggatcgcccaggttctcggggcattctctggcgcggcgatcgtctacctggactactacaaggcgatcgatgcgtggaaccttgcgcaccacgtcacgcgcgccagcgccggtgggttgacgaccttctcgatctttgccacgttccccgcgaagtacttcggcacgagcctcgtcgggccattcatcgaccaggtgatcggcacgttcttcctgctgctgttcgtgctcgccatcaccgacgcgacgaactcggggccgggttcgaacatggcaccgttcctcgtcgggatggccgtcgcggcgatcggcatgagctttggtacggacgccggttacgcgatcaaccctgcgcgtgacttcggtccgcggctcctgacgtggttcctcggctggggacacaacgccttcgccggtctcaacggttactggtgggtcccgatcgtcggtccgctcgtcggtggagcgatcgcggttggggtctatcgctggttcatcgaggacacgattcgtgcgcgcttcgcgcgccagagcacggaaggaggggcgcagtgaccacccgtatcctcgctcttgatcaaggaacgacgagctctcgagcgatcgtcttcgatctcgacggcaccatcctcggcctcggccagcacgagttcccgcagtactacccgcagccaggctgggtcgagcacgaccccgaggagatctgggagtcccagcgccaggccatcttcgacgccctgcgcgccgccggcatcgcgccaggggacctcagcgcgatcggcatcaccaaccagcgtgagaccaccatcgtgtgggatcgccaaaccggcaagccggtcatgaacgcgatcgtgtggcagtgccgacggacggcgccgatgtgcgacgaactccgtgcggccggccgcgaggatctggtccgttcccgtaccggtctcgtcatcgacgcttacttctcgggaacgaaggtggcctggatcctcgagcacgtgccggaggctcgtcgcctggcggacgagggccgattggcctttggcaccgttgatgcgtggctgatttggaagctcaccggcggacgggtgcatgcgacggacgccaccaacgcctctcggaccatgctcttcaacatccacaccggtgagtgggatcccgaactgctcgagatgctgggcgtgcccgcgtcgatgtgcccgacggtcgtcgactccgcaggcgtggtcgccgagacggaccctgagatcttcggtgccagggtgcccatcgccggcatcgcgggtgatcagcaggccgctctcttcggccaggcgtgcatcgagccgggcatggcgaagaacacctacgggaccgggtccttcctgctgcagaccacgggccacgatgcggtcgcgtcgcactcgggcctgctcacgaccgtggcgtggagcatcgggggtgagcgcacctacgcgctcgagggctccatcttcgtgaccggagccgtcgtccagtggctgcgcgacggactgcgtctcatcgcgcatgccgaggacaccgaggcgatcgccgccgaggtccccgacaccggtggcgtcgtggtggtccctgccttcgtggggctcggcgcaccggtgtgggacccgtacgcgcggggcaccatcgtcggcatcacgcgcgggacgacgcgggcacacatcgtgcgggccgcgctcgaatcgatggcctaccagacgcgtgacgtcgtcgaggcgatggcggccgactcgggccagcgactcgccatcttgcgggtcgacggcggtgcggtgcgcaacaacgtggtcgcacagctccaggccgacgtgctcgggatcccggtcgagcgtccgaaggtcaccgagaccacggcgctgggtgctgcctacctggcggcggtcggcgtgggtgcggtggcaggtcctggggggctgcgcgacgtgtggcaactggagcggcgcttcgagccaacgtgggacgaggcgacgcgagccgcggcctatcgcacgtggcagcgtgcgcgggaccgcgcccgagcgtgggtcgaggcgtaggctgcgagagggaggtagtcggatgaagaaggtcatcaacgaggtcgaccacgtcgtcgacgagtctctcgatgggctcgcggccgcgttcgcaccgtgggttcgccgcatcgagggtacccacgtgctggcgcgcgcggtcgcgaagccatcggggcgcgtcgggctggtctcgggcggcggatcgggccatgagccggcccacggcggctacgtcggtgagggcatgctcgacgccgcggtggccggcgaggtcttcacctcgccgacgcccgatcagatcctcgagggcatccgcgccgccgaccacggcgcgggggtgctgtgcgtcgtgaagaactacaccggcgacgtcatgaacttcgacatcgccgccgagctcgccaaggaggaggggatcgaggtgcgccaggtcgtcgtgaacgacgacgtcgcggtcgaagactccctgtacacctcggggcgacgaggcatcgccggaacggtgttcgtccacaagatcgcaggcgcagcagccgaacgtggggacgatctggcgacggtggcggcggtcgccgagcgcgtgatcgcgaacgtgcgctccatgggcctcgcactcgcaccgtgcacggtgcccgcacgtggagagcccaccttcaccttgggcgaggacgagatcgaggtgggcatcggcatccacggcgagcctggggttcggcgcgaaccactgcgtcgtgccgacgacctgaccgacgaactgctcgatcgggtgacgagcgacctcgggctcgagagcggtgcatccatcgcggtgatggtgaactcgatgggagcgacgccgctcctcgagcttgggatcgttgctcgccgcgtctaccaggtcgcggccgagcgcgggtggcacattcgcaccgcctgggttggcgagtacatgacgtcgctcgagatggccggctactcgatcacggtgcttcgactcgacgacgagctcgccgcgctgctcgaagcccctgcgtcgacggctgccgttcgggtggcacggtgagcgagcccggttcgctcgcctggtggcacgacgtctggcgctgtttcgcggcgtcggtgcgcgaccagcgcacctggctggacgatctcgacgctgcgatcggcgatggtgaccacggtacgaacctgaaccgaggtctcgagcgcgccctcggggccctcgagacctcgcagacgccgcgagcggggctgaggagtgttgggatggcactgctcggcacggtcggcggggcatcaggcgcgctgtggggctttggctggaccaaggcctcggcggcagccggcgacgggaccggcgccccaacgcccgacgaggtcgtggccacgctgtcgctattccgggacgcggtgctcgagcgtggccacgccgagctcggcgacaagaccatggtggatgtcctcgtgccggcgctggcgtcgctcgctgccgagctcgggactcagcgctccttcgccgaggcagccgctaccgccgcgtccgtggcctcggagcgtgccgagtcgaccatccccctcgtggcgcgcaagggccgcgcgtcgtatctcggggagcggagcgcaggtcacgaagaccccggtgcggcctcgatggctctgttcttcgcatgccttggcgaggtgagctgaggtggtgggcgtgctggtggtgtcgcactcgcggcgattggcgcagggggcgtgcgagctcgtcggcgccatggccaagggggttcggctcgagtggcgaggaggtgagccccccgagcttggcgtgagtgtcgagctggtggcagatgcgctcgagggcctgctcgaagggggcggtgaggtggtcgtggtcgccgacctcgggtcctcggtcctggcggcagaagcggcggtcgagctgatcggggcaggcccacgcgtccgcgtcctgcgcggcgtcccgatgctcgagggcttcatcgcagccgcgatggcgctcacggtgggcggaggcctcgccgaggccgtcgccgcggccgaggcggcctgtggtgcgctcgagggcgggcgatgacgcgccgccgggtcgtcgtgatcggggccggggccaccgggctcggcgtcggcgtggatttggccacccgtggcatcgaggccgtcgtcgtcgagcgtcacgcggtgggggcagggacgtcggggcggttccacggtcttgcacactccggcggtcgctacgccgtcaccgacccgctggccgctgccgagtgcgcccgcgagctcgcggtgctgcgccagatcgcccccggtgccctcgaggccaccgggggatggttcgtacgcacgagcgacgatgacgccttcgagcaggcgtggctgcgtgggacggcgtccgccgggatcgaggtccgcgaggtcccgctcgacgtcgccagggcgcaggtgccggcggcggcggcgcgagctcggcgggtgttctgggtacccgacggtgtgctcgaggggttcgagctcctgcgcggcctcgtgcgaacgctgcgacgtttcggtggcgacgtgctcgaggggtcggaggtgatcggcctcgtgcgcgacggtgccagggcggccggtgtggtcgtgcgccaaggcgatcgagaggtcgtcgtcggtgccgacgccgtggtgaacgcggcgggtccactctcgggtgtcgtcgggcgtcggctgggcgccgaggtgccggtcgcgccgtcgttcggcacgatgttgatctttgccgatcgccgactcccgctcgtggtgaaccatctcgagcgcccatccgacggcgacatcttcgtaccccatggcgagactgtcatcctcggtaccaccgacgtcccccacgaagacggcgaggcgctaccgccgagccggcaggaggtggctcggctcgtggagctcggtgcgcgcttcgtgccggaggtgcgcacctggcgaccgatgcgggccttcaccggcgtgcgccccctggtcgccgatccgggtgcgggcgggccgcgaggtctgtcgcgcagtcacaccatcgtcgaccacggcgcgagagacggtatcgccggcctgttcgcgatcatcggtggcaagtggacgacgtatcggctcatgggggagcagaccggcgacgccgtcgcctcctacctcgaggtcacggcaccgtcggcgacgcggtcgctcgtggtggtgccggcgcgagttcggggacgcgcgccgacgtcgtcggagacgttgtgcacctgtgagggcgtcggtcgtgacgagctcgtcggcgagggttcgctggatcgttggcgcgtcgagcattgggcgacgatggggccgtgtcaggggacgttctgcgcccatcggttggcggctcgcgcagctgaactcacgggcggcgccctcgagagcgaggcgctcgatgcgctgcgtgccgagcgcgcgcggggggtcgatgcggtggcctatggcgcacaggcacgccttcgggccctcgcgtccgagcagcgtcgctggtgggggtggggctcgtgagcgtcgtggtcgtcggggcagggccgagcgggctcctcgcggcgtcgctgctgctggacgagggtgcgtcgccgatcgtcgtcgcggccggcgagggttctcttggcttgtggccgggttggctcgcggccccacgggacgatggcgccgtcgagcgggccgtcgcgagcttgaatcgggccgacgcacgactgtcgagcgtcgacgagcgcgaccgactcatcggcccgctcggggtcgcgcatcggttcgcctgggctccgccggaactcgcgagagtgggacccgaggacgtcgtcggcttctgcggcttcgccgagatgaccgagacgcgggctgccgtcgcggtggcgacctggcagagccagaccggatcggcagccgtcggcttcgacctcgcgccgtggggccggcgggtgccgttcgaactcgctcgcttcctcgggcacctggagggggcgcgagcgctcgggcgcgccctcgcgccccgggtcgacggcgccgtgagcgtcgtcgcggtaccgggactgctcggtatcgaggatgcgacccgggcgctggcggtgctcgaggagatgctcgagcgccgggtcggcgaggtaccgctcgtcacgcctgccctggctggttggcggctcgatcgtcgggtgcgcaccgcacttgcggctcggggcgcgacctttcggcgcgccagggtcgtcgaggtcggtcggggaggcgtacggctcgcggacggtgcgcacgtcgacgccgacgcggtcgtgctcgccactgggggcgttgcgggtggcggcatcgcaatcggtccggatggctcgctcacagatagcgcgcgcggcgtcgcgatcggcgaccctgcggcatggatgatgggagaagacgtggggctgctcggttatcgcgaggtcgtcgtcgacgaggaggctcgggtcgtcgcggtgggcgcgctccgtgcgcacgaaggctccgggttcgcccaggttgcccagagcgtcacggaggcggtcgaggtgcttcggtcatggtgagcacggcaacggcgctcagactcgacaacgccgatgcttgcatcaagtgcggtctgtgtcagctcgtctgtcccgtgctcgaggtggacccggcctttagcgggccgaaggtgctcgggccggactggcatcggcgcttcgtagctggcgagcgggtgacggacgacacggccgcgcgctgtacgttctgccagctgtgcgagtcggtgtgtccggtgggtgtccccatcgcgcacctcatcgcggagcacaagtcgcacctcgaccacgacccgcgctcgaggatgcgagatgcggtcgtggtccggcccgatgtgctcgcgcgctttccgtggctgacccgggtgccgaggcagctcgcgccggtcgccggcctgtcgtcgacgacacggtggccgcgtccgcaccgaccccgggccgcgtcgagtgacggcgggacctctcgcgtcggcacggtcggagtcttcgtcgactgcttcagtcgggccttcgacggtgccacgatcgatgcactcgtcgtgctcctcgggcgtgcggggatcactgcacgtctggtgccggcggacacctcggtgtgctgtggcgccgcagcgtgggcgagcggtgctccgcacgtggccgaggggcgcgcgcgcgaggcagcgcgtgccatcgaggccgacgccggcgatctcgatgtggtcctgagcgtgaacgcaacctgcgaggcgacgatgcatggcgagtggcacgacgtcttcggcatccagacgtcggtgccgagcgtgagcgcggtcgattggctcctcgacactggtgtcctcgctgggctcgtggagcggcggcgaaggggcgatcggccgaagcggctcgctctccacacgacctgtcgcgcgacggtggccggagaaggcggcgccgacgtcgccgcgctcgaagcggttggctacgaggtcgtccagaccgagctcagctgctgtggcgcggccgggagctatgcgttcaaggccgagcatgccgagcgtgcgcggcgtatcgggtcgcgggtcggaccgccggccgagatcgtcggggtcgcggtcgactctgcgacctgcgcgttgcacctgggggacctctggggcgtgcgcgcgacacacccactcgtgtggatcgaggaggcgatgcggccgtgacggagaccccacgtgcgattctcgccatccgcgatcctgagctcgcccaggctacgaccgctgggctcgcgcctgggtgggtgatgctgctcggagggccggccgcgagcgtgatcgatgcctccatgaccctctcgctcgagggctgggtcgtgttcgtccacatcgacatggtgcgcggtctcgggcgcgacgccgacggcctcggggtgctctcgcgcttcggcgcaccccagggcgtgatctcgacgcatccgagcgtggtgcaggcggcacgggatctcgggttcgccacctccctgcggatcttcctggtggactcgggctcgttacgctcggggatccaacaggcacagcgcaccaagccggacttcgtcgagatcctcccgggtgtgctgccgcacctcatcgcgccggtggctcgagcgacggggctcccggtgatccctggtgggctgatcacgactccagcggatgcgtgggcggccatcgaaggcggtgcgctcgcgatctcgacgtcgtcgctcgaggtctatcgggcggtagtggaggcgccggctcccctggcgcacgagaaccacgtgcagcgctcgaggggtcaccgatgagtgacgtcgttcggcgccagctcatcgtcatcgaccccctgggactccatgcacgcgctgccgcggcggtggtcgcggcgctggggccgatcgcgggcgtcgtcatccgagcaggtgagcgtgccgtgcccgccacgagcgtgctggcgctcatgggactcggcatcgaggctggcgacgtgatcgtcatcgagggtcccgtcgaggcagagggagcgatcgcagaggcgctggcgacgatctctgcggtggcccagcccgtcgtcgagggcccgagtgacgacgagggacaccaggggcagtcgtcgtcatcatgaaggccgtgtaacgattcccgcctcgtgcatggattcccttgcgccgaccggacgcgacgagtaaagtagcgccacacgggccgtttcgacgcggaaagcgtgtcggaacggggagcctggatcaggaggggtggccagggtgcaacggtctcgagggcgcgcagctacggtgcgctaccgatgaccaccctgacccgtcgcctcgaggccgagcctggcccacgagccgttcgccgagacggtgcgctggcgcgcttcctcgccaatcgactcgccgtcggcgcgctggtggtgctcgtggcgatcgtcgcgttctgcttcgtcggcccgatcgtgcacccggtgtcggacgcagccaacctgctgcacgccaaccaacctccctccggccagtacctgctcggcacgacaccgaacggccgtgacgtcctcggacgtctcatggtgggaggccagtcgacactcgagctcggggtggccgtcggcgtgctcgcgacgggcttcggtctgctctacggcaccgtcgctggtctcgtgggcggtgtcacggacgcgatcttgatgcgcatcgtcgatgccctgctctcgatcccgttcctcttcttcgtcatcttgctcgcctcgatcgtgcgcccgacgctcggactcatcatcctcgtgatcgccggcgtgagctggctctcgacggcgaggctcgtccgagccgagaccctcaggctccgaaccctcgactacgtcgacgctgcccgtggtttcggagctcccccctggtggatcctcgtgcgccacctcgtgcccaacgtgctcggtgtgctcgtcgtgaacgggaccttgaaggtcgccgatgcgatcctcacctttgcggcgctcggctacctcggcctcggcgtgcccccgcccgcgacgaactggggcgcgttgctctcggcgggcgtgaacaacttcttcgacggctactggtggcagctgtggccagcggccgtgctcatcgtcgtcaccgtgctcgcggtgaacgtgctcggcgacgccctgcgcgacgtcgtggagcggaggctctcgtaagtgggtggaaggagcaaatggtggagggatcgatgatgaggcagctgcgtcggacgaggtggcatcggagcgcggcgtggaccggttcgctggtggcgctaggcatactggcggccgcatgcgggagctcgtcgggggcgtcgacgtcgtcgtcggcggcgaccggactgccggcgaactacgcctcgtttgcgctgcactcgggcgacacgttctcgtgggttctcccactgccgaaccaggccaactacgagccatgggaccagaacgcggagtacgggatgtaccgaccgctctacgtcgctggcaacgggtcctccccgaccatcgacgaggcgacctcgatggccaacccgccgacctacaacgccaccgacacgcaggtcacggtgacgttgaagccgtggaagtggtcggacgggaccccggtgaccgcccgggacgtccagttcttcttcaacatctatcgggccaacaaggcgaacatcgcgacgtacgtgccggggaacttccccgacaacgtcgcctccttcaccgtcgactcgccaacgagcttcacgctcacgctcacgcatccggtcaacccgacgtggttcaccgacaacgagctcaccgacgtggtgccgctgccccagcaggtctgggaccgtacctctcccggtggcaaggtcggcaactacgacgagaccacggcgggtgccgtggcggtcttcaagttcctcacgaagcagtcgaacgatctgtcgacctacgcgacgaaccctctgtggcaggtggtcgatggcccctggaagctccagagctacgacccgaccaccggtcgcacggtcttcgcacgcaacgatgccttcaccgggccggacaagcccaagctcgctgggtatgcactcgagagcttcccgagccagaccgccgaggtgaatgcgctgcgctccggtcagctcacctacggctacttgccgatctccgactacaagctggagtcgagcctgtcgaagagcgggtacaccatcgcaccgtgggtcaccgactacgtccagtgggccgaactcggctacaccagcccgaagtacgggccactcgtcaagcagctctacatccgccaggcgctccagcacctggtcgacgagccgctgtacatgagtcaggccctgcacggctacgggcagttcacctatggaccggtcccgaacatccccggctcaccgtacgtgacggcgacggagcagaccgaccccgacccctacagcaccgcagccgcgaagagcctcctcctcgcccacggctggacgctcgggtcccaaggggtgatggtgtgttcgaaccccgggaccgcggcgaaccaatgcggtgcggggatctcgaagggcgaggccctcaacctcctcttcatgtaccagagcggcaccccgacgctcgcggcccaggtggaggcgttcgcgaccgctgcgaagcaggcgggcgtcggcatctccctcgatccccagacccagagcaccatgttctcgatcggcggcgtgtgcccctcggccggcccgtgcaactggggcatcatcttgtaccggaccttcctgtggaactacggccaaggcgatgtgctcccgacggggggtcagatgttcggcaagggcaactactggggaggcggctacagcgatccgacggcccagtccctgatcgacgagacccacacccaaccagggctgagcgccttgttcgcctacgagaactacatctcgcgccaggtcgcagccctgtggttcccgacgtgggactggcagatctcggtggtctcgaacaagctgcacggctggaacccacagcagatcttcgggaatccgacgccgtcgaggtggtacttctaggcgatgcttgggttcgttgcccgacggcttggccaggcgatcgtcaccatggtggcggtgtcgatcgtcgtgttcgggctgctccatgccttgccaggggggctcgtgcgcgcccagttgggcgcgcacgtctcccaagtcgcgatccgtgcgctcaccgtgcaagaaggcctgaccaagccgctgccggtccagtacctcttgtggctgaagggtgtcctcgaagggcagttgggccagtcgttcaaactgggtgaaccggtgtcgacgttgatcgcgctctatgtcccgaggacgatcctgctcgtcggggtgtcgttgttgctcgcggtcgcgatcgcgatcccgctcggtctgtggcagggctaccgccgtaatcacccggacgaccacgccctcagcgccatcatgctcacgctctactccatgccgacgttcctgctcggggtcgtgctcatcatcgtgctcaactcctggctcggcctgttgccgtcgctggcatcgaacttcggcgcgagcatcggcaccgatgtgcgcgacctgggactgccggtgctgacgctcacgctggcgaacgtgagctacttctcccgctacatgcgctcgtcggtgatcgacaacctgctcgaagattacgtgcggacggcacgctcgaagggtgcctcggagcgtcgagtcctcctgcgccacgtcctgcgtaactcgctgacggcgaccgtgaccatgatcgggctcacgctgccctatacggtgtcgggatcgctcatcgtggaagcgctcttcaacttccccggggctggactcttgttctggaacgcggcccagacgcgcgacttcatggtgctgctcggcatcgtgctcgtgatctcgatcgcgaccatccttggcaatctcctcgctgacctcgcctatggcctgctcgatccgagagtgcgctaccgatgaccaccctgacccgtcgccccgaggcccaggtcggcccgcgagccgttcgccgagacggtgcgctggcgcggttcctcgccaatcgactcgccgtcggtgcactggtggtgctggtggcgatcgtcgcgttctgcttcgtcggtccgatcgtgcacccggtgtcggacgcggccaacctgctgcacgccaaccaggcaccctccggccagtatctgctcggcacgacaccgaacggccgtgacgtcctcggacgtctcatggtgggaggccagtcgacgctcgagctcggggtggccgttggcgtgctcgcgacaggcttcggcctgctctatggcaccgtcgccggtctggtgggtggtgtcacggacgcgatcttgatgcgcatcgtcgatgcgctgctctcgatcccgttcctcttcttcgtcatcttgctcgcctcgatcgtgcgcccgacgctcggactcatcatcctcgtgatcgccggcgtgagctggctctcgacggcgaggctcgtccgagccgagaccctcaggctccgaaccctcgactacgtcgacgctgcccgtggtttcggagctcccccctggtggatcctcgtgcgccacctcgtgcccaacgtgctcggtgtgctcgtcgtgaacgggaccttgaaggtcgccgatgcgatcctcacctttgcggcgctcggctacctcggcctcggcgtgcccccgcccgcgacgaactggggcgcgttgctctcggcgggcgtgaacaacttcttcgacggctactggtggcagctgtggccagcggccgtgctcatcgtcgtcaccgtgctcgcggtgaacgtgctcggcgacgccctgcgcgacgtcgtggagcggaggctctcgtgaccgttcgatcgagcggtggggggacctcggtgcgcaggacgtgggagcgccccgagctcctgcgcgttgccgaaggcgcactcgcgcacgcatcgacgatgccgctctggctcgacgatccggctcgaccggcggcgaccccaccactcgaagggcaggtcacggccgatctcgtgatcgtcggtggtgggctgctcggtctgtggagcgcgctcctggcggccgagcggcgaccagagtgggagatcgtcctcgtcgagggcggtcgcatcgccgctgcggcgtcggggcgcaacgggggcttctgcgaagcgagcctgacccatggactcgccaacggacttgccaggtggcccgatgaactctccgagctcgagcgcctcggcgaggagaaccttgcggccattcgggcggccgccgagcggtatgccgcgaactgcgacctcgtcgattcggggacgatcgacgtcgcgctcgaggactggcagctcgacgagctcgccgagctcgccgaggtggcgccacgctacggccacgacgtcgtcctcctcgagcgcgaggcgctctcggccgaggtacgctcgccgagctatcgcggaggcctgtggacgcgcaaccgcgcactcatgctcaatcctgcacgtcttgcgtggggtctcgaggcggcagtggcggggatgggcgtgcgcatctgcgaggggacgcgcgtcgttgggctgagttccgagggcccgttcgtcgtggtcgagaccggttcgggtgcgagcgtgcgcgcgagtcgggtgatcctcgcgaccaacgcggcggctcccctcgtggcgtcggcgaggtggcggttcgtcccggtgtacgactacgtcgtggcgacgcgaccgctcgcggcgagcgagcgtgccgagatcggttgggagcgacgtcaagggatctcggatgcgggcaatcagttccactactaccacctgagcgaggacggtcggatcgtcttcggaggctacgacgcggtctaccactacggttcggtggcccgccctcgctacgagggacgctcaccgacccacgtacgcctcgtcgcgcacctgtacgcgacgtttccggggctcgagggtgtcgagatcagccacgcctggggtggggcgatcgacacgtcgactcggttcgtcgcgtccgtgcatcgggcctttggcgggcgcgtgcactatgcggtggggttcacgggtcttggtgtcggggcgacgcggctgtacgcatcggtactcgtgggtcgtgcgatcggggagccccacccagcggagcggctccgactcttccgtgagggccccgtaccgtttccgccggagccgctccgctggatcgggatcgagttgacacggcgctcgctcgcctgggcggacgaccacggcggtcggcgcaacgtctggctccgtgcgttggaccgcttcggcgtcgggttcgattcctaggaaggggacctcgtgcaagagctcgtgcaagaggatgtgatcgtgcgggtcgaggggctcacgaccgatctcgtgcgtcacggtggctcggttcgggtgatcgatggcgtgagctatgaggtcgccaggggtgagacgctcgggatcgtgggggagtcgggttcgggcaagaccatctcggcactcagcctgctcggactcttgcctccccagatgcgcgtcgtcgctggctcggcacggctcgagggcgaggaactcatcggtgcgagcccgcggcgcctgcgcgagctccgcggtgcggccatcggcatgatcttccaggacccgctgagctcgctgaacccgtcgaagaccatcgggtggcaggtggccgaaccgttgcgcatccaccagcgtctcggagccgccgcagcgcgccagcgcgcgctcgagctgctcgagctcgtgggcatcccgagcccgaaggagcgcttgaacgactacccgcaccaactctccggcgggatgcgccagcggatcatgatcgccatcgcgctcgcgtgtggaccgaagctcatcgtcgccgacgagcccacgaccgccttggacgtgaccattcaggcccagatcctcggcctcctcggcgaactgcaggaccggctgggtacagccatgttgctcgtcacccacgatctcggggtcatcgcgggtcgtaccgaccgggtgctcgtgatgtacgccggtcgggtcgtcgaggctgcgccgacgcgcaccctgttctcggccatgcgccatccctacacccaggccctcctcgcgtcgatccccgtgatcgggatcgatcggagcgtcccgctgccggcgatcccgggcacaccgccgccgctcggcggagcgggggtgggctgtgcgttcgcgcccaggtgtccgcgtgccgacgagcgctgccgccaagagatgccaccactcgcggtgagcgctggccacgcagtggcctgctggcaccccgtcgacggacccgttcgacggaccaggctcgaggtcgctacctcgcttgcggcggtgccacgtgctatggagccgttggtcgagctggtcgggcttcgcaaggagttcgagatccactccaacgtgacgcggcgccatctggggacggtgcacgcggtggcgggggtcgatctcgtcatcggacgtggtgaaaccgttggcctcgtcggtgaatcgggctgcggcaagacgaccctcggacgtatggtcgtcgggctcgagcgcccgacgggtggtgagctgcgcatcggtggcgtcgacgtggttcgcctccgcggcagcgagcggcgatcgtttcatcggcggatccagctgatgttccaagatccgttcgcatcgctcgatccgcggatgcgcatcgcgagcgcgctcgccgaacctttgcgcgttcaggggctcgatcgtggcgaggagcggctggcgggactgctcgagcgcgtcggcttggcgcgcgaggcgctgtggcgctacccccatgagttctccggcggccagcgccagcgcatcggtctcgcgcgggcgctgacgctcgaccccgagctgatcgtggccgatgagccggtgtcggcgctcgacgtctccattcgctcccagatcctcaatctcatgcgcgagacccagcgcgagcgcggtctcagctatctcgtgatcagccatgatctgtcggtggtgagctacctcgccgatcgcatcggcgtgatgtacctgggccgtctcgtcgaggtcgggccgacggccgcggtgatcgcctcgccagcgcatccctacacgcgcggactgctccgttcggtgccgcttccggatccagaacgtgagtcggcaaagcgtcgtctcggagcggtgatcgaaggcgagctcccgtcggcgttgcgcccaccgacgggctgtgcgtttcaccagcgctgcccatttcgggtggcccgttgcgaggtcgaggcgcccgaggctcgcacgctcgacgatggcagggtggtcgcctgtcatcgcgtcgacgacgtcctcgccgagccgtggtcgctcgaggacgtcggacagatggcgagcgcgctgcgagcgtaggcgtttcgacgtgcgccgcggccaacgagggccacaagagtacgccgacgccggccaggcggtctcgtggctgtgcggaggcggcgtcggagcggttcctcgtagcggcgccagacgatgagcgcgatcgcgagtgccgcggtgaggacgaggaggtcttgccaccacggtccgccgtagtgatacagcgacacggtggcgaggctgcgcatgaccagtcgatggaccatgtagaaggcgaagctcgccgagccgagcgcgaccgctgccgaatgggcgatgaggcgtgagatgcaacctgcctggtgtgcaaagacccacacgacggctccccagacgggaagatagagcgcgctgaagcggagcgactgcggagcgaagggtcccgcgacgacgacgcccacggcccctgcgagggcagcgccctcgaggagtgaccatcgccagcgcgacccgccgctctcggggtgttcggcgaaggcaatggccgcaacaacgccggccagaaagtccgagagtcgggtgatcggaaacacgtagatgacccagctctgccaaccggtgtgaagcggaaccagcacgccgacgagggcgagccaggccgtcgccgcgccgaagaggagccagcttgtcgtgagtcgtggccgagcccactcgacgaggcgggcgacgacggggaagatgaggtagaaggttgcttcgtcgctcaagctccatgcgacgccgtcgaacgagaacgccgcggcgagcgatgggatgaagctctggacgaggaggaggttggcgagtgcgagcccgagccaggagccgatgccaccgtacatcgagggtggcgtcaagaacagcgaccaagcgaaggcgaggacgtagaccggatagatgcgtgcgagccgagagcggtagaagccaagcaccgggtttcgccgaagacgcgtgaagcggccctggtacgcgtaggtcaggatgaagcccgagagcacgaagaagaacgagacaccgacgtagccggtctggtaggtgcgcagccaacctacgtgccaacagaagacggcgagtgctgcgacgaaccggagactggtgagtgggcgtagctgtaccaacagacctcctttggccctcgtgcgccacgtagtggctcaagaccgcgagtggtcgcgtgtcatgacgttcgatgacgtgggtcgggcggttccgaacagcgtagagggctcggtcgttcaggtctgggttgggtcgtagtagctactcggagacgtctgagcgctgacgtacgacggttccggaactactgctcgcctcccgcgtgggcgtcgcgcgaggcaatcgagtcagcgaccgagggcgagatggtggagcgcgatggctgcggcggtcgcgaggttcacggagtcgaccccgttcgcgatcggaatggtgacgagtacgtcggcgtaggcgagagcgctcggtgagagcccgtgtccttcggatccgacgaggagcgcaacgcgcggtcgcggcaggtcgtgctcgccgggcgcgcgtgcgtggcgtggttcgccgatcgcttcggcgagctcgtcgaccgtgacgacaggagtgaggtcgcaggttcgctcggtacgcaggcgttgtgtcgacgccggtggcaccaaggcggcgatgcgaacctgcgaccgtgcaaggagtgccagtgcgctcggccatggtgtcgcgcgcacgagggggagcgtcaagaggtggcccgctgacacccgcaccgatcggcggttgcgtgggtcggccgaggtgggatcgagcaccagggcgcacgctccgaacgcggcggcgttgcgcccgagcgccccgaggttctcctggtcgaccacaccctctgcgacgagcgccgtctcacccggtgcccacagatcgaggaagtcctcgagtgcctgcacgggcgggcgctcggcgtgggcgacgacgccgcggtggagtgcgaagcccaccgtctcggcgatcacccttcgggatgcgacgaggatcgggacccgtcgggcgacggcacgatcgaccacctcggtggcgagtgcaacctggtggtcatcgaggaggacggagtggacggtgagcccggtcccgagcagcgtggtgacggccacgcgaccctcgacgatcacgtcgcgagctcctcggcgttggcgaagcccgttgccgcccttgaggtcgcgatacggctcgagccggtcgtcgtcggggtcgtcgatgcgtacggcgccgatcggcagaggagcagaggcggcgtcgtcgtggttggcgatcatggctcgacgtcgaggagggtgtcgtcggcaccaccggagacgagggtcgaggcgaggatcgtcggagccgagttcctcgagctgagcgcacagagccacccgtcgagttcggtggaggtgcgcaccgcgagcggttgccaacctcgtgcgagcttcgtggcgcgcctcgcgagcaggcgtgcggtcgatcgtgtcgagcgctcgaggaggagggcagcgatctggaggtcgtgggcgcggccgaggtgggtggtgagtgcgagtgctcgccgacggagcctcacgctcgtggcgggggcgatgggtgcaaggagttcggatgcgaggcggaggcggcgtgcgcttcgacgtagcgcatggagctcgtccatcccaggccgttgggcagcacgacgcgctcggcgctgccaggaacgcacgagggcttcgagatcgaccacgcgccgagtgtcgggtgtcgatgtcgggcccgggaggcagacacgggcggcgcgtgcgagttcggggaggcgctcggcgcgcttggtgcgctcggcggcgaggtcgggacgagctggcaggatcgtcgcggcgacgtcgagatcgcgcacgctcgcgagctggttcgcgaggcgagtgagtggagaggcgccgtggcgccccacgctgggggcgggcgcggtgccgatgagcgcttcggcgaccgccgcgcgtcggagtgcggctcgcgcatcgtggacgaggtcgggggtggtgcgccgctccagcgcgatgagcagctcttcgagcgccgcgcgtgtctcggcaagatgcgccgccaccgacggccagacctcgggatcgatgacgacacgggtgcgcatggtcgggcgtcgtcgaacgagtcgtgcgttggtcacgtcgggtcagtgggcgtgcaggatcgttgggtcggcgtcgatcgcggtgacgacgccgagcagatcggcggcgcggaccgccacgggtgtggtgccgtcgtcgtgctccgcgatgccggaggcggcgagggcaaagggaatctcgagtgccctggcgaaggctccgtccgtggtgaggcggtcacccaccatgatcgtcgatgtggcaccgaggtggggtcgcacaagctcgaccatgggccagtcgggcttgccgcagtaggtcggttccaccgaggtcgaagcgacgaggctcgcgacgagcgcgccggttcccgggacgacgagtcgttcgagcgggtaggtcgggtctcggttggtcgcgaggaatcgggcccccgcgcggatcgcgacacaggcctgcgcgagaagatcccatgtgaagcctcggtgccagcccatgacgaccgcgtcgaccttctcggcgtcctcgagggacgtgggcctcacgagcgtgttgccctcggcgacgacgctcgtcagtccttcctcgccgatcgccagcacgcgctggtcactgccgagcgcgagacgtgcggcaagggcggaggtgaggatctcgttggcgtcggcgtcgatcccgagtgagcggagcttcgcgacgtaagcttcgacggtgagagtggagttgttggtgacgaagcgcagatcgtcgccacgatcacgaatgcgcctgatcgctcggtcggagccttcgatgagggtgctcgagcgccacacgacgccgtccaggtcgatgagccagcgcatggtcctccagtcgccaatcgactgccgaagcgtcgcgggtcgctcggcgttggttgggacttggaggctagcatgacctcgtcgacacgagggaggtgctgagcgtggactacgagtcactgctgggcgaggaggcgaagcagctcctcacctacgtcgcgacggggatacccgcatcgagcctgatccaccccggccctcgcgtggtcgacgaggtgttcgcttccagcgaccgtaccaatcgcgtgttggtcgagctcgccaggctctatgggactgggcgccttgcggggactggctacgtctcgatcctccctgtcgaccagggggtcgagcactcggcggcggcgtcgtttgcgccgaatcccacctacttcgatccgcagcgtatcgtcgagctcgcgatcgagggggggtgctctgccgttacgacgacgctgggtgcgctcgggatcgtgtcgcggcgctacgcccaccgcattccgttcatcctcaagctgaaccacaacgagttgctcacctatccgagccgttacgaccaggtcatgttcgccaacgtgcgccaggcctgggacatgggtgcggctggggtcggcgccacggtctacttcggctcacccgagtcgacgcgtcagatccaggaggtatcggcggcgttccacgaggcacacgagctcgggatgttcacggtcttgtggtgctacctgcgcaaccccgcgttctcgaccccagacggagacctgcatacggcggccgatctcaccgcgcaggccaatcacctcggcgtgaccatcgaggccgacctcgtcaagcagaagcttccgacgaccaatggcggcttcgtgaagctcggctttgggcgcaccgatcctcgtgtctacgagcgctacgcgaccgatcatcccatcgaactcactcgttggcaggtcgtgaactcgtatgcaggcaggatcggcctgatcaactctggcggcgagtcgcacggcgcgagcgatcttgctgaggccgtccggaccgcgatcatcaacaagcgtgctggaggtgtcggcctcatctcggggcgcaaggcgttccaacggccgttcgaggaaggcgtggcgttgctgcacgcgatccaggacgtctacctcgatcctgcggtcgaactcgcgtgagcgtgtcgcggcgcgcgcctcaggccagcgccgcgagccgttctgcgacgtcgtagagcgacggatcgacctgggcgatcgcgcgaaaggcatctcgtgcctctgcgtagcgtccttgtcgctcgagcagggtcgcgagctggtagcgcagtcggagggcccggagcgacgtggtctgtcgctcgcgttcgagtgcccgacggatgacgtccaccgccgtgctgaggcggtcggtgtccgcgaggtggcttgcccacacgatacgcccctcgaccatggcgtccttcgacgggctcgcttcgcggagcgcgcgccaccaatgctcgacggcctcagcgtcgccttcggctcgagcacagtccatgaggatcgctccgtgcgtcagatcgccggtgaggtcaacgaaggtggcgagatggcgtgcagctcgagcgaaatctcccaagcggtagcgcacgagaccgagcagttcttcgatggggggcgacgcaggcgcgaggcgctcgatgcgtgtgaggatgcgaagcgcctcggcgtagcgatcctcggcatagtgctgtgctgcctcggcgagctgacgctcgacgactggccggagccgaggcggcgccgtcagctcgctgggctcgatcgcgacgggctctcctggcttcgcgcgtcgccggttcggcctcgtcggggcgaggtagcgctgtcggcgcgggctcgtggtgtcgaagcgcacctcgggcaggcgcccgctggtgcgcgagggctgcggctgcttggaggactgccctgccgtgcgagcaggacggtgggcgccatcagagcgacgctcacgcgcctcgccctcggggcgacgtcccccgccaccacgacgcgggccctcccaggaaccctctcgacgggacggccgacggtcgtcgtcgaagcgacgctcacgcgcctcgccctcggggcgacgtcccccgccaccacgacgcgggccctcccaggaaccctctcgacgggacggccgacggtcgtcgtcgaagcgacgctcacgcgcctcgccctcggggcgacgtcccccgccaccacgacgcgggccctcccaggacccctcgcgacgggacggccgacggtcgtcgtcgaagcgacgctcacgcgcctcgccctcggggcgacgtcccccgccaccacgacgcgggccctcccaggaaccctctcgacgggacggccgacggtcgtcgtcgaagcgacgctcacgcgcctcgccctcggggcgacgttgcccgccaccacgacgcgggccctcccagcggttggcagaggtgccgtttccggagcgatccgagctgcgttgccccgcggctcgggcccgagactgagggttgcgctgcccgtcgcgttcgcgtgctcgagtgtcgggacgggggcgctgtgtcggggtttgtcgatcagactgggaaggatcgtggcgttgaggtcgtgcgggcatgcgtaagggcttcttcctggcgatggagtgtgacgggtgcttcagtctacgtgccgattgcggcggcgttcgcggagagacgggagtccgctgccgacagcggccctcggcgacacgagagtagcggtcgctctgcgctcaccggtggcggtcgagggtggtcacggtgctgtgcgaaggcgcggtcacctcggcgaccctggcgcccatgttgagcatctcatccccggccagcctttggagaatctgccgcgtgtggtgcttcgagcgtcgtgggtgctcgctcccgcgtgtgcatcgtcctcgagatcctcgccgagcgagtggtcgcgtcttggaggtcggccgcaggcgagcgtcgcctccggtcggtcggtccgatcagcacctcggggcaggagaggaccggtctcgcagccctcgggatgggttgggtgtccgtcggcatgcggtcgtccctcgtgccggcgaccagggtcaccctcgctagggtcgtctgtcgagggtgcggtcggtgacgggcagtgccatggtggctcgcgagcaggatggtccgtgagcgggagcatccgcggctgcgtgcacgtgcttggcgcgctcgattgcgaggcgtgctttggcaaccccgacacgcacacgatctcgtgcgaacgcgctgcgtgccagcgcgggcgatggctggaacagagtcagttgccctgggtgctgtcgtgccatgaccctctgcttagaccgagggtcggacggcctccatctcgctggcgttgacggcatcgatgagttggcgcaggcgtccgaacgagcgccggtcgaagcggagggcgaggcgcgggagatccggatggtcgtgctctcgcacctcccacggcgtcgcgcggacgcttcggatgcgaccgtcggtggtgatgtcgccgaaggcgacctcgaggtcggcgacgcgcgcgggggagagtctcccgttcagtctgaggatgaggtctcggccgacgacgcggagcgagtggaagactcgatagaagccgaacacctcggccagggcgtcgtcgatgtcgtccgagcggtgaagcagcgtgagatcgtcgcggtcggcaagcccccggtcgacgatgcgatcgttgagcagctgccacacgccgtcccagtagtgggatccagcgggctcgagcaggatcagaggggcgatctgcgtcttgcctgtctgcatgagcgtgaggagctcgaacgtctcgtccaaggtgccgagcccgccggggagggagatgaaggcatcggactcgcgcaccatgagtaccttgcgagtgaagaagtacttcatctccaacagtcggccgtgttcggcgagttcgtgatcgcctggttgttcgaggggaaggcggatgttgatcccgaaggcgtgatgaggtcctgcgccgcgcgccgccgcctccatgatgcctgggccgcccccggtgatgaccatccagccagcctgagcaaggcgggcgccgagcgtctcggcgagctggtagctcggctcgtcagggtgggtgcgagccgagccgaagaccgtcaccttgcgctgggttcgaaacgggccgaacgtctcgaatgcgctccggagttcgcggagcgctgaggtcagcatcttgaggtcgagtcggtcgaggggcgcttcggtggccgcgagcgcctcatcgaggaggagctgcttgaggtcactgtcacgtcccgcgaccgccggtacctggttgcggtggtggtcggatgtcatgagtgcgtgctcgcgatcgtgacgtccatcaggtgctcgtagaacgtcgttcgttggacgaggtggcggcctcgctgcgctgcgatcgcaccaagctcggcgacggtgagctcgctcgcgtgtgccgccccggctgcgtgcgaaatcgactcctccatgagcgtcccgccgaggtcgttcgcgccggcgtcgaggaggagcacggctccggcaggccccatcttcacccagctggcctggacgttgtcgataacaccgtggtaggcgatgcgccccaccgcgtggaggaggacggcctctcggagcgtcggaccccggcgggcacggccagcgaggaagatcggtgcgcccatgtggacgaaggggagaggcacgaactcggtaaaccctcgtgtgcgcgtaccgagcgcccgggtgcgcatgaggtgccgtgcggtgtgcgtggtcgtctcgaccgtcccgaacatgatcgtcacgttcgatcgcaagccgaccgcgtgtgcggtctcgtggacctcgagccactggtcggtggtcagcttctcggggcagatcaccgcacgtacctcgtcatcgaggatctcggcggccgttccgggcaggcttcgcacaccgcgggcggcgagctcgctgaggtaacggtcgaggggccagccgagtcgtcggctcccctcgaagacctcgagtgccgagaacgcgtggatgtgcatggccgggaagcgttcgtggatggcttcggcgatgtcgaggtacgtgccgccgtcgaagcgaggatggataccgccctggaggcagacctcggtcgcaccacgggcggctgcctcggcaaccttggcgaggatctgctccatcgacaggagatagggtgcgccacggagcgccaaggagcgcgggccgcgcgagaaggcgcagaacccgcagccgaaggtgcactggttggtgtagttgatgttccggttctgaacgaaggtgacgacgtcgccgttcgtctcgcgccgcagcgcatcggcgaggtcgatgaccgcctgtgcgtcggttccgcgcgcactgagggcgtgctcgagcagctcgagcgagggaccctctcccgatcgtgacgccgcttcgagctcgtcgaaccaaccggccggagctcgtcggctgacggtcaccacgcgcggggggaggggacctggtcgaccggagaaccactggtgctcgcgtgcgaagccatcgcgatccatggacgcgcgcactgcgggtcggagcgcgtcgtcgacggcgtcgtcacgtcgcgcgtactcggggtagagcgcgaggcgcggcacgaggtcgcggcctgcctcggcgaggcgacgctcgaggagctcgatctcgggccacgggcgttcggggttgacgtgatcgggggtgacccgcgagatgccgccgagatcgtcgatgcccgccgagaggagcccctcgatgtcgtccgagaggttcgggggtgcctgaacatggacggtcggtgggagcacgagacgcgcgagtgcgatggtacgcagatgggcctcgtgatcggcgggcggggcgtgccgcagtcgagtaccaggttttgggaggaagttctggacgatcacctcttggaggaagccggtctcctcggcgatggcggcgagggcttcgagtgcacggaggcgatcggcttcgctgtcaccgatgcccacgaggatgccgctggtcgtcggcacgtgctggagtgccatcgcacgtaccgttgcgaggcgcagatccggatccttgtcgggtgcgttgcggtggaccgggaggtccggtcggatggactcgagcatcgtgcccatcgagacggcgtgcggtcgtagcgacgcgacctcttcgggcgtgagcgtcccgggattgaggtgagggaggagtccctcggcgatcgcgacgtcagccgcggtgcggaggtagtccagggtggttgcagcgcccagcgaacgcagtgcatcgcgtgcgctggaccatcggagctcagggcgctcgccaagggtgaagagcgcctccgcagcgcccaccgccgcccccttgcgagccaacgcgcggacctcgtcgaggctcaggaaggcagatccgagtcgggcgggcacggtggcgaaggtgcagtagtcgcagcgatcgcggcacagacgcgtcaacgggatgaacaccttcggggagtaggtgatcctcggcccgaaggttcgatcgcgccgacgagcagcttcggcgagcagtcggttggtggaccactcgagcagcgccttggtcatggggtcaccctagccatcatggctgacgatcgagggatcgagcgcgctcgccgcggcagagtcgaggagccagatcgtgtcgtcgcgggtgacgtgcacgacggggaggtcggcaccgccgagcgccgctgcgacgatggttgccttggaggctccgagcgccacgatcacctgagtctcgaagcgcgcgagagcatcgcgtgtcagcgagaggcgccagtggcggttgtgtccgctcggatcgtgattgggtgtgacgaggcctgaggcatcgagacctggggagcccgggaacaggctggcggtgtggccgtcggccccgatccccagatggacgagcccccaggtgggacgcgactcgagctgcgcgccgtagcgggcagcgagcctgtcggcgagcttcggcactgtggccgggtcctccgtggcgagggttgcgaggtccgcgggcgtcagtgcatcggcatccaccatcggcaagagggccggaccgcgtccggtcaggaccgggccgaggtgtgtccagttcgcttcgggcgagccgggctcgacgagcctctcgtcgacctgcgcgatcgtgccggtgcgtgggaggctcggcccgagtgcgtccaagagggcgaggatcgtcgatccgccggagagcgcgaccaaggtgtcgcgttcgagcgcgtcgtggatgagtgccgcaaagcgcgttggcacgtcgttgctgacgatgacgcgagccatcgaacctcctcgtccggtcgccttccctgctagggtaggcgacgcggtggctgcggtcgcaggcagcacaaggacatcgaccgcgcgagcagctaggggagcagggtggatgcgcgaggcagatgaggttcgagacgtcctccgggtcgtcgggcgttacctcaagcaagagaccgtcgatccgttccgcgcgatcggtgccatggtcgtgtggggcctcgttgggtctgtgctcgctgccggcggcttcgtgctggcggggatcggactgttgcggctgctccagaccgagacgggaacgaccttcgccggccatctggactggctcccgtacgtgatcgtggtcgtggtgctcgcagttgtggtggcgatcgcggcagcgcgcattgggcgccgggcgaaggcgtaaggcgggaggacacatggcaaccgaaggccgggtaacgctcagcgacgtcgaggagcgcattcgctcgctgactgagcaggcgtctcgctccgccagtgcggtgcggcctgcggtccctggcgtcgccgggatcgcggtcgccgcggtcgtggtcgtcgcgttcgtgctcggttaccggcggggtcgtcgttcgagcgtcctcgagatcactcgcctgtgatggctgcatcccggcgcgtgctgcggtcgcttcgacgacagcgttcccgcctcgtcggtaccgtgctggggctcggcgggccagtggcgggcgtggtgtggggcatcgtcgcgctgcgttggatcgatcgacgcctgggtcggcgtacgagaacggcgcgcatcgatctctcccgtggcccggtgaccttgcgactgcgcgagcgtcggtgagcggggcattccaggtcggcgattcggtcttgctggtcgaccatcgcggtcgcgagaccgtggccgaactcaccgaggccggcgtcgtgcgcacggccgtgggtgaggtcgcgatgggtgatctcgtcggtcacgagccgggtgaggcggtcgtgacctcgaagggcaagcggatcctcgccgtacgtccgacgctcgccgagacggtggtccacatgccccggggcgcacagatcatctacccaaaggacgcgctggccatcctcggcgcgctcgatgtcgcccctggtcagcgggtcctcgagtgcggtgtcgggtctgggggcctgacggtctggctcgctcggctcggtgcgtcggtcgtggcggtggagcgcaggcccgattttgctcgacgtgctgagaagaacgtggcgcatctcggaggctcggagcgggtctcgatcatcgttggcgaactcgccgacgtggctccgccggggccctacgaccgggttgtgttggacatggtccatccgtgggaggtcatcccctggatcggggcagaactcgcccctgggggtcgcatcgtcgcctacgtgaccaacgcgctccagattcacgagacggtggaggcgctcgaggcgagcggctacgtccgcatcgaggtccgggagctcctcgagcgtcgttgggtggcacggggcgagatcgttcggccggagctgcggatggtggcacacaccggcttcatcgtgtcggctcacatcacgcctcgagcgcgtcggttggccgctgaacggccgcgcgagatcagcgtgtcgggtgtcgtcgatgacggctcgctcgacgagagcgcggacggcgacgtcgacgacgagctcatccaaacggaggaccgaccctaggactcacatcctcgtcggcgcgttctctgcgcagtctcaggcatgtcgtgaggggccggcgagtcgtgccgacgcgagcggccagacgggtcgtacgctgggtcgaccctgacggtgggtggagcaacccttggcccgaacgtcgacctcgacgagttcgttcgtctctcggcccgtatccgtcccgtatccgcgctgccggggaccgcgttcgccgcggggggcgaaggttgcgagttgtcggggttcagtccgcctcgatgaagatgcactcgccggggcactcttcgctggcctcggtcacggcgtcttcgagctcgaccggaaccgaggccatctgggcagagcccccagggttgttcaggacctcgccgttgtccttgacgtaggcgaggccgtcgtcgaggagcgtgaagacgggagggcagatctcctcgcagaggccatcgcccgtgcagagatcctggtcgatccacaccttcatcgaaaccctccatcgattgacgtcgcccacttgagactagtgggtactcacccagggaatcacgggagcgcgggaccgttgacggtgtcatggtgtcgtgcccatgcggtagtgtcgcggtggagggaggttagccatgccacgcgatgagaccccggaacgtgagcacgctgagcagcagtcccgccaagcgctcgaggaggaggtgcgcgaactccgccgacgtgtcgaggaggcaccgagtcgagttcgtgccctggaggagaagctcctcgaggtgtcgggagcgttggctcagacccaggcgaagaacgagaagctgaccttcacgctgcagcaggcacgagagcacatccagaacctgagggaagaggtcgagaagctgacgcagcccccgtctgcgtacggcgtctacctggcggccaaccaggatggtacggcggatgtcttcaccacgggccgcaagatgcgcgtggccgtgcaccccgagatcgacctggcagcggttcgcgtcggtcaggaagtcgtcctcaacgagtcgttcgccatcgtgtcggtgcgggggagcgacgtgatcggagaggtggcgacggtcaaggatgtgctcgacgacgggagtcgtgtgatcctgctcggacgggcggacgaggagcgggtggcgcaggtcgctggtcatctgcagcacccgccgctgcgcgtcggtgattcggtcatggtggatccgcgttcggcgatggtgctcgagcgactgccacggcccgaggtcagcgaactcgcgctcgaagaggtccctgacatcacctatcacgacatcggtgggctcgatcggcagatcgaggagatccaggacgccgtcgagttgccgttcctctaccgcgagctgttcggcgactatcggctccccgcccccaagggcatcctcctctatggccccccagggtgcggcaagacgctgatcgccaaggcggtcgccaactcgctcgccaagaaggtcgagcaggtctcgggccggagcgtgcgaagctacttcttgaacgtgaagggtcccgagctcctcaacaagtacgtcggtgagaccgagcgccagatccggttgatcttccaacgcgcacgcgagaaggccgaggaaggcgttccggtcatcgtgttcttcgacgagatggactcgctgtttcgcacacgaggctccggcatcagctccgacatggagtcgacggtggttccccagctgctcgcggagatcgacggcgtcgaagccttgcgcaacgtgatcgtgatcggcgcgtccaaccgagaggatctcatcgatccggcgatcttgcgcccgggtcgtctcgacgtgaagatcaagatcgagcggcccgacgagcaggccgcacgcgagatcttcgcgcgctatctcacgccggaggtcccgatcgatgcgggcgaggtcacgaccctcggcggtggcgatgcggagaaggccatcgcggtgatgatcgagcggaccgtcgagcgcatgtacgccacatcggacgagaaccgcttcctcgaggtcacctaccagaacggcgagaaggagatcctctacttcaaggacttctcgtcgggtgcgatgatcgagaacatcgtgcgacgggcgaagaagctcgccatcaagcgcgagatcgcgggcgggtcgcggggcatctgcctcgatgacctcctcgcctccatcgcgaaggagttcaaggagcacgaggatctccccaacacgaccaatcccgatgactgggcgaagatctccgggcgcaagggcgagcggatcgtgttcatgcggatcctcctccacgaggaggagggacagacgggtgggcgcgccatcgagcgcgtcgcgaccggtcagtacctgtaggtaccgagtagggaggtgcgatggcggtcgcaaaggttctcggcatcgaaaccgagtacggcatcaccgtgccgggggtgccggaggcgaaccccatcaccgcctcctcgagtctgatcaacggctaccttgcccagctcgccgggaggacgagctgggacttcgttgacgagtcgcctggccaagacgcgaggggcttcagcgtggataccggcggcaacatcgagctcgagacgcacctcgtcaacgcggtcctcacgaacggggctcgcctctacgtcgatcatgcgcacccggagtattcctcgccggagtgtcgcacaccgcgggaggcgaccctctacgacaaggctggcgaggaggtgatgcggcgagcaatggctggtgtcgccgcactgaaccctcatggaccagcgatcgtggtctacaagaacaactccgatcgcaagggcaactcctacggttgccacgagaactacctgatggatcgtcaggttccgttcggtcggatcgtcacggagctggtcccgttcttcgtgacgcgccagatcgtggtcggggccggcaaggtcgggtccgaagccccgggggtgtcgatccgcgaggttcccttccagctctcccagcgggccgacttcttcgaggaagaggtcgggctcgagaccacgctgaagcgtccgatcatcaacacgcgcgacgagccacactcggactcgcagcgcttccgacgtttgcacgtgatcctcggggacgcgaacctcagcgaggtggccacgtggctcaagctcgggaccacggccatggtgctcgccatgatcgaggacggtgagctcgaggacctcgggatctccatcgtcgacccggttggctccctacggcgcctgtcgtgggaccccacgctcaaggccaccgtgacgttggccgatgggcgcaccatgcgtggtctcgacgtgcagtgggcctatcgagagcgcgcagagcgctggctcgatcgcttcggcggcgaggccctcggtggcgatgacgaggcccacgcgatcctcgaggagtggacggatgtcctcggcacactcgagcgcgaccccatgagtcttgccgatcgtctcgattgggtcgcgaagtggtccctcgtgcagggctacatggagcgacaccacctcgatatcactgatgccaggatcgccgcgctggatctgcagtaccacgatgtccgcccggagcgatcgctgcagcgccgtcttcgcatgcgaagactgacgaccgacgaggaggtcgcgcgcgcgacgacggagccgccgccgagcactcgggcctactttcgcggtcggtgcctcgcgcggtttccgtcccaggtcgcagccgcgaactgggactcgatgatcttcgacgtcggcagcgatccgcttcgacgcgtgccgatgatggatccactgcgagggacgaaggaactcgtcggaacgctcctcgagtcggtgggctcggtggacgagctactcgaggcgcttggggcctaacatacctagtgaggtgatcatcgtggctgagcgcgaacaggtcagacggagtgggacggagcgcgaggaggaggccgaagaggtctcgacgcagagcgcggcgagctctgacaagctcaaggccgagatcgacgacatcctcgacgagatcgatgaggtgctcgaggacaacgccgaggagttcgtccgcaactacgtccaaaagggtggcgagtagcggtcgggtgaactgacgggctcgagggccgacgacggtcggcctgagcacggggccgacgacggtcggcctgagcatgaggaaggatggagcaaggttggcgttaccgctctttgaccctcggcacgacccggggccggattttgccgcactcgtctcgcgggacgcggctcgcaccgtgccgacgtcgggcgatggttcgctcggcgctcaggtgccgcacgggaccaccatcgcggcactgcgctttgccggcggcgtcgtgatcgctggcgaccgtcgcgcgaccgaggggaacttcatcgccaatcgtaccatcgagaaggtcttcccggccgatcgcttctcgggcgtcgggatcgccggtgccgcgggtccggccgtcgagatggtgcggatcttccaagtgcaactcgagcactacgagaaggtcgagggcaaggcgctctcgctcgagggcaaggccaatcagctcgcccagatgatccgccagaacctcccgctcgcgatgcagggcctcgtggtgatgccgttgttcgcgggctgggacgcagagcgcagcgagggtcggatcttcaccttcgacgtcgcggggggccgctacgaggaggtcgcctactacgcgatcgggtcggggggtcgtgatgctcgcgcgaccttgaagctcggatggcggcccggcctcgacgaggcaggggctgtccaccttgcggtccaggcgctgtacgaagcagcccaggaggacgccgcgaccggtggacccgatgcgctgcggggcatcttcccggtggtcgcggtgatcgaccgcgagggttaccggcgcatcgacgacgctcgcctcgaggagatcgcggtcgaactcgaccaggccgtgagggagcgaggtgcgcggcgatgagcatgccgttctacgtcgcgcccgaacagctcatgaaggatcgggcggactatgcccgcaagggcatcgctcggggacgagcgctgatcggcgccgtctgggaaggtggcatcattatcgtcgccgagaacccgtccagatcgctgcacaagctgtcggagatctacgatcgcatcgccttcggcggcgtcggcaagtacaacgagttcgaccagctccgcgtcgctgggattcgtcacgccgacctcaagggctacgcctatgcacgagaggacgtcgacgctcgcagtctcgccaatctctacgcgcagtaccttggcacggtgttcacgcacgagatgaagccgctcgaggtcgagatcctcgtggcggagctcggcaacggacatcgggagtcgcagctgttccagatcctctacgacggcaccgtgatggacgagcgcgagttcgctgtgctcgggggcgatgccgacgcgatcgcggagcgcttccgtgcgctctacgacgcgagtggtccgagggagcggctgctccagagcgcgcgagacgcgctcagtgggcaacgtcctccgatcggggccgacgatctcgaggtcgtggtgctcgaggatcgaggcgagcgtcgctgcttccgacgcctcgaggtcgacgaggtgcgcgaggcgctgggcgatcagccggaggggagtgcctgagtgccccgcttggcacggcggatctacggcatcgagaacgagtacggcatcacctgcacccagcgtggccagcgtcgcctgagtcccgacgaggttgctcgctacctgttccggcgcgtcgtgagctggggccgctcctcgaacgtgttcctcgagaacggcgcgcggttgtacctggacgtcggcagccacccggagtacgcgaccccagagtgcgactccctgagcgatctcgtcgcccatgacaaggcgggggagcggatcctcgagtccttggcccattctgccgaggccaagatgcgcgaagagggcatccgcggtgacgtcttcttgttgaagaacaacaccgattcggccggcaactcctacggctgtcacgagaactacctcacggtccgcgtcgacgacctgacccggctcgtcgaggtcctgatcccgttcctcgtgtcgcgtcagatcatcgccggcgcgggcaaggtgctgctcacctcgcgcggtccgctctatgcggtctcgcagcgagccgagcacatctgggagggcgtgtcctcggcgacgacgcggtcacgtccgatcatcaacacgcgcgacgagccgcacgcagatgccgagcgctatcgacggctgcacgtgatcgtcggggactcgaacatgtcgcagtgggcgacctacctcaaggtcggagccatggcgatcgtgctgcgtcttctcgaagaggaggtcgtcctccgcgatctcacgctcgagaatcccattcgggccatccgagagatcgcccacgacaccgaactcgagcgcacggttcggctcgtcaacggtcgcgaactcacagggctcgagatccaagaggcctacttcgagcgggcggagcgctaccacgagcggatcggtctgcctgcggacgaggcgcgcgcactcgacatgtggcgcgaggcgctgaaggcgctgcgcgcgaacgatcacgaggcgctctttggcaaggtggactgggtcaccaagctcaccttgatcgaggcctttcgggcgcgtcatcagctcccgctgtcgcatccgcaggtgtcgctgctggacctgcagtatcacgacatcagccgcgagcgaggcctctttgctcggctcgaggccaagggtcgggttccgcggatcgtcgacgacgagaccatcgagcgtgccgtcgacgaacctccggcgacgacgcgggcggcgctgcgggggcgcttcattcgtgcagcgaaggaggcgcaccgcgactacacggtcgactgggtgcacctcaagctgaacgaccaggcgcagcgaacggtgatgctgaaggatccgttcgcgtccgaggacgagcgcgtggatcggttgctgacctcgatctgatggctcgccgtcgccgagcgggctggctcgcactggcgctcctcgtcgtggcggccgtgctggcggtgcgcgcatgggtgctcacgccgttcgtcgtccccaccggttcgatgcgaccgaccatccgtcccgggtcgtggatcctcgtcgatcgactcgccttcgacacacaccccatcgaggtcggtgacgtcgtggtgcttcggcgaccggccgacgatccgggggaggcgaactcggactacctcgtcaagcgggtgatcggcctgcccggtcagacgatcgccagccgcggggggcacgtcgtggtcgacggacgggtcctcgcggagccctatctgcctcgcggcgatcggacggagggcatcgtgccccagacgatcccgcggggcgaatacttcgtgctcggtgacgatcgcggcgattcggtggattcgcgcatctttggacccgtgccagcctccagcatcgtgggcgaggtcgtcgcggtggtatggccgccgagccaagcacacgtcgttcggtcgtagctgtgcccgggcgtcaggcgttcccgcgttcgccggcgatgcccttgcgaaggaagtccacccaaccgggcgtctcgagggcgtcgcgcagcgatgccgcatcgtgttcgtcgagtggggggccgtcgtggtgttcggagagctcctcgggcagccgccagaactgcagccgtacgccggctgcgaccagcacctcgacgatgcgccgttcgaccggtttggcgacgatgaacccgcagctcggacagcggaacgtgtacgaggcttcgccgttcgaggagcagagcatgatcttgacacgcccgggcgcgacctcgacgtccccgcactctgggcacgaggccttgatgatcggcatgggcgactcccttcgcaaccgcgcgtccgtgacagagggtctatcggcacgcgcggcgccggtgttgagtgctgcggccgtcgacctcgacgcgactccaagagaatgtgccgtgtgcaggtagactcacgccggtgacgcagtctctgcgagcgaaccgtgtgctctcgggcgtgcagcccaccggcgtgggtcatctcggcacgctgctgggtgcgttcatgaactttctcgccgaccaggagcgggcggagtgcatcttcctcgtcgcggatctgcacagcctcaccgtcgaccaggaccctgcggcgcttcggcgccagcgttacgagctggtggcgaccttccttgcggtgggcatcgaccctttgaagtcgaccatcgtgatgcagagtgaggtgcccgagcatgccgaactcgcctgggtgatggagtcgaccgcgacctatggcgagctcgcacggatgacgcagttcaaggacaagtccgctcgccagacgaaggtgcgcgcgtcgctgttcacctaccccgcgctgatggcggcggacatcttgctctatcaggccgatgtcgtgccggtgggcgaggaccagctccagcatctcgagctgacgcggaccctcgccgagcgcttcaacggcgcctatggcccgaccttcacggttccgaagggtcagcttccgacccatgccgcacgcgtgatggacctcgccgagccgacgtcgaagatgagcaagtcctcctcctcgcaagcgggcatcgtgttcctgaccgacgacgacgcgacgattcggcgcaagttcctccgcgctcgtacggattcgttcgccgaggtcgtctggaagccagacgacccgtcccgtgccggtgtgaccaacctcgtcgagatcctcgccgcgctcgagggcaccgacgcatccagcgtcgctgctcgcttcgatcgctacggaccgttgaaggaagcggtcgcggaggcggcggtggccgccatcgccccggtgagagagcgcttcatggccctgcgcgacgacgaggcgaccctgcggggcgtgctcgaccaggggcgtgagcgcgcccgggacatcgcccgcacgacgatggccgtggtgcgcgatcgcctgggcctgacctgacgaggcgtggagggaccagcgtggatccggccaaggtgctgttcatcgccgtcgcggcgctcatcgtgctcgggcccgagcgcctaccggcggtcgcgcggcgtgcgggcgagctgtggtcgctcgcacggtcgccgacggagtgggtcgcgaagcatctcggcgaggtcgcgcacgcagccgggatccccgaggacgtgctgcgcatcggtttgccaggaggcctggatcgctggctgatggcttcgggccccgccacgagtgcgtcggcccaaggccccgcggctccggcgtcgccccctcctggccaggcctcctcggcgacgccgacgggcgccgcatcgatcgtggcgggaccctgggagctgaactagtggcgctgcggcggccacgacggcgccgtctcgaccccaacgcgatgaccaccgtggagcacctgcgggagctgcgacgtcgcctgattcgcgccatcgtcgcggtcaccatcggcgccatcgcggcctatgcggtctacccgcacctgttgtcggtcctgaccgaaccgttgtgtacggtcgagcacgaaccgcactgcgtgctgtacgtgaccggaccgatcgatgggttcgcgatccgtctcaaggtggccgcggtggcggggctgttcctcgcctccccgatcgtgctctgggagctgtggcgcttcgtcgctcccggcctcaagcggggcgagcgacgcctgacgctggggtttctcgtgtcgtcggtcgcgctgttcgtggcgggcggcgtggtggcgtggttggtctatccacgcgccctcgggttcttccagtcggccgcgggcgcccaggtgcacgcgatctacacgccgcagagctacctgtcgctgttgctgatcctcatgatcgccttcggcgtcgccttcttgttcccggtcgtgctggtcggcctcgaactcgctggcgtggtgagtccggccgcgttgcggcggcaccggcgtcccgcgtggctcgggatcatcgtggtggtggcgatcctcatccccagtaacgatccctactccttgaccgcgatgacggtgccgctcctcgtgttctacgagctgtcgatcgtggtcggttcggcgctcaccaagcggcgggcacgcgtcgccgacgccggaggctaagctcgtcctcgacggggaggctccgctggtatctaccttccgcagccgattcgccgaaacgctcggcttggtcatggatcggttccaggacgaggccctcgaggcgctcgacgaagggtcttccgtcctcgtcagcgctcccaccggttccggcaagaccatcgtcgcgctctatggcatggcccaggcccttcgacagggacggcgagccttctacacgtccccgctcaaggcgctgtccaaccagaagtaccacgagctcgcccgtttcttcggtcctcagcacgtcgggttgctcactggggacaccacgctgaacccggacgcgcctgccgtcgtgatgacgaccgaggtgctgcggaacatgatctacgcctcgccagccgcgatcgacgacgtcgacgtcgtggtgctcgacgaggtccactacctccagaacccgtaccggggatcggtgtgggaggaggtcatcatccacttgccgcgccgcgtccgcctcgtctcgttgtcggcgacggtgtcgaacgtggcggagttcgctggctggttggccgccgttcgaggtacgacgcgcgtcgtggaggcgacccaccgccccgtcccgctcgagcatcgctacctctacacgccgcggcgttcggagacgccggtcgcgataccggtcctcgtcggtgggagggagaacccccagggggcacagctcgatccaccctggctcgcgcgcagtcgttaccgagacgggcttcgggctcggacggtccatcggatcgagctcgtcgagttcctcgctcacgagggcgatctgcctgccatcgtgttcatcttctcccgtgctgggtgcgagcgcgcccgcgatgaggtggtcgcctccggcattcgactcaccaccgcggccgagcgggtcgcgatcaggcgcatcgtcgacgagcgtctcgacgggttggccgagcgcgacctcgcggccgtcgggttcgcgccgttcctcgcgggactcgaggcgggcatcgcgccccaccacgcgggcatgatcccgccgtttcgcgaggtcgtcgaggcgtgcttcgagcgcgcgctcgtcaaggtggtgttcgcgaccgagacgctctcgctggggatcaacatgccggcccgatcggtcgtcatcgagcgcctggtcaagttcgacggggagtcccaccagctgctcaagcccggcgaatacacgcagttcgctggacgggcagggcgtcgggggatcgacgagcgcggcaccagctacgtcgtgtggggtccgcaggtcgccttcagcgacgtcgcgcacgtcgtccgggcggacttctacccgatcacgagttcgttccgtcccacctacaacatggcggcgaacctcgtgaagcgctacacgcccgagcgcgcagctgagctgctcgatctctcattcgcgcagtaccagcgagacgccgaggtcgtccggcgccaggcgcggttgcgagcaggcaacgaggatgtcgtcgcggcgacgacgcagccggagcgcgctgagtggatcgagccgggtcgggtggtgagcgtcccgagcgagcgcggcggtgccgagcgagcgctgctgctcatcacgcgggtgtcccagcggcgcggtggcgggcttcggatcagtgcgtcctcggagtcgggcagggtgtatcgcctcgacgaggggcacgtcgcctcgatgcgacccaagggcaaggtgcgcctccgtgcggtgcacggctcccgggaccaggggatcgccatggcctgggcacggatccgggcgcggcgtcagcaggcgcgggagctcggcgaaccgtcgaaggcattcctcgacgagcgtgcgcgtggtcgtcgcaccgacgcgccagcgccgtcgccccgttcgcgtgagttgctctcggaacagctcgagcgtgtgcgcacggtgctcgagcgcttcggcttcgccgaggggtggagcctgacgcagcgaggcgagcgactgacgaaggtctacgtcgagacggacctcgcggtcgtcaggttcctccacgacgccgagatcgacggcgtcggcccggcggagttcgccgcgatcgcctcgtggttcgtgttcgaaccacgacctcattcgccccgatccggtccgtggccagcgagcgcggccatggcgcggctctacgagcgggccgaggcgctcatgcaggagcagtgggcggcggagtcgtcgctcagactgcctcgatcgcgcggtccagagcccgggatctctcgcgccctctggcggtgggcgcggggagagccgctgggggcagtgctcgcgaccgacgagatggcaccaggggactttgttcgcgtggtcaaacaggtcgcggacttgcttcgccagatcgcggtcgcctgggacgacgatgtggtctcgtcgctcgctcggcgagccgaggcggcggtcgttcgcggcgtggtggcgctgtcgtcggaggtcgtcgccgaggatcccgagcgcatgccccacggagtgctcgagctcgacgagcggccggcgtaggctggcccgctgtggcgagctaccttcctgagcagttcgacgaggcggagcgggcgcggctcgctcctttcgtcaccgacgtcgacggtcgtgtgttcggtctggtgggcctcgacgaggaggtcgtcgcagccctgttcgcacgctactcgcgcacgtccaggtcgcttcggcggacgctgctggaggagttcgcgccgagggtcgaggacgcggtgcgagcgggcgtcggtcgtgagcgcaccgaggctctccttgcccgcgtgatcggcgagtacggcgacgactcggtcgcccaactcgcggtcgtgcacttcgcgatcgagcagatcccggccttgctcgcgcgccgcatcgagcgcggccgtcttgcggcctatctcgagcaatccactcgctacgtgccgctcgcgactcgccgttcggatgggagttggccagcttacgtccccgacggcctcgcgccgcgggcggcgcgtgcctacgacgaggccatcgaggcgagctttcgtgcctatgcggcggtcctcgaggcggtcgaagaccatctcgcgaagctcgatccaccggccgatgcgccggctcgtcgtgcgcagcgggccgccgcactggatgcagcgcgcgggttgctgccgctcgccgtcttgaccaacgtcggtgtcgtcgccagcgcgcaggcggccgagcgcttggtgtggcggctccgggccgacgccacgcctggggcgagcgaggttgccgacgagatcgcccgggtcctcggagtgctcgtaccgggcctcacccagcgcatggaccgccccgaccgcggtgggcggatggtcgagtatctgcgcgagacgcggggcggcgtcgaggttccgtggcactggaacacggcgatcgtcgaaccctccgttcggatcgtccgagccgacgaggatgcggagcgccgcgtcgctgcatggatgctgttcgagcgtggcgaggtggactcggtcgaccagggccttgccgcggtggaggcgcggggcgaggagggcctcgatgcgctgttcgtggccggcgtcggccatcgggccaatcgccgccacctgcccgggcgccccttcgaggctgcggtgtacgagctcgagatcacctgcgacatcggagcctttcgcgacctcgcccgccatcgcatcttgaccctgctcgagccaccgctcgtgccgggtcgtgggttcgcgctctccgatctcgtcgtcgacgcaggcgtcgcaccgctcgtgctcgagcattgggagcgactcggcccgctggtcgcgagcgtggtcgccgaggccggaccgtcggtgggtcggttgctcttgccgttcgcgacgcagatccgcttcgcggtcgtggtgaacgcgcgggagctgatgcacctcgtcgagctgcgatcgcagccgcagggtcacccggtctatcgccgcatcgcgatcgaggcctggcgcgcgctcgaggcggtcgggcatcgccggatcgcaggggccatggagttcgtggacacagagggctacactgtgggccgcctcgccgccgagcgacggagcgaggtgcgatcgatgcagtcgggaaggatcagcggggctgatccgttgagctagccgagctggtgcgcgaccggctccgtgcgaggaggacgaggacgagtatgccgagacgcaagggcgacgagtcggcatcggaaccggaggttccacacgacgacgagctcgacgaggagctggtgggcttcgacgacgatctcgatggtgacctcgacgacgacgtcgacgaggaactcgaagatctcgacgaagagatcgaggaagagggcctcgaggttggcgatctcgaggatctcgaggccgatgatctcggcgaggccgacgacatcgtcgacgatggtgtcgacgacaccgaggacggcgaggtcgccgttgtcgacgaggaggacgacgatctcgagggcgacgaggacgtcgagtcggccctcgacgagattctgagggagcgcttcgtcggcggtgacgtcgaagaagatgtcgaggccgagtcggacgaagacacgcccgatggtctcgccccggtacggcctcgccaacccggcgagttcgtgtgccagtcgtgcttccttgtcaagagcatgtcgcagctggcagactccgagaagatgctgtgccgcgattgcgtctagacggatcggtggcaccgtaagcttgaggttggccccaaaggaggcgctatggcagagcagcaacgtcgacagctgttcgatgatgtcctcgatcgcttcgtgttcggcccggtcggtgtcgccgctgcggtggcacgggtgctaccgagcgcggcggaggagggtcgcaaggtcctgcagggaccgatccagactgcgcagttcgtctcccagatggccgctggggtcgtacgggcacgctacggcgagcagttgcggggagtcgaggagcgtctcggcgacgtgagcgagcgcgtctcggcactgcgttcgatggtcgagcaggttggcggcgggatcgtgcgcaccgtccagcagaccgtgccccggccgggtgcgggcccacgcgatgcggctcccgatgccgaagccgcatcggccgccacgcgcgaggcgaggccgtcggatgcgcacgcaactggggaggaccacgccggcagtgtcggtgggatcgatgcctacgcgaccctgtcggccgccgaggtgatcgagcggctcggatccttgagcgcggagcagctcgccgaggtcgagctgttcgagctcgatcaccggcgccgccgcacggtgctcgcgcgcatcgcgaagctccgtgaggagcgtggctaggccgcctcaggcattgagaggtgcctcaggcgatgaggccgaggcgctcgaggagcgagcgcacgcccggagccagggggcgaaggtgacgaaggtcgtctggcccgaaccagccgagagcatcggcgtctgaacgcgcattcccacgcgctcgcccccgcggtgtcgcgagcacggtccagagcacgtacgcgccgcgatcggcgagcacctcggcaacctggaggacgcgcactggcgcggcgtggacgccggtctcctccgccagttcgcggatcgccgcggcgaccgggtcctcccccgggtcgacgtgcccaccgggtggggcccaggtcccgttcgcgtccggagagccgcgccgcacgagcagcacgcgcccatcgaggacgaggagcgtcgaggcaccgcgctggacggggagggcgaggcgcgccacgacagcgggcctaggcgaggcttcgagcgagccggagctccaccgttcgaagtccagcctcctcgaagagggccttcgttgcccggtcgccgggtgcgcaacttgcgctgaggacggtggcgccgtgccggcgagcgagttccgcgcaggcttcgaggagctcgccggccaagcccaacctctcgaagccgggcatcgtgacgatcgcgcgcacgatggcctcggggccgttgcgctccacgatggcgatcgctccgactactccgtcgacctcggcatcgacgcgccaggcgtggtcgggccgaagttcctcggcgacgagcacactggccatgggagcctcagtcgtgggtcggcgtcgcctcggcggcggagacgtcggaagggtcatcgccgggcaccgcctcgtcgatgtgcgacggtgctgccgcttcgggttcgccgatggtgtggtcctcgacgtctcgaacggcgtcggctgccgcgagctcgtcgtgtggtcctgcggggtgaggggatggagcagagacggtctcgtcgacggcgacggtcgtcgcagggtcgatgtcgcgggtcgatgtgtccggctccgcgtcagccggctcgggctgggcgccgacgagggtgtcgtcgggagtcgccaacgattggggctcggcctgacgagcgcccgttgcagcgccggcgtccgtggactcggcgtggccccgcccggcatcgtcacgttgcgtggagccctggcggggtttgcgcgaagtcttgggaacccgagcgaggatctctggcttcgggggcgccggcatcgtgaccccgagcaggcgtccgagcgacgggatgcggccggcctgttccttggcgagttcgacgagttcggcaggcgcggcctccggcagaccggtcgcggtgacggctcggcggatcggcgagttcgcgatcgcatcgatcaggaccatccagcgctctggcggggtgtcggggatcagttcgcgatcgacggcctcgacgagggcgcgctcgacgtcgtcggggatgcgtgcactcggatcaggcaggcgactcgccagccgcagcgctcgcacggtacggccggactcgacggcctcgcggagttcggcatgccagcgctcgatgctctcggcgatgcggcggttcagcacctcgcggagcgtggtggccttgtcgaggacgctcgggtccttcgacgacggatcgacggaggccaccacgctgcgcagatcgcgaagggcgacggtgttggcgatggcgagtgcggcgtcggcccgatcgagccaggtcgccgtgcgcacccgaggcaggagatcctcggcgatcttgagcgtggcctcctcaggcgctggcgcgcggccctcatgagcggcggcctcgcgatcgcgcgcgatggctgcgcgaacctcgggcatgccgccgcgcaccagtgcctctgcgatcggccggtgctcggggatgacgctctcgaggaatgcgcgtcggtgggtgtcgcgtggccgaaggcgtggtgccgctggtgcttcgggctgagcgggccgtgcgtcgcggcggcgagaacgctgaggggtcgctccctccgcgcgcgcgctttggtcgtgctggtcgtgctggtcgcgattgctgcctggacgtccacggcgctcggcgcgacggtcctgacgcggccgaccgtcgcggtcgtgggtgcctcgagcacccggccgtcgctctcggcggacggtctggatggtgacgggaggttccgcgcgtcccgaccccacgatgtcgatgcggtcggtgcgaggcggcgcgacgtcgggccgagccaggctgaggatctcgatgccgtcgaggcggcgcgcgatctcggcccgcgcgacatcgccgacgctcgcaccctcccacacgagcgaagccggtaccgtgccgcgcggatgtcgtgcgccgacggcgcgccaggtccactcgccacgcgctgcgtcgtggctcgtgagctcgacctcgatcctcgatgccatgtcccaagaacccttcttgctcacccgatgctcggcatgtcgccggtgcctgcgccatcctagtgtgcgcgctcgtgggcgtcggagggtcactgggggcgctcgggtgccctcggaaggggccccacggcgcccgtggattcgccgccccgaggggccggtcgtgggcgccggctcctcggatcggagcctgtcaatctctagtcaatctctaagaggcaccccgggctcgatgttcactgtgtcgtcgctgcctcctccggcgggttgatccggaccgctgcacggagccggggtggctcgggccgcctctgcacgaggcgttcggggtgggcacgcaaggcagccgcgagcacctcggcccggtgtgctcggagctcctcggcacggccgtcgacgtctgccggggtgtggagtccgattccagaatgacggtgctcgtggttgtaccagcggaagaagcgctcgcaccaggctctcgcgtcctcgtagcagccgaagcgccgggggtcgtcaggtcggtacttcatggtcttgaactgagactcgctcctacgggttgtcgttggaggtgtggggcggctatggctccgcgtcaccccgaggtgcgagagcaggtgtgcgacgggccccgcgatcatgggacctcctctgtctgcgtggatggtgagctgccctggtcggatgccctggctggccacggtctctcccaagagagcgaccgccaggctggcgtgctccgcgcgggcgagcatccagcccacgacgcaagcggctgtcgatgtcgatcacggtggagaggtagtagtggatccacgtggcagggccgtgcagcttcgtaatgtcccacgagtagacctggttccttctcgtggccacgagctcgggcttgaggctcgggggatgggtcgcatggcgtcgccggtctccgagcgcccgtgggcgcgcagtatgcgatccatcgaggacacggaggcgaggtagatcccctcgtcgaggagcttcgcgtacaccgtggccggggcctcatccacgtactccgggctgttcaggacgcggcgcacctcctcgcgctcgcgcggtgagagtgcccgtgggtgagggacacgtgcacgcttcggccggggtggccgggggctcgcagggtgccgtcggtcgtagcgggcacggggctcgccgagggccgagcaggctgcgcgtaccccgaccgttggcgccagttcgctgatggcctcgtcgatcacgtggtctcgccgtgggtcgcgggcgcgccgtcggtggcgagctgctgcaggcgcgcggagagttttccctgcacctcgatcaccttgtgggccttggcgaggtcggcctcgaggcgctcggcgcggcgcctgaggcgtgcgatctcctggtcgcggggatcagcgggttggcgtcctggtggacgtgcgagtgcctcctcggtggcaaggtcgcgttggcgtcgccactcggtgatgagtgaggagtgcaagccctctctccggagcagggctcccttctcggcctttgcaaagggagtcgtagtcggcgaagatccgtgccttgtaggccgcggagaagcgtctcggccctcgggcccgctcggggacctgcggatcggagttgctgggcatgcccccagtctggtagggactcgtcgtggcgtcggtcgtcatggtggtggcaagctccttcctcggccgccctctcgatccaacgatggggtcaggaggagtggtctcacccaagattgacacggagggtaaccccgaaccgctggcggtgccgaggtcagcggattcccccggccagctcctcagcgcacgtcgctgtcgagggggcgctctgccaccagctgcttggcgcgctggggctggcctcgagcgccttcagcctctttacctcgggccccgtgcctgccgccgtcggtctgcttccagccgctgtcaggtcgtctcggtgacgtgcgaaggctcgggcgacctcggcgaccgtggcgcctgtggtgcgcagccgtccccctcggccagcctccggaggaggctgctggtggggtgtggcgctgcctgcccttcatgtggtctcttcctcccactcgtccatgctggtcggggtgctcatggaacgggtggtctcgttgcaggagggccggccagggtactcgatgatcgcgaggtggtcgacgcggtctgtggaggtgcaggcttgccgacgacgctgggtgcaccagccgcaccagcgctcggcggcgtggcgctgtggcttggtggccacgagatcgtcgtggagggggtacggaggcccagctacggcgtggacgacgcagctggtagtgccgtcgtgacggcgtcggctccgcccaggcgctcctggacgcctgttgaaggctacttcacggtcacgttgcagccaacccaagggcaccaccgccgtccggctcagctccctcccctgccagatgacaaccgccgggacaacaacttgtcatcttttcgtccgggtcgtgaggctgaggctatactccgctcaggcgcctccgcaaaggtcgtacggctcgagggctctcggggctcatcgctgcgcgtctcctccgaagggagccgagatatgcacccgtctaagcagatgaccttcttgcgcaaggaactcgcccttggcacgatcctgacgtctgcgctggccttcttacttttctcacccttgggtacaaccagcgtggctgcgtcgaaaacggcagtcgccccgatgcccgcaccatcaggcgacccttctcagcctgccggtatttgttgcagtacccagaacttgggatccaccatcggtgaaggcactgttctcaatcccggcgactatctactctcaagttctggacaataccagctcatcatgcaaggcgacggcaactttgtcctctacaacttgtacaacggtcaagcattgtgggcgactggtactgaagagcactctggcgcctacgcagtgtttcagaacgacggcaaccttgttgtttacttcaatgggactgcgctgtgggatagccatacgtatacctactctggtctgacactgacaatgcagaacgatggcaacgcagtcatctatcaaggtacccagccgctatgggcaacggatacagctgcgaacgagttggactgttggccttccaacaactgcacacccggcttgttcatctatgcctatcttcaattcccgccaacagcgccgttgcagggagtgaacgcaccgacaacgggtgccaacacgtttgcgatgtccaagtgggaacaacaagaagacagcgtcattcagtcaaaccctctcgacacgacgcaaaaggagcctggctcctacaccctgaagggcaactctgccaacgttcaagtgtatacgaattctgatggtgagtccgctgattactggggcattgacgcatttgatcagactatttcttaccttccatattatgggccgattatctcggttcttagaaatccagtgaacagtccctaccagcaatgcgtcaatctcgcgaatgctgtaagcagcaccctttgggggacgattaatttctcagatctgtgttagcttcctactgcaaagatgaggaggtgtgatgtccactgcatggaaccgcacggtgaagattggcggggttgtcagttcgtgtcttgccttagtggctcttgctgctgttgctggccgagtcgaggatggccacgccgctcaacaccgcggacatcagcagtcacccgttgcgagaacagctacggcgccctcagtacaggtggctactgggcaaagagcagggcagtcaaaggatgctgctgccgcaggtgatccaagctactttacccccacgctatcaggtgttgaaacgggtgatcctgccttgccagttggccactactgggaatacgtgccagcggtagtgcccggcgttccggagagaccatcgtacatgttgacgatcacacaaagtgggagtgatggacagatcgcgggcatggtctatatcttctacgaggatgggaagcttgataccgtgtttccgttctctggcctcgtggatgcgacgactggcaagggtagtatcacagtgagtggcgctccaactgtggtgtcatacaacggcgtgatcttctacgatcaatctacggtgcaatctggtcagcagctgccagtggtcgtcagccatggcgacatcacgttccctgggtgttcgaactatctgcactggctgatggccgggagttcagcatcacctgctctgctcgcggcaatagcaagtgatccgaatgtgtgcacgttctacccgactggtggcgaggcctacccaagcgagtcgcagatacccgttaccccttaggggatcggtgcgtgggaagcggagggcggagagcatcttggcgcctcgtgttagttggtgtctcagtaccctcggccggctctcctgaccggccccccgcaccgagtccaccttcaccgtgagacccagcgtcgtcatgccagcgctcgttgattccactgagcgccgatgacgccgagcgggcagcacctctgacccctcgcggaggcctcgaggatccgtcgctgggtggcgacgtcgaggcgggcgaaccgggcggggctgcggtcccccggcgatctgggcgtccgcgtcgtgctggggggtgccggtcgtgctcgaggagctgcctggcctcgcgaacgccaggcgacgcgctccccatcgagcacctcctcgcggacctgggcacccagcgatgcgcacaccccgttctgccacggcgagcccgggtcctggacacctgggcagccgagctcggctgcccaggtggtcatgcacgcggccacgcacgccgggccgtcctcgacccggaggacgcctagggttcctcgctcggcgaggaggccatcgagggtggcgacacgtcgtgcgcgtcaatcgagcgcttcaccacgcacagccagctcctccgtcgtgggggcgtccaccacggcgagcacccagggcgccctcccgtcgtcggtcgcgtcgaaccggctccagtgcccaggtcgcgttcgtctggatgggcaggtgagcgcccatgggcaccccaggtcgtggttggcgccgtctcgtgcgtgactggggacccggagccctgccgtgcgccagagccggtgcacccatttgaggttcacctggtagccagcctccctcaccgctcggtaggccttgcgatagccctggcgggagttggctagggcgaaggtgcgcaggacctcatgctggccgcatccaagctggactcgggcttcgtcggcacccgacgctgggtggagcgaggctgggccgtcagccggcacgctcgtcgctcgtgcaccccgaaccgccggcggtgccggggtcagcaggttccctcggccagcctccggaggaggctgctacctgggtggcacgctgcctgcccttcatgcgctctccctcccgctcgtccatgctggtcggggtgctcacggagggggtggtctcgttgcaggggggccggccaagatcacctcgtatcggtgccggtgccaccaggcgtatggcaccagcgagcggtgatcctcgtaaggcggtcaggtaagtccaggtcagagctgctatggttgagggtcggtagcaacgacccctcggggtcgtcctcgttggagcagggcgtcccagaagaccggatcgtcggcattcaccacgtggcaacgaccccgagcggtcgtcctcgttggagcttcgatgacaccccgctcaccatgtagcggcggctcaagtagcaacgagcccgcggggtcgtcctcgttggagctcggcgacgcagggcccagcccccgacccgtgaccgcggctacgccgtgtgctggaacacggcctgctcgagccgacggaggcgctcggcaacgctcagctcgccccctcctcctcggcgcggagccgatcgagtgcccagattcggatcaacgtggagactggcaggtgctccttggcggcagcgcgttgcagccgggcgtgctcgtcagcggacaaccgcaccgacaccacggtcgggcgagtgaggttgggtcgtgcgaccgtgacgcctgcgggcacggtgtcggcgaggtcgtgctgctccgccgccgctccctcctcggccacgtggagcatgacgcttgccgcccttcaggtcggcgccctcctacgagtccctgctcgtcgggaccgccgcaggccgagtgcaaggatgtagcgtgaacagcgagaggaaggaccccatgccccgccgtaccaccaaggactgcatcctcgcctacctcgccgcccgcccgaacgaggtggccttcgtgcgctccgagttcgctcagtgcgcgaagagtcgctcggccgtggaccgagcgctgcgcgccctcatcgacgaggaggtgctcgtgcgcggcggctggggcatctacgtgcgggccaagcgtgtcgagttccttggtcgtgagtacgtcggcactgtcactggcttcgactattggtaccccgaggtgctcgccaagctcggcgtcacctgggaggccgacagcgcgcgcaaggcgtacaacgagggccacaccacccaggtccccgcctggaccgcagtcaacgtcggccgccagcgcatcaccaggcggatcgcgttcggaaagcgagtgttgcagtatgagcgaaccacgggggctcgacgacgcaaggttcggcctacttcagcgagccgacgacagcgggcaacttccactccctcctgagttcttcgaaaaggacctgctcgtcgccgaggcggtgcgcgtcatcgcccaggtaggtcgtgagcgaggtgtctcgctcatcttctgcggtggcaccgcgctcgcgcaggcccaccaggtgatcgagcgcatgagcgaggacgtcgacttccgggtggtgctgccggacctgcccagcaccaaccagcgccgcaagttcctctcggcgctcaaggccgacctcgtcgcggcggagcctgtcaatctttgagagacaccccgggctcgatgttcactgtgtcgtcgctgcctcctctggcgggttgatccggaccgctgcagggagccggggcggctcgggccgcttgcgcacgaagcgttcggggtgggcacgccaggcagccgcgagcacctcggcccggtgagctcggagcgcttcggcacgtccgtggtgcacatcggccggggtgtggagtccgatgccgcacgtggcggcgctcgtggttaaaccagcggaagaagcgctcgcaccaggctcgggcgtcctcgtagcagccgaagcgccggaggtcgtcaggtcggtacttcatggtcgtgaactgggcctcgctccgacgggttgtcgttggaggtgtgggggcggctgtggctctgcttcaccccgcggtcggcgagcaggtgggcgacggacttcgcgatcatcggacctccccggtccgagtggacggtgagctcccccggtcggacgccctgactggccatagtctcctccagcagggcgacggggtggctggcgtgctcggtgcgggcgagcatccagcccacgacgcaagcggctgtcgatgtcgatgacggtggagaggtagtagtgggtccacctggcagggccgaggagcttggtgatgtccgagctcgtgacttcgttcggtctcgtggccacgagctcgggtttgaccgtcgggggtgggttgcgtggcgtgccggtccccgagcgcccgtgggcacgcaggatgcggtacatcgtcgacacggaggcagggagatttcctcgtcgaggagcttggtgtacaccaaggccggggcctcgtccatgtgctcggggctgttgtagcacccggcgcactggccctcgttcctcgtccgagagggcccgtggctggggagccttggctagcttggggcttcttcggtgccgtcggtaggagcgagcacggggctcaccgagagccgagcaggcggtgcgtaccccgacggttggcgcgagttcaccgatggcctcgccgatcacgtgatctcgtcatgggcgccgggcggcgtatgcgcgcggctcaagggtccttgcggacgcgaggtcgctgccgcacgcgcgtgcacgggagcggttcgcgtgctccgggccactcgggtcagttcgcagccgagaacggtagccttggccgtggggacgcttgctccgagggaggttacagggggatgacgcgtcggtaccgctgcacgaactgcgggaacgtcacacggtttgacgtcaccatgtcggttcgtgcacgttcctatttccactattccatcgcgggtgagctgtcggtcgaggacaccgaggagctgtcgcgcgtcgtcgaggaggtgtcgtgtcggtggtgcggcacgagccgattcgtggaggtcctcgaggcgaccccagcgacggtggagcggacgtgagcccccgcgctggtgaccgccctcgtcggccggcgccgcagtgggcgctcgctcgtgtcgtggagctcctcgacgagacgccggacacgaagagccttcgtctcgagctcgacgaaccccagcagtacttgccggggcagtactacaacatccgtatcccggtcgagggacgaccacgaccgatccagcgcgcctattccctcgggtcctcaccgatcccggaaggccgcgtgatcgaggtcggcgtcaaggcggtgccgggaggactggtgtcaccgcgactcgtgttcgagacgcacgtgggtgacgaactcgaggttcgtggcccctacgggacgttcacctggaccgaggaggacgggggcccggtcctgctcgttggtgcgggatcgggcatcgtgcccctcatggccatgatccgctaccaggccgctcgtgggacggcgatcccgatgcacctgctctactcgtctcggcgtcgcgacgaggtgatctacctcaccgcgctcgagtccctccggagcgagcacgagtggcttcgcgtcagccacaccttcacccgtgatctcgatgatccgctcgccaggttccatcgtcgtatcgacaaggagatggtgcagctggtggcgcgcgaggccgaagcgcagctcgcctacatctgtggacctccagaactcgtcgacgacgtcgaacggacgctgatcgagtccggtatggatgagcaacgcatcaagaccgagaagtacgactgacgacggtgcgctcgctcgccgcgtcgaggcgtgcctccgagacgccggtgtcgtcgcggcagggtgggtcccgagagagcagcgtgcctggcgcgagagcacctgggcccagctggctgtcgcgcgcggctggatgcgtgagccacggttcacctttcggcgtccgcagcctgcggccgacccttgggccccgctgtcgtgggcccgcggtgcgatcgtggtcgcggtcgcggcagcgccgtccgtgcccgcggcgaaccatctcggtgtcgctggctacgcagcaggcgatgcgtacgcgcaggtgcgcgacgcactcgagcgtgtccggcgcctcctcgtcgacgtcggtggccgtggtgtcgtcgtggccgactccaacctcgctttcgatcgcgccctcgcgcgccgagcgcggctcggatgggtcggacgccacaccctcgtgatggtgcccggctacggcggggccgtcgtcctcgggtccttgatcgtcgatcgggtcgtcgaggtgcgtctcggacggaccccgactggggatccgtgtcgcaactgccgtcgttgcgtggatgcgtgtccgacgggcgcgctcggcgacggggtcctcgagccgctgcggtgtcgctcgtggcgccagcaggagcgacacctcgagccgtcgtggcgcgagacgtggggcccctggctgtatgggtgtgacgagtgcgtgacggcgtgtccgctctcggcacggcagaagaaggtcgggggcgagcgcgtcgcgtccatcttgtcggcgagcgatgcagcgctcgccgagcgcgtccggagttggtacataccggatcgaacgctggcgtgggtgcggcgcaacgcgatcgtcgcggctcggtccctcgcgacgagccccgacgacgagcaggcgatctggcgccagctggtcgccggagcagcgccggtgcgagccgaggcggtacgctgggtgcttcgtcgaggtgggtggggaggtgtcgatgcgtcacgtgctcgtcaccaacgactttcccccgaagatcggcggtattcagcactacctcggggagatctaccgtcggctcgacccgacgagcttcgtcgtcgtcacgcgtgacgaggcgggcgccgaggccttcgatcgcgccttcggggcgcgcgtcgtgcgagtgcgcggaccgcttctgcccactcgggccctggccgcccgagttcgcgggctcgcacgcgagatcgacgcggacctcgtggtgatcgacccgatctggccgctcggtgaggtcgcggcgagcctagggctggggtgggttggtgtcgcacacggtgcggagctcacgttgccgcttcgactgtggccgacggccggtcgaatccgaagtgtgctcgcgggggcgctcggcgtggtggcagcgggaggtttcgtcgcgcgcgcgctcgatggggtggtgccggccgatgcgatcgcgacggtgccgccgggggtggatctcgaacgcttctgcgtcggcgatcgcgagcgtgcgcgcaaggacctcatggtggacccggagcgatcgctcgtgctgttcgtctcccgtctcgtcccgcgtaagggcgcccacatcgtcatcgacgcggttgcccagctgcatcggccggtggagctgcacgtggtcggtgacgggcgaagccgcagtgctctcgagcagcgagcgcgccgtcggggaatcctcgcggtgttcgaggggcgtgtggcgctggatcggctggtggcgagctaccaggccgccgacgtcgtcgcctttcctgcgcacgatcgttggttcggtctcgaggaggagggtttcggcatcgtcgcgctcgaggcgcaggcctgcggcgttcccgtcgtggtcggcgtgagcggcgggaccgcggaggccgtcgatcctgcgagtggacggctcgtcgcgagtcgccgtccgagggcctgggccgaggcgatcgaggagcgtctcgctcacacgagccctccggtcgccgacgcgcgtggcttcgtggagcgtcatcacggctacgaccggttggccgacgagtggcatgcgggactcgagcgcctcgcgagccgtggacgtacggccggaagcggctaacctgcacacatcatggaggccacagctgagtcgcgcgaggttcctgcgccggtcgaggcgctgttcgacgtcgtcgtcgacgtcgaacgctatccagagtgggcctcggacatccgaagcgtgagcgtgctcgagcgcgacgagcatggtcggccgcgtcgcgtccacttccgtgccggcgcgttcggccggagcgcgtcctacacgctggtctacgatgcgtccaaagcgccgaacgagctgtcgtggacgcaggaggaaggcgacgtcaccgcgcggctcgatggccggtatcagttcgagccgttgggggacgacgtcacgcgtgtcacctatgagctggctgccgacctcgtcgttccgctccccgggttcttgaagcgtcgggcagagatgaagatcgtgcacgccgcgctcgaggatctggcgcaacgggttcgccagctcggctccgccgacggatcggcggcgcgcacacccgatcgctcgcattgatcggtcgtgacgcactcgcttcaccactgaatccatcgtccctgaccttcggcgtccctcacgacagggacggccatcggcgcacgtcagatgcactacgctggggttcacagcgacgctgtgcgtcgggtgtgggggagcggagccgtctgggggtgcggaatccatggcgagatgtcgaggatctcgaccgatgagccgatcggggtcgacacacggttcgcagccccgacgtcggcgactcgcgcaggtgtcgagcgcggtgcgcgcatgatcggctgtggggggcccgcgctgggcgagatgatcgatctgggcttcggcaaccccgacctgcctccgcctcaagaggcgctggcggcgatcgcggccgagctcgcgcggtcgcatcctgcacgctacggcgacagcgctgggaccgtcgcgtatcgtgccggcgtcgcagccctctacgagcggcgttggggcgtcagcctcgatcccgacgcggaggtcacccaggtgctcggcgccaaggagggtctgcaccacgtgctggcggtgctccctccgggtcctgtcggggtgccgatgccgagctacccgacgcaccacgaggcagtgctcgtcgcggggaggcccctcgtcggactcgagctcgatcccgacgatcgagacgggcgacacttcatcgagcgggccgcggacttggcccgcgccggccgcgttcgcgcgatcgtgctgtcgttcccgcacaaccccacgggggtcacgacgacgcgcgcgatgctcgaggagttggtggccgccgcggtggaggcaggggtgaccctcgtgcacgacttcgcctactgggccacggtgctggaggagcgcccgagcgtgagcctgctcgagatccccgaggcgcggtcggtcgcggtcgagctggtgagcctgtccaagtcgcactcgatggcgggatttcgtgcgggtgcgctcgctggttctggcgctatcgtgcagcgggtacgcgcgcgcaagcgcgccttcgaccacggtctgtcccaaccggtagaggcaggagccctgtgggcgctgcacgatggcgaccgagcggccgacgagctcgcacgtcggtatcgggtgcggcgcgacgtgctggtggcgggccttcgccggctcgggtgggggcgggtcgcgaatccggccggatcgatgttcgtgtgggcacagcctcggggcggactggacgacgccggcgtgacgcgccacctcgtcgacgagcacggcgtccttctcggtgcgggacgcgacttcggcgccacggaggcggggtggcttcgcttctcgctcatcgccgagcccgaggtgctcgacgaggccgttcgtcgtctcggccagtgcgcgctgctcgggtcggcgtcagcgcccgagggctcgctcgcgtcgtgaggccgtggtatcgaggcgcgctcgctcgaggtaggcgagcacctcgtcgaagtcgtggtggggctcggccagcgtgatgcgcacggcgccggcgaacgacgaggcgagggtgaaggcggcgcctggcacggtgcgcacgccgtgggcggcgagctcgagggcgatgagcgcctcgggatcgggcgggagccatgcgttgacgccgtctcccgtcaggttgcgacccagcgcatcggcgaggcgctcccgtcgggctgcgtaggtggcacgggcgtgctcgaggcgctccgtctcctcgggggcctcgagcatcgcggcgagcagcgcctggaggagtttcggcgaccacgacgggccgaggctgcgcgcgtgctcgagcgcgtcgcgtcggtcggcatcggtgatgatcgcggcgaggcgcaggtcgggcccgtgggacttcgagaagctgagcacgtacgcactcgcgggatggagccctgcgaggctcgccaacagcgtcgaggcgacgagcccggagtgatcgtcctcgatcacgaggacgtcggggcgtggggcgagggctgctgccagcgcatcgcgacgctcgccgctcaccgtcgcgccggtcgggttgtgcgcgcggggctggatgatcaccgcgccaagctcggggcgtgcggcgagtcgcgcaaggtcgctcgggtcggggccctcggcgtcgatcgggaggggccagacgctcaagccgtgggcctcgacgaggtcgaagagcgcgggaaagctcggatcctccacggcgacggcggtcgcgctgggagcgacggtgccgaggagtcggtcgatcgcctcgagggcgccatcgacgatcgtggtgccggtgtccgctcggagctggagggcgggtggcagcaaggggacgaggacgtcgacgaggggtccgaacaccggtgggtccgcgtacgtcgcgggagcgagcggggcgatgcgtgggagataggacacggggtcggggagcaggcgcggatcgggagcgccggtgccgaggtcatagcgtgcgggctggggcggcgtctgctgccatcgccgaggccgacggcgcggtggtgaggcgacgaaggtaccacggcggccctgggccgcgacgagccccaagctggcgagctgtgcccaagcagccgccaccgtcgtcggcgagatcccaaggtccgcggcgagctggcgaacagggggcaagcgcgtgccttcgggaagctcaccggcgcgaatcatggtcgcgaccgtcgaggcaacggtgcgcacgccgatcgtgccgacgctgcgacggcgcagcgctgccaccagggcgtctgccgctgcgtcgtgcccgagatgctccatggccccagcgtagcaaggagcgcgctcgtgattttcgtttgtgtggcacaaccctgtgtcgcgtgccagtacaacgaagtgctaccatgccggaaacggtccggatgctcggaggaagtggaggcggcgatggacctcatcgaacggcatcggcgggtgctcccgtcatggctcagtctgtactacgacgagccgatcgaactcgatcggggcgaaggatgctgggtgtgggacgcgcacggtgagcgctacctcgactgcttcggcggcatcttgacgacgagcgtcggtcacaacgttcccgagatcgtgagcgcgatcagcgaccaggccgctcgggtgatccactcgtcgaccctgtatctgaaccggcccatgatcgagctcgccgagcgtctcgccaaggcgtcgggcattcctgatgccaaggtgttcttcacgacctcgggcaccgaggcgaacgacgcagccctgctcttggcgacggccgccctcgggtcgaaccaggtgttcgcgctgcgcaactcgtaccacggtcgctccttcacggagatcgcggtgaccgggaaccgaacctggtcgccgacgtcgtactcgccgctcagcgtcagctggttgcaggggggttcgaggctgcgcgggccgctcgcgggtctctcggacgccgagtacgtcgcgcgtggggtcgccgacttggaggatgcgctgctgacgacgacggccggacgggtggctgccctcatcgccgagccgatccagggagtcggcgggttctgtctcccgccggatgggtacttcggtgagctgtggagggtgacccagcgcgaggggattctgtggatctccgacgaggtccagaccgggttcgggcgtaccggcgagcatttctggggctacgaggcgcacgggatcacgcctgatctcatcacgttcgccaagggtgtcggcaacggcatgtcgctcgctggcgtgatcgggcgagcggaggtgatggacgcgctcgggaccaactccatctcgacctttggcggttcgccgatcacggcggcggcgggcgtggcgacgttcgactacatcatcgaccacgatctcatggccaacgcgcgtgcgcgcggcgccgagcttcgcgaggggctcgacgcgatcgctcgatcgacgcccgcgatcggagaggtgcgcggcaagggcctcatgcagggggtcgagctcgtctggcccggtacggtcgagccggcgcccgagcttgccacacgcgcgctcgaagcggcacgtcgcgaaggcgtcctgatcggcaagggtggtctgcacggcaacgtcctgcgcatcgcaccgcccatgaccatctcggccgagcagatcgagcacgcactcgaggcgttccggcggtccttcgccgaccaggcattccatgtgaaggagcagtgatggagacgatcgcgcacctgatcgacggcgagcgggtcgaagcggccccgctcggatcccagccggtcctcaacccggcgaccggtgaggccatccggagcgtcggactcggcgatgcgggcctcgtggatcgggccgtcgccagcgcggcggcggcacagcaggactgggccgagcagtcgctcgccgcgcgccagcgcgtcttcttccgctatcgcgagttgctcgtcgctcacaccgacgagctgtgcaccttgatcagtgaggagcacggcaaggtgctcggggatgcccgtggcgagttcgcccgaggggtcgaggtcgtcgagttcgcgaccgcgctcccgcagctgctcaagggtcagttctccgacagcgtctcgcgcagcgtggacgttcgcagtctgcgccaaccgctcggggtcgccgctggcatcacgcccttcaacttcccggccatggtgcccatgtggatgttcccgatcgctctcgccgtaggcaacggattcgtcctcaagccgtcggagcgcgatccctcggcgtcggtgcgactcgccgagctgttcgtcgaggcgggtggtcctccgggcttgctgaacgtggtgcacgggggtccagcgacggtggatgcgatccttgcccaccctggcatccgagcggtgtcgttcgtcggctcgaccccgatcgcacgccacgtctacgagagcgccgctcgttcgggtaagcgggtgcaggcactcggcggcgcgaagaaccacatggtggtcctccccgatgccgatcgcgaacaggtcgtcgacgctgcgatcgcggccgcgttcggcagctcgggtgagcggtgcatggcgatcgcggtgctcgtggtggtgggcgagcagccgggcctcgtcgacgagatcgcggctcggatgggctcggtacgcgtcgggcccgcgacggacccgactgcggagatgggcccgctcatcaccgaagcgcatcgcgaccgcgtggcccgcctcatcgaggaggcggtgtcgaagggggcgaaggcgatcgtcgacggacgagcacacccggctgcggcaggtccgggcttcttcctcggccccacgctgctcgaccaggtggacgtcgcgatggacgcctacaaagaagagatcttcggcccggtgctcctcgtccagcacgcggacgacctcgacgaggccgtggcgctcgtgaaccgcaacccgtacgcgaacggcgcggcgatcttcacgcgcgatggcggcgctgctcggcgcttcgtgcgctccatcgacgccggcatggtcggggtcaacgtgccgatcccggttccggtggcctaccactcgttcggcggcttcaagctgtcgctcttcggcgacacccacgtccatggcgaggagggcgtgcgcttctacacgcgcggcaaggtcgtgacggagcgctggcccgacgaggcgtccgaggcgcgctcgctgcacttcgtgaccaaccggtgaggtcgcgcttcggtgccggctcaccgaagcgctaggctcggcgcctcgtgaagcgggaggagtcatcggcggccgacgctccggcggccagcgagcgcgacatggcacgcggccgaggcgcgcgagaagcgtggcaggtgcccgcgctctcggtcgatgcgttcgactacgacctgccggccgaggccatcgcgcacgatcccatcgagccccgtcgtgctgcgcgtctgctggtggcccgtcgcggggctcccgtggcccatgcgagggttgccgatctcgctcggctcctcgagccgggcgacctcgtcgtcgtcaacgagtctgccgtggtgcccgctcggctgcacctgcagcggagcagcggaggcgccgtcgaagtactcctgctccggcagcttcccgatgggaccgccgaggcgctcgtgcggcccaatcgtagggttcgcgccggtgagcgccttctcgccgacggcgtggaggtcgtcgaggtgggaggcgccctcgaggccgtcgagggcatgacgatccgagcggtgcgcgtgctcgatccggagcgcgtcgcctcgatcggggtggcaccgctcccgccctatctcgggcgccaggacatccccctcgagcgctaccagaccgtgttcgcgcggcgcccagggtcggtcgcggcaccgaccgcgggactgcacctcgacgaggtcgtgctcgccgacctcgcggcgcgcgggatcgacgtcgtgcgcatcgtgctccatgtcgggctcggcacgttctggccggtgacggcggcgacgctcgccggccatccgatgcacgcggagtcctacgaggtcgacccggccacgtgggcgcgcatcgagggcgcgaagcgtgtcgtcgccatcggcacgaccgtggtgcgcacgctcgagaccgtggcgctgacaggtgagttggcgggcgagtctcggctgctcatcgcgccagggtttcgcctgcaggtcgtcgacacggtgctcaccaacttccaccaaccgcgctcgacgctgattgcgctggtcgcggcgatggtgggggatcgctggcgcgagctctactcggtggccctcgccgaggggtaccgcttcctctccttcggtgatgcgatgctcgtcgacgtcgaggggcgtcggtgaggccgtcgttccggatcgacgcgacggacggcacggctcgtgcggggacgctcaccctacgccatggtctggtaccgacgcccgtgttcatgccggtcgcgacgcgtgggatggttcgactcgtccccccggcgaccctgcacgagctcggggtctcgctgctccttgcgaacacctaccatctcgccctccgccccggtgccgatgtggtggcggcgctcgggggtctcagcgctttcaccggcttcggagggcccatgctcaccgactccggcggattccaagtgatgtcgctcggaggcacggtcgatgacgacggagtcacgttccgatccacctatgacgggcgccgggtccgtctgaccccggagggcgtcgtcgagctcgaggagcgcttcggcgtggacatcgcgatggtgctcgatgtgtgcaccatgttgccggcggagcgagcagcgctgcaggtggcgatggttcgcaccaccgagtgggcgcgccgggcagcagcggcgcgtcgagacgaggcccaagcgctcttcggcatcgtccagggtgggtcggaggaggatctgcggcgtgagcacgcgagccagatcgccgagatcggtttcgacggctacggcatcggaggcctcgccgtcggggagtcggcgcccgccacgctcgcggccgtggcagccgccctcgagcggctgccggcggatcggccgcgctatctcatgggcgtgggggatccctacctcatcgcccacgccgtcgagctcggagtcgatgccttcgactgtgtggcacccacgcggcttgctcgccacggcatcgcgctgaccagccagggtcggctcgcgctgcggccgagtcgctggttgggctcggacgagcccgtcgatcctcgttgcgggtgctcgacgtgtcggacggtccctcgagggctcgtcgcgcacctgttgcgtgtcgatgcgcacagcgccggcgcgctcctcagcgtgcacaacctgtcgtttcagctcggactccttcgcgacctgcgtgctgcgatccgtgccggcacgctcgcgggcctggtacgcgccctcgacgaggtctgggcgccgagctggcgaagcgctcggaccgaggccgcgccggatcgctaggctccttgatgagtgcacgtcggaggggtatgagcaagacgcgttggctgtggtcggtggtgctgtcggcgctggtcgcggtggcggcattcatcggtgtcgtcgagctcgctcacgatgggccgatcctcggactcgacctccaaggcggggcgagcgtcgtctaccggcctgctcgaccggtgtcgacggccatcttgaacgagacgatcggcatcttgcgcaaccgggtcgatggactcgggatcgccgatccgtccatcggtcagcagggcaacgacatcgtcgtggagctgccaggagttcgcgatccgcgccaggccttggcgctgatcggacagacggcggtgctgcagttccgaccggtcgagtgtacgtgggctgcgtacgccccgacgaagggacagcacgtctcggccactcggccaccgacgtcgtgcccgacgagcgcagccggactcgccgccgaggccgcggtgccgacgacgccgacgcaggtcgccctccacagccagacggcggtgctcgatcttcgtcagggaacccaggtcgtcggacgctacctcgtggggccagccttgctcgacggcaacgccatcaagagcgtgtacgcggcgcccgacaccacctcctcgaccgggtcatggctcgtcgacttcaccctgacgccgaaggcctcgccgctgttcaatcagatcgcgaagacgttctaccaacgccagctcgcgatcgtgctcgatggcacggtgatctcagccccgcagatcacctcgacgtcgttcaacggacaaggacagatcaccggcaacttcaccgaggcgcaggccaacaaccttgcgctcgtgctgcgctatggcgccctcccggtgcagctggtccagcagacggtgcagaccgtctcgccgacccttggtgcgagcgcgctccgtgcgggcctcgtcgccggcgtcgtcggcctcatcgccgtgttgctctacaccatcgtctactaccgagtcctcggcgtcgtggtcctcgcaggtctcgtggtgacggccgcggcggtctgggcggtcgtcgcctacctggggagggcggcgcagctcacgctcgatctgtcgggcgtgaccggtctcatcgtgtccatcggcctcatcaccgactcctacatcgtcttcttcgaacggctcaaagacgagatccgtgaggggtcatcgatcgggtatgcggtcaaggcggggttccagaaggcgtttcgcaccatcatcgcggccgacctcgtctcgttcatcggcgccgccctgctgtggtacttctcgatcggtcaggtgcgagggttcgcgttcttcctggggctcgcgacggtggccgacgtcgcctccgcctggttcttcacccgaccgctggtcctcatcgtcggcgacgccctcggcaagacgcatccccgatggctcggtgtgggcccggtgcagctgcgcgaacaggcacccgagacggccatcttgcggccacgggccagagtgagtggaagtgaatcatgagtcaggttcgcatcgtcgaagatgcctcacagctcagctggtggcggcgtgtcggggcgggcgcgacgcgcattcgcttcgtcgaacgggcgcggtggttctgggcggtctcgctggtcgtgatcgcggtcggcgcggcggcgctcgggattcgcggcctgaacttcggtatcgattttcgtggaggcctcgcctggcaggtgagtgcgccgacgctcagcgtcacccaggctcgtagcgcccttgccgggctcccgctctctggcaccacggtcgtcagcttggggaccggtcagcaccgaaccatcgaggtggaggcggatctgccgacctcgggtgcgcgagcccatgcgctcgagaacgaggtcgccgctcgactggctgccgcagctcaccagccttcgtcggcggtggcgatcaactacgtcggtcccacgtggggatcgcagatcaccgacgcctccctgaaggcgctcgtggccttcttcgtcggcatcacgctctacatctcgttgcgcttcgagtggaagatggccctggcggcgctgatcgcggtgatccatgatctcgtcgtcacggtcgggatctatgcgctctcggggttccagatcacgccatcgacggtgatcgcggtgctcaccgtgctcggttattcgctctatgacaccatcgtcatcttcgatcgcatcaaggagaacgtcgcgacgcacgtcgatcaggcgggggagatgacctactcggaggtggtggaccgctccgtcaatcagatgctcgcgcggtcgatcaacacgagcgtcgtcgcggtgataccgatcctgtccgtcttggtggtgggggcctacctcctcggtgcgacgaccctgcgcaacttcggcctcgccctcgtggtcggcctgaccagcggcgcgtactcctcgatcgccatcgcatcgccgatcctcgcgttcctcaaggagcgagagcccaggtaccgacagctcaagcgacggattgccgcgcgtcgtatcgcacctgcgaccgaggcggcgggtaccatcgatacgtaggagggggcgatgctcgacgagcggtggttagcggagcgctacgccgacaacccgctcgtgctcgacgccctcgcgctcgcgacgaaggcgcaccacggccagctgcgccggtctggggagccctacatcgtgcatcccctcgcggtggcccgtcgcgtcgccgaactgcgcgccgacccgatcaccgtcgccgcggccttgctccacgacacggtggaggatacctcgatctccctggaggaactcgagcagcgtttcggcgcggaggttgccgcactcgtagacggagcgacgaagctcgaccggctctcgttcgactccaaggaggtcgcgcaagccgccacgatgcgcaagatgctcatcgcgatggcgcgtgacgtgcgcgtgttggtgatcaagctcgccgatcgcctgcacaacatgcagacgatcggcgctctcgggcgcgagaagcagcgccggatcgcgcacgagaccatggacatctatgcgccactcgcccatcgcctcggcatcgaggaggtgaagtggcagctcgaggatcatgcgttcgcggtcctgcatcctcggcgctacgccgagatggagcacctcgtcagtcagcgggctccggagcgcgaggcgcggctccaggcggtcagcgaacagctcgctgccaagctcgcccaagtcgggatcgtcgccgaggtcacggcgcgccccaagcacgtctggagcatctacgagaagatggtgctgcggggcaaggagttcgacgcgatctacgacatcctcggggtccgcatcatcacacacgaggagcgtgactgctgggcagcgcttggcgtcatccactcgctgtgggcgccgatccccgggcggttcaaggactacatcaacgctccgaagttcaacctctaccagtcgctccacaccaccgtcgtcctcgagggcgggagcccgctcgaggtccaggtgcgcacccgtgagatgcatctgcgcgccgagtatggcgtcgccgctcactggggctacaaggagggttctgatgcggccgagctcgcctggctcggtcggctcatcgacctcgacgaagagacgcacgatccggtcgagttcctcgagcacctcaagctcgatctcgggaccgacgagatctacgtgttcacgcccaagggcaaggtcatcaccctcccgacgggcgcgacgccgctcgacttcgcctatgccatccataccgaggtggggcaccggtgcgtcggtgccaaggtgaacggtcggctggtcgcgctcgagacggagctgcgctcgggcgacaccgtcgaggtggtgacgagtcgctccgccacggcgggtccgtcgcgtgactggctcgcgatcgtgcgcaccccgagggcgcgctcgaagatccgccagtggttctcgcgagagcgtcgggaggagtcgatcgacgcaggtcgcgaggagctcgctcgtgagctgcgtcgcgaggggttgtcggtgaccaagcacctctcgggaccgggtcttgcgcgcctggccgagcaggccggctatcgagaggccgagaccctgctcgcggccatcggtgagggccacgtctcggcccggagcgtgctcgccaaggtgcagcgagccgagctcgagcacgacgggttcgagccggcggtcgcgacgccgcagcggcggcgccgtggaggcgggggaccgtcgatctgggtcgagggtctcgacgacgtgctcgtgcggctcgcacgctgctgcaacccgctgccgggcgatgcgatcgtcggcttcatcacccagggccgtggggtcgccatccaccgagaggactgcccgaacgtcgaggcgttgctcgcccaagggcccgagcgcatggtcgaggtcgactgggcgggtgagcacggctccggcttccagatggcgatcgagatcgaagccctcgaccggccgcgtctgctcgccgacgtgtcccgtgtgctcgccgagcaccacgtgaacattctcgcctcctcgtcggggcgcgggagtgatcttgtcgcggcgatgcgtttcgagttcgagctcgccgatccgagccacctgtcgtcgatcctggcgggcattcgccagctcgacggtgtcttcaacgctgcccgagtcgttcccgggcgacgtcgcccacggaccgcgacccagcacgacggccgctgagtcggtcgccgaggcgaccgtgtgtcgcggattcgtcatggatttggtcctacgacgcagcattacggcgtccgtgacgggatattgttgggccaccgacgcatggggagcgtcggaggaacgggcgtgagcccgtccattgctacgacaagggggattgctggatgcaacagcaggcagtagagggcggatcccttcgcagggagatgtccttcgttgatctggtgatggcctgtctcggtgccatcatcggatcgggttggctcttcggcgtgctctatgccgccaacgcagccgggcctgcagcgatcgtcagctcgctcatcgggggcattgcggtgatcttcatcgccctcgtgtacgccgagctctcagggatgctcccggaggcgggcgggatcgctcgctacccggagttcacccacggtccgctggtagggttcgtcggctcgtggggcgcgttcctcgcctacgcttcggtgcccgccatcgaagccgaggcggtggtgcagtacgccgagcactacattccgaagctgaccgggaacaccgcactcgacttcgtcatcgaggcggtgctgttgatcatcttcttcgccatcaacgtctacggcgtcaaggcgttcgcgaaggtgaacacggtcatcacgttcttgaagttcgtcgcaccgacgctcacggtcatcgcgttcttgttcgccgtcggccactggagcaactacacggcgacctcgaccggaggtttcatgccggagggtagcgcgggtatcctcggcgccgtggcgacctcgggcatcgtgttctcgtacctcgggttccgccaggcagtggagctcgctggtgagtcgcgcaacccacagcgtgacgtgcctcgcgcgatcatcacggccgtgttgctcgcggtcgcgctctacacgctgctgcaggtggtcttcatcgccgcgattcctcactccgcgctcgccaagggctgggcgggcctgtcgctgacgtcgccgttcgcgcaggtcgcgtccattatcgggctgggctggctggcggcgatcctgtacgccgacgcggtgctgtcgccctcgggcacggggctcatctacctcggctcgacggggcgcgtcgtcctcggatcggcgcgcaaccgctacctcggtcagctgttccgtcggatctcggacgcgggtgtgccgctctacgcgatgatcgcgacccttgtcgcctcgatcatcttcttgctgccgttcccgacctggcagagcctggtgggcgtgatctcgtcggcgacggtcttcacctacatgatgggtccggtgtcgctgggtgtcttgcgcaagcactacgcagaggcgcatcgtccctatcgcttgcctgcggcctcggtgctctcgccgatcgccttcgtggtgggcacgctcatcatctactggaccggttgggcgacggactggaagctcgccgtcggcctgctcggcggcgttgtcgtgtacctgatcgcctcgagtgctggtcagggggtcaagaagatcgacggggcggcgatccgtcacggtgcgtgggtgatcgtctatatcgtcgcgatgctcgccatggcctacttcggtgcgcaccgcttcggcgcgccgttcgatcacggcaaggggctcatccattatccgctcgatctcgtcgtcgacatcgtccttgccctcgtcttctactactgggcagtggcgtcgggtcgtccgagcacggatacggaggaggccatccagcgtgctgccgagctgcgtcgtcagaccgcggctggcggttccgcagccatgagcggttgagcctcagctcgccattgcgagagggggtcgggctctgcccgacccccttcgtgcgttggcgggccagcaccagccggggcggcggcatggcccctcggtagtatgggcgccgtggaggtctcccggtgagcgtgctcaccgtcatcgtgctggtcctcgccgtcgtcgtggcggtgctcttggtgcttggcctctggcaggtgagcatgctgcgtcgccagatggaggcgtttgcgagcgagtggcgcgaggagatggtccgcatggtgcgcacctcgacccaactcatcgaggaggcctcggccgctcagcggcgggcgcgcgatctcgtcgaggaggccgaggccgatgtcgacgggctcgactgggcgctgcgtgcggtcgtcgagcctgcgcggagcgttcggcgcctgggtcttggggttcggcgcgctcgcgccgtctttcgggagcgtcgtggtggtgaggtgcgccgcgcatgaggcgggtggtgtggctcggtatcggggcgaccctcggggccatcggggcccgccggttggggcgtcttggcgcctcatcggtggatgcgcgggtgcggcgtgagacgcgccgactgcgccgggatctcgcggccgccatcgaggcgggtcgccacgaggtgcgcgtcgccacggcgaacgagcggagccggcgccgcggctcgaggaggagcgggtagtggattcgaatgacctgagacgtgcgtttcgggagtacttcgtcgagcgaggacacgttcccgttccctcggcgtcgctcgtgccgcacgatccgacgctgctcttcacggtcgcgggcatggtgccgttcaagccctacttcttgggcgaggaggtcccgccgtatcgtcgggcgaccagcatccaaaagtgcatgcgcgccggtggcaagcacaacgatctcgatcaggtggggaccacggcccgacacctcaccttcttcgagatgctgggcaacttctccttcggcgactacttcaaggagggtgcgattccctacgcgtggggtctcgtcaccgaggtgctcggactcgatccagaccggctctggatcacggtgcacacgagcgacgacgaggcggagcgcatctggatcgaggcctgtggggtccgcccggagcgcatccaacgactcgacgaggacaactggtggcagatgggggagacagggccgtgcggtccgtgctctgagatctactacgacaagggcgagtcctacggcgcgggcggtgggccggcggtcgggtccgacgagcgcttcctcgagatctggaacctcgtgttcatgcagtacgaccgccacccggacggttcgttgacgccgctgccggcaccctgcatcgacaccggtgccgggctcgagcggatcgtgccggtgctccaggggcacgactcggtcttcgagaccgatctcatgtggccgctcatggaggaggcacagtcgctgacgggccgacgctacggcggtcgcttcggtgcggacgccggtggcgacgtcgggctgcggatcatggccgatcacgctcgggcgacgacgttcttgctcgctgacggggtcgtgccgacgaacgaggggcgtgggtacgtgctgcgtcgtatcatccggcgtctcgtggcgcgcgcgcagctgttgggcgcgaagggtccggtcgtcgagccgatggtgcgcatgaccgccgccgtgatgggcgaggcctaccccgaggtggcgcgcgagctcgagacgatcgtgcagcacgcagcgcgcgaggaggagcggttcgcggcgacgctggcgctggggcgcccgctgctcgacgcggccctcgagggcggctcggttcccggcgcgctcgcgttcaagctccacgacacctacggtttgccgatcgagctcacgatggagctggcggccgagcggggggtgagcgtcgatcgtgccggtttcgaggaggccatggccgcacagcgcgagcgggcccgccaggccgggctcggtaccgaggccgtggagcacccggtgagcgccgaggtgctgcgcgagcacggccggagcgagttcacgggctacgaggccaccgaggacgaggggcgcctgctcgcactcgcctccgaaggcgacgtgctcgtcgccgtcctcgatcgaacgcccttctatcccgaaggtggtggccagctcggtgataccggcacgatcgagggggatggctttcgcctcaccatcatcgacaccgaccagcccgtcgcgggggtgatccgccaccacgtcggagcggtcgagggcgagccggtgatcggggcgttggtgcgggccgtcgtcgacgcggagcggcgcgagggtcttcgggtccaccacacggcgacgcacctgctgcactgggcgcttcgcgaggtgctcggtccgcacgtcaagcaacaaggctccctggtcgcaccggatcacctgcgcttcgacttcacgcactggggaccgctcacgcccgacgagatcgaggagatcgagcggcgggtcgcggccgagatcatccgcgactcggtcgtcacggtggagctcatggatcgcgacgaggcgatccgtcgcggtgcggtcgccttcttcggcgatcgctacggcgacgtcgttcgcgtggtgcacgccggtgagtcgtcggtggagctgtgcggtgggacgcacctcgaccgactcggccgcatcggccacctgcgcatcacgtccgagagctcgatcggcgccaacacgcgccgggtcgaagccgtcgtgcagctcgccgccctcgaggtggcacaccgcgatcggcgactcctcgacgagctcgagcggatcgtcccgggcggacgcgatgggatcggcgagcgcgtcgatcgcatcgtcgagcgtgccaagcgcgccgaatccgagctcgcgcgtgagcgcacgcgcaccttggctgagcgcgcccgcgcgctcgccgagacccggggggccgacggactcgtggtggcgcgcgtggacggtcttgaccagcggggggttcgggagctcgcgatgctggttcgtgaccacgagggcgtgctgggcgtcgtgatcgggggcgtcgccaacggcgtggtcgcactcgccgccgcggtgcgcgagggcgctccctggcgtgccgacgagctgctgcgccccgtcgcgcaggcggtcggtgggggcgtcggtcgagccgaggtggtggcggtctccggtgggcgccgtgccgaagcccttgacgcggcgctcgaggcggtgcggacggcttcgtgagcgaggggttcggcggccgcgctctcggcgtggaccttgggacgaagcgcatcggcgttgcggttgcagagggctcgctcgcgctgccgctcgaggtcatcgacgcgcgggggccgtggcgtgcgaggctcgccgagctggtcgcgtcggtcggtgcgagcgtcgtggtcgtcggtcttccgatcggcctcgatggatcggagggtcgggcggccgcccgggtgcgccagtggtcggaaggcctcgcggagcacctcgaggttccggtcgtgttcgtcgacgagcgcttgtcgtcgcaggccgccgagcgtcgtctcggggccgccggtgtcgacgccaggtcgcggcgcggtgcggtggacgcctttgccgcgaccgagatcctcgagcggtggctggtgacgcagcggtgagagggtggccgaagcggctcgtcgctctcgcgctcgtggtggtgctcgcgctcggggcgatcggggtcgcgtatctcgccgaggcggcgccgagctcgtcgggtcacgaggttgcggtactcatcgagcccgggacgtcgctcgagggggtgtcttccctcctcgcgcgcgagggcgtcgtgcgcaacggcacgttgttcgacctctacctgcgccttcgcggatcgccgacggtggatgcgggggtgtacttcttgcgcaccggggagggctacgccggcgcactgtcggccctgacggcggggccagcaacggtacggctcgtggtggtgccggggatgacgatcgctcagatcgcagccaggctcgccgcactgccggaggccggtcacaacgggggtgcgttcgtcgcggcagcgtctgccgtgcacagctaccacaatcccttcctgcgcggcgcgaggtcgctcgagggcttcctctaccccgacacctacttcgtcgatccggcccagacgccgcacgagctgatccaggagatggtggatcgcttcacccaggaggccctcggcgtgggtctcgagccgggggggacctaccacggtctgagcgcctaccaagtggtcatcgcggcgtccatcgtgaccaaggaggccacggccgcgtccgatgcccccaaggtggcccgcgtgatcctcaatcgactggccgcggacatgccgctcgacatggactcgaccgtgcgctttgcgaccggcaacgagaacgcgccgctgacggcggccgaactcgcctcgccctcgccgtggaacacctacacccatcgagggttgccgccgaccccgatcggtcagccgtccgtggccgccatcgacgcggtgctccatcccgccaccggaccgtggctgtacttcgtcgcgctccgcgggcatcggaccgagtcgttcttcacgacctatgccgcgcagcaagcggcgatcgcgcgctacggagaggccgggtgaggcgcgcggatcccgaactcctcggggtgatcggccatccgatcgcccacagcctctcaccagcgatccacgccgcagcggcccgcgccgagggtcgtcgcttcgcctaccacgccttcgacgtcgagcccgctgcgctcgcggcagcgatcggggggcttgtcgtgctgggagcgcgcggggtcaacgtcacggtgccgcacaaggttgccgctgctgcgctcgtggatcgactcgagccggaggctcgggcgacgcggtcggtgaacacgatcacgatcgaggacgacggcacgctcaccggtgcgacgagcgacgtcgagggcgtcctcacgtccgtgcgcgacgatctcggtctcgaggtcggcgggttgcgcgtcgtggtcgtcggggcaggaggtgcggcgcgcgcgacggtctatgcgctcctccaggcgggtgcggcctcggtcggcatcctcgcgcgcgatgtggcgcgcgcggccgagctcgctcggagccttggcggttccgtcgtcaccgcccatgacgacggggcggcggcagatctcgtggtccaggccaccagcgtgggcatggcgggcggccccgatcccgcgggatctgcggtgccggactggctcctcgatcgtgccggcgcggtgctggatctcgtctatcgcccgagcgtgacgccgcttctcgaggccgcacgccggcgcggacttccggcggccaacgggttgacgatgctcgcggcgcaggcgcgtgggtcctatcggcgttggttcggcgacgcaccgagcctgtcggtcttcgtcggcgcggcccgcgaggccgccgccgagggctgaggcgatcggcgcgagccgcgaacgggctcgccgaggctgcccgggcacgaccggttctggccgtgcgcgcctcgcgtgatgtcacagtcgccccagctgcgcggagcgcctcgactgccctgtcagcgggtcagcgtcgccgagccctgcggtgctcagtcgttcgtcgatgcgtcctggttggcgtcgtccgagacgagtgccttggcctcgtcgagggtggtgtcgggtgcggggacgacgacctcggccgtcacggcgggatcgtcggtcggcgtgccgttcgtccggacgagctcgatgacctgtgcgagcagtcgcgtgaacccgtcggcgtcgtcgtgatcgagggcctggtcgagcgcgtcgtcgagtccgtcgagcgccggtcggagcgaggcaggcacgaggtagacgtggtccgacaagatgcgcaccgccaccgtggcggccgacgtcccgggcgccgggggtgtcgcgggcgccggaggtgtcgtggcctgtgccggctcgctggccgcgatcgccgcgggcgctggcggtgctccgatggcgttcgtctggtccgcaggggcggcaagctccgccttgatctgggcgagctgcagatcgacgtcgttgccctggttgccggccgcgagggctgcctcgatgtcgtccccaccaccgccgagcgctggtgagtcgaggaccccggagtccgccagttcgccgacggcggcggagcgcgcttgcatctcggagatcttgtccttcgcgcgatccatcatcatggtcacgtcggtcatctgatccgacaggccggtgaggccctcgagcgcagcggtggacgccttggcggcggtgtactgcgccttcatggtgtcgcgttgggcgcgaaacgcctcgatcttggcgttgagttgccgtccggtctcctcgagcgcggcctcctgcttggccagctgctcgatctggggcgtgagctggtcgatctggggcttgatggtgctcgcgcgctcgagggcgagccttgccacctgctcctggccctgctgcacggcctggcgcgcctgtccttgcagcttgtcgtactgggcctggagctgggcgcgctgagcctcgagtcgcttctgggacgtgaggacgtcggcgatcgacttacgaacctgctggaggttctcgagcatcttctggtaggacaggtcgagcgcctgggttgggtcctcgaccttgttgagcagtgcgttcgacttctgctggaacacctggctcacacgcttgagcaggcccattggcatctccttcgatgagacccacccgcgcgccacggttcgaggcgcgctaggctccacagagcatggtagcagcagcgacgcagcgttcgtgggccgtgcgcttagcgttctcggtgcctgcttgcgttgcaacgcccaaggcctgaggaggtgctctccatggcgacatcgctcgcccccagatcccgcgggacgacgtgggcgcgccttcgcagctacgacgcgctcctgtggttgctcgccgcggccgtgggcgtcttcggtgtcgtgatggtgtactcggcgacccggaaccaactggaacttgctggcctctcgccgcactactacctcgatcgtcaggcgatcttctgggtgctcgggctgatcgtgatgagcgtcgtcgccgcgctcgatctcgagtggctcggtcgtctcggctactggatctacggtgcggtgctgctcggcctcgtggccgtgttgtcgccggtcgggtcgtcggcgctcgggtcccagcggtggttccagctcggcccgatccaggtgcagccgtcggagttcgcacccatcggcgtgatgttcggtatcgcggcctatctctcgggacgcgatggaccgcggacgtggcgcgaggtggccgtggtcctcgcgctcgggggtgtgccggcactgctcgtggtgaagcagccggacctcggcaccggcatcgtggtcggtatcgtcaccatggtgctcctcgtcatgggtggcgccaccggtcgtcagctcctcgtgatcctggttgccggggtgctcgggatcatcgccgtcgtgcacctcggtctgctgaagcactaccagctcgagcggctcctctcgttcgtgaacccgcagtcggcgacccagacctacggctacaacctggtccagtcgaagatcgccatcggttcggggcacatcttcggcaccggcctcttcaaggggagccaaacgaacctcgcctacgttcccgagcagcagaccgacttcatcttcacggcggtgggcgaacagctcggcttcatcggtgccggttcgctcgtgctggtgtacggcatcatgctggccaggtcgtatcgggtgctgcgttcggcggcggatcgagtctccatgctgctcgtcgccggcgcgatcgcgtggatcggattctcggtgttccagaacatcggcatgacgatcggcatcatgcccatcaccgggatcccgttgccgttcgtctcctacggcggctcggcgatgctcggcttctcctcggcggtgggcatcgtgctctctgccgggtcgaggcgactgcgacgtgccagctgaggagccgccgcagaccgaaggcgcgcccctcgtcgtctgcgacgttgcgagggtgcacgtcgccctcccggagccgttcgcgcggatcgagctcgtgtcccgtcaggccgagcacccgggtcggttgtcgttgccggtgagcgtcgagcaaggtcgtgccgtcgcgctcgcccttgcgcgccgacgcgcaccgcggccgttcacccacgaactcgcctccgagatcgcccacgccgtcggggccagcgtgttgcgcgcgacgctccacggctccccagaggggggcgagtccaccttcgcagcgacgctcgagctcatgggggccgatggttgtcggcacccgatcgacgcgcgaccgtcggacgccatcgttttgtgtctgctcgaggccgtcccagcccccatcctcgtcgaggcaccgctcctggccggcccacccaccgacggctgacgtcgacggttaggacgccggccagtcgagcccgagatccaggctcggtgccgagtgcgtgatccacccgacagcgaggtagtccacaccggtgagggcgacctcgcggagccggcccggacgcaggccgccggaggactcgagcttggcccgccctccgttcagacgaacggcgtcgcgcgtggcctccagggtgaagttgtccaggagcaccatcggcacgtcgagcgcgagtgcctcctcgaggccgtcgaggtcgtccacctctacctcgatgggaaggtcgccgaagcgctgacgtgcggcggcgacgaggtgctcgaggggtgcctgggcgaggtggttgtccttgagcaagatggcgtcgtcgagactgaaccggtggttctcgccaccccccgcacggacggcggccttctcgagcccacgcatgccggggagggtctttctggtgtcgcggagccggcagcgggtgtcggcgatctcggcgacggcccgggcggtcgtcgtggcgaccccggagagatgggtgagcaggttgagcatggtgcgctcggctgcgagcaggacacggttcgatccggcgagctcggcgatgagctgcccgggctcgagcgcgtcggcgtcgtgtgcggaccactcgatggtgggcgcggccgcaccgaggcgcgcggcggtggctcggagcaccacctcggcggtgttggacccggcgaggacgccctcgtcgcgggcccggagctcgagtcggacggtccgttcgggcaccaaggagccggtgatgtcgccacgctcgccgaggtcctcgtcgagggcgagcgcgacgaggcgttccaggctggaggcgcggagcgccgtcatgggcgcagctcccgggtgacgcggtggtcggcgtcgaccgcgagctggtagtggggatcctcgtcgatcgcgtcgcgacgggcatgcgcgcccacgctgccgcgacgggccgccgccccagccagcatcgcaccgacgagccacgtcgccccagcctcgctgggatcgccgctcgactcgccagtgaggccggcggtcttgatcgtccggtacgccgcggcgagcgtgtccccgtcgcgcagcggaccgagggcgagggcggcaagggcgcgcagacgcgcgagtgggagtgcgggacggcgcacggggcgtggtagagccgtcggcaggggtgtcgggcgcggcaggtcgccctccgtgatggcttcgccgacacgccgtcccatgacgacggcctcgaggagcgagttcgaggcgagccggttggcgccgtggagtcccgtgacggcgcactcgccgacggcgaagaggcccgggaggctggtcgcgcccagctcatcggtcgcgatgccgcccatggtgtagtgcgccgcgggacgcaccgggacgagctcgcggagcgggtcgaggccgagcgtgcgagccgcggcgacgaagctcgggaagcgatcgacgagcgatggcccgatgggccgcgcgtcgaggaaggccggggtggcgtgcacgctgaggtgcaaggcgagctggtcgcgggtggtgagttcgcgcgccgggaggtcgtcgacgagggacgtaccgtcggcatcgacgaggagggcgccggccccacggagggcttcggtggcgagcgcgaagggcgcacgtgggcccccgatggcggtcgggtggaactgcacgaactcgaggtcgaccaccctggcacccgcccaggcggccgcggcgatgcccgtgccgagattggtcggggggcaggtgaaggcgtcgaagagcgcgccggcccctccggtcgcgagcacgacgcgacgagcggcgatggcgtcgaggcgtccgtcggcggtgcggacccaggcgccgacgacgcggccatcgagcgtgatgagctcgacgagcgtgccgtcgaggcgcgtgatggagccgagccgagggcggagcgccgccatgacggccgcaccggtggcgtcgccggccgcgtggcggatccgtgcgcgccggtgaccggcttcaaggccatagtcgggtgcgaaggccacgccctggtcgccaagccagcgaatcgcgctcggtccgtcggcgaggatgctcttcgcggcgcgctcgtcgaccaggtgggcgccggcgtcgatggtgtcggcgagatggtcgccgatgtcggggccgtcgacgggggctgcgatgccgcccttcgcccagtcgcttgaggtcgctgcgcctcgaggtgcgacgatggcgacgcggagcgtgggcgccacgctgagggccaccgaggctgcagcgaggccgtcgcctatgatcacgacgtcgaagctgctcaccatggtcgcaccgtgggatcgagcatcgcgagtacgggtcggcgtgcggcctcggcgacggccggatcgagtgtgacctcgccctcgttgcgctcgagggcgccgaggagcagctctggcgtcacccgctgcatgtaggggcacgtggcgtcggcgcgcagcggttcgaagctgatcgagttctcgcgccggagctggtggagcacgcccgtctcggtggcgacgatgacgcggcggtgctgctcggcgcgggccgcctcgatcatctgcgtggtcgacaggaggcgcacccgttggcgccacgggtcgtcgacgagcagggcgctggtggtgcagccgcactcggggtggacgtagacgaccgcctcggggtcgtcggcgagcgcggtctcgagggcgccgggctcgagcgcggcgtgtacgtgacactcgccgtgccagacgtgcatgcgttctcggccgagcgtacgcttgacccacgagccgaggaagacgtcagggaggaagaggacctcgcggagggtggggatggaggcgaccacctcgagcgcgttcgcgctcgtgacgcagacgtcggcgagcgccttcacctcggccgaggtgttgacgtaggcgacgacgatggcgtcgggatgggcgctgcgccactgccgcaggtcgtcggcggtgatggcctcggcgagggagcagcccgcatcgtgtgccggcaggagcacggtcttcgtcggcgacaggagcttggcggtctcggccatgaagcgcacgcccgcgaagacgatccgccgtgccggatgctcggccgcgatgcgggagagctggagtgagtccccggtgacgtccgcgaggtcctggacccacggtggctggtagttgtgtgcgatcaggagtgcgtcggtggcgagggccttcgcggcacggaggcgctcgaggacctcggccgagggagtgggcccgccgacaccgagggttggcttcgtcgcggtcgatgcggaactacttagtctcatcaagagacaaagttagtgggtgacgccatcgccacagctcggctggtcggccggtaccggtacggatccgaagtccgacgggctcgatcagcgtggactcgacgaggcgcctgcgcgcgttgggcgcgtggacctgttccccggtgagggcctcgatgcgcccgatgagcgcggggagagtgaaggtggcggcgaggagcggggcgaggacgctcgttcgatcgaggaggtcgcggaggaggagcaggccacggccgacgagggcgagttcgtcggcggtgagcgtgctgggccgcgggctgcgggcgctgcgatggtcgagggccggcatgaggtcatagacccggaggcggtcgacgcccgaggcgttcgaggcgagcgaggcgaggaggccgacctcggcgtagcggatggtgctgggatcggcggctgaagccgtgagggcatgcgtcggcccgggatcgagaccgacacgagcgtggaaccagtcgtgcagcgcatccgtgagatcggcgcacggaggtgcgagggtcgtcgtggggaggtggccgtcgagggtcaggaccacgggatcctcgccctcgacggtgagcgcgatcagggtggcttcgaggcgccagcagggcgtctcgttcatggttgtggcaattcctgcaatttgcttgacaatagcgccgggctgtggcatgctccatatgcgcaggtgcgcatatggcaatgctccgagcgtccggtggaggaaccggggcgaggagcggagccggcggggacggtcgacatcggggctgggaacctcccgatgaggtgccgtcgtcggtgtcgtacctcgcgcaggcaccggggggtgcatggatcgcaagatccgaggtgcgtgttgtgacaaggggggactcgtggacgaaccagcagtggtcttggactgcaccggcctgcagtgtccgatgccggtgatcaagacgtcgaaggcgatcaaggacgtcgaggtaggggcggtgctcgagctgctcgcgaccgatcctggcgtcgagccggacatgcaggcctggacgacccgtacgggcaacgagctgctcaaggtcgaccgtcaaggtgacgtgttccacgtcttgattcgtcgcgccaagtagcgctgcgcggtcggtcgcggtccgagcgaccacgtggcgggcacgagccgtgtggcgcgaaaggctgcgtacggtctcgctccgcgcgtgatcggtgctcacgcgacggcgagctgcgatggtggcgtctcttgctgggcgtgcgcgaccaccatgacgggttcgcgtccatggaggtggctggccctcacaatttccgtcagttccgtcagtcgagtcgctgcccgcgaggcgggccaggtggtgaggaggcaggcatgtggaccaacgagggtgaaggaaagatcgtctacgtccagacgcacgggatcaacgatccagggcgctcggcgacgccgttcttcctcgctgcctcggccgcggcgatggaggtggaggtcggcatctacttcacgatgtacggtccgcagctgctgcgcagggacatcgtggacaagatcggaccgaagggcgatcgcgggcagccgctctcgtacttcattcggcaggcgaccgatctcggcgtgcgtctgtgggtctgtcagccttcgctggacctgaacgacctcaccctcgaggagctcatcgacggtgtcgagatgatcggcggggcggccttcaacaacctggccatgaccgctgacgcggtggtgtcgttctgatgcccacgttgagtgccgacccctacctgaagcgttccgacgccaccggctatggcgaggtcgatcgtgcgaccaaggaacgcctcatcggcgaggtgttcgaggatccgcggtttccgcactacctctacgggtgctacgagtgcgggatctgcgtggcggcgtgtccgtcggccaggttctacgacttctcgccacggcgcatcgcgcaagctgcggccaggcgtgacgtggagctgctctatcagcagctcgaggaggacgtctgggagtgctcgcagtgtttctcctgcctgcgctgcccgcgaggcaacaaccctggaggcatcgtgacgatcatgcgcgaggtggcggtccgtgagggcctggcgtcggccaaggaggcgctcgcgggctactcccggatcatctacaagatcatgtcgacgggcacgcaggtctcgcccgacatgctccagcccgacgccttccccgactggggaccggaggtcaaggacgtctcggtcaacctcgacctgtggcgtcggatgctgccgcccgagacgatgcacaccaccaccactgggtggcaggtcgccgatcggacgctcgtcgagctgtacgtcatctggttggaaacgggggcgctcgacatgatcgcccaggtcgacaaggggatccacatgatcctcgccgaactcatggaggagcgactcgaagaggagggcatcgagctatgaccacgagcgctgtcaacgtcatcctgtcgcgcaaggagcggttcgagcgagagcccgatcgccgctccgaggacttccaccatcacctgttcgagctcgaagccgagggcgaactggtcgtccagcgcgtcgccggggaggtcgtcgaggtcccgaccaagtacgggatcgccaagcggatcccgaaggctcacctctggcatcacaagtcgtgcggccagtgcgggcacatcccgggctactcgacgtcgatcttttggatcatgcgcaagctgggctacgactacctcgatcccgaggatcagacgagctgcacggcctggaactactacgcctcggcgacctcgaaccaggccgcccaggccgccgtcgccgtgcgcaacttcgctgcggcgtacgagaccgggttcttcccactgatccactgcggcaccagctacggccactacaaggaggttcgctccgagctcctgcacgacgcggcgctgcgtgcccaggtgcgcaaggtcatggagcgactcggcaagcagctcgtgctgcccgaggagatcgtgcactactcggagtggctgtacgcggtgcgagacgagatcgcccagcgggcggttcgggacgtgtgcaacgtcgccgttacggtgcatccggcgtgccactactacaagctggtcgagggcgacgccatctacgacccggatgtctaccacggtcagcgcacggcggcggtgtcaggcctcgtgcaagccctgggggccgaccttcggagctactcgacgttcttcgactgctgtgggttcggctttcgccacatcctggtgcagcgcgacttcacgcggtcgttctcgacgctgcgcaagatcgaggtgatgcgagcggaggccgaccccgacgtcgtgctcacccacgacaccggctgcgtcacggccctcgacaagagtcagttcgcagcccaggcgcacgagcgcaacgtgggcgtgccggtgatgagcgaggcgcagttcgccgcgctcgccatgggcgcccatccgttcaaggtgtgccagctgcactggcactcgaccaactatcgaccactgctggagaagatggggatcgactggcgggccgcgtgggccgagttcgaggaggacgccaagcgcctctcggacggtcgtcagcagttcctgacctgggccgacgtggatgcgtgaggggggtacatggatcgaattgtcgtgatcggtggtggcccggcgggcctgtcggcggggatcgccgcggcggagctgggtgcacccgtgacgctggtcgagcgcaacgccttcctcggtggacggccggtcgaggagaactacgcctctatcacgccctatctcgaggacgcggcgatggtgatggggcggatggaggagcggctccgggccgccggtgacgtcgaggtgctcttgtcgtccgaggtggtgcacgcggccggtgacggaccctacgggctcaccatccgtacacccgatggcgaacgagtccaagaggcctcggccgtcgtggtggcgacgggcttcacccacttcgatccgggccgcgagacgcagctctatggctactacgagttcccagacgtgatcgcgctccaggacctcgaggccatgctgaaggagcaccacgtcgtgcgcccctcgaacggggaggccccgcggcgcgtgtgcttcatccagtgcgtcggcagccgcgatcgccagatcggcaacgagtactgctcgaaggtgtgctgcggtgtggcctcgaaggaggcgatcgaggttcgccagctcctgccggattcggaagtgttcatcttctacatcgacatgcgcatgtacggctactgggagcgccagctctactggccggcccaggaagagcaccacgtccagtacgtcaagggcatcgtgaccgaggtcctgccgaaggacgggcgcctgctcgtgcggggcgaggacaccaccatgggtcggccgatggagacgctcatggatctcgtggtcctgtcggtgggcatggagccctccccgggaacccgcaagatcgccgggatcttggggctcgcacagaacaagttcggcttcatcgaggcccagcagcccccgctcgacacggtcgggacgtcgcgtcccggtgtgttcgctgccggtgcggctctcggaccgagcgatctcgaggactgtgcctcctcgggtggcctcgctgcggcacgcgccgtcgcgctgtggcgtcagcaccagaccgtcggcgcgcgatgagtgtcgtgagctcgcagctgtgcgacctcgagagcgtgcgtgcgttcttggaggctttcgacgagcaagccgggagcgcgacccgcgctcggctcctcgagcgggcgcacgagcgtcgagcacgggtacgtcgagcgctcgagctcggtgacgccgatctcgtgctcgagacccaagtggcgagtcggcggcgacggcggacgctcgctgggctgcttgcacgagacgagctcgaagcgctctgtcgcgatgtcgcagccggtatgggcgaggcacgcgcgctcgaggacgatcctcggcgcgaggttgtcgagttcgttcgcgagctcgtgcacctgtgggaccctgcgaaggtcgcgctctggacgtcgtgggtctgggcccccgacgacgagaccggcgcgctcgcgctcatggtggaggacccagcggcgctcctcggtgccgacgatgccgaggtggccgcgcgggtgggcgaggcgagtcgctacctcgccgccgtgctcgaggcggcggggctcggtgtcgacgctgccgatccgttgagcttcgacgtggcggccgctgccgtctgggccacctacgcggtgacggtggtgcgcctgcgcatgaccaaggagttcacacagctccttccgccggccgctggctttgcggaacgagcactgggactagcgagggagggctgatgccggtcggagggcgcaaggtggcgcctcaggtggtcgaactcgaggaggccagggtcacctcgaccatctcaggcagggagtgggacgtctcgggcggcccgagtcgcatgctgatgccgcgggtgctcaccgactacacccagcgcggcttcgaggcgatccgtgcgctcgccggtggcgagagcctcgagtggtgctacggctgtggcaagtgcgtaccggtgtgcccggtcgatctcgtgggcgagtacgggccgcgcaagctccaccgcatggtccagaccgggacgaacctcttcgaggccgatcagctctggatgtgcacgacgtgcggcaactgcctgcgcgtgtgcccgaagcaggtcaacatgatccagatcatgccggcggtacgcgaagtggcggtcgccgacgggaccatcccgaccgagctccaaggggtcatggagaagaccttccgctacgggaacgccttgggcgagaatccccggcggcgccatgcctggacgaagggcgcgggcgtcccggtgcgggtgctctcgcaggatccgagcccggtggacgtgttgttctacgtcgaggactactggagctaccacccgcgcggacagcaggcggcacaggcgttcgcgcgtgtgctgaacgcggctggggtcgactttgcgatcctcggcgccgaggagaagaccatcggcgactcgcagcggctcgccggcgagaaggggctgttcgaggccctgatggaggacgtcgtggcgacgctcgagcgctacgagttccgacgcatcgtcacgccggacccgcacggcttcaacgcgctcgtgaaggtgtacccctcgtatgggcatcactacgaggtgctccactacacgcagctcctcgcgccgctcatgtcgtcactcgagctgacgaacccgatcgacgcgaaggtgacgttccacgatccgtgctacctcgggcgtcacaacggcgtctacgacgcccctcgcgaggtgctgcgagcgatcccggggctcgagctgatcgagatgggtcggtgccgtgagaactcgtactgctgcggtggcggtggcggcggcatgtggctcgacggcttcaacggcaaccacctctcggagcgcctgtcggagcgacgggtgcgcgaagccgcggcgaccggtgcggacatcttggctgtgtgctgcccgtacgaggtgtcgcgcttcgaggacgccgccaagtcgaccgggaacgaacatctccgcgtgctcgacatcgccgaactcgtggacatggcaatggcgccggcgctcgctggccaggttgggtgaaggaggggggatggacatcgtcgtcgtggtccgtcagctggcggacctcgtggaggaactcgaggtcaacgacgagggcacggatatcgaccgtgacttcgtgaagttcgtcgcgaacgagtgggacgaggccgcgctcgaggaggcgctgtgtctcaaggaagcggtcggggggaccgtcaccgtggtggccctcgacgagccggacgtcgaccagacgctctatgccgccgcggccaagggggccgaccgggtcgtcaagctgaccgggcacgatcccgacggctgggtgcgcacgcgcgagcgagccgctcgggtcgctacctggctccgtgatcagcatccggacgtggtcctgacgggcgtccaggcggccgacgacctcgacgggcagatggcgggcgtggtggctgcgtatctcggatggccgcacgccgccgtcgtggtggtggtcgaacccgccggcaacgagctcaccgtgacccaggagctcggcggtggcacggtggcgacctcgacgctcgccatgccggcggtgctcgggatccaggcggcgcgccaggcaccgcgctacgcgcccatctcgaggatccgccaggcgcagcagtcgacgaccatcgaggaggtcgagatcgacgagccggcgatcggcgccgtcgcatccgtgcgtcgtctgttcccgccaccgtcgcgcggtggcgctgagatgctggaggggtcggcggccgaggtcgccgacaagatcgtggagatcttgcgggcccgcgggctcgtgcgcgcgtaaggggggttcagatgtcggtggcagtgttggtggtgagcgagcgggtcgtcggcgaggttcccgacgtcacgttcgagctgctcggcaagggccgtgagatcgcctcggcactcggtggcgagctcgccatcgcggtgctcgggcaccaggtcggcgagctcccgttcggggcagccgacgtcgcctacgtggtcgacgatcctgcgcttgcgaactacgcggcgagcgcggtcgaggcagcgctcgctgccgtcgtcgaggccgcgtcgccaaaggtcgtgctgatgagtacgggcacggtcgggctcgatctcgccgcgtcgctggcggctcggctcggcgcgccgatggcgtcctatgcggtcgacgtcgcgacggaaggcgacacggtggtcgcgacgagtcagctctacggcggcaagcttctcgcagaggtcgccctcgagggctcgccggccgtcgtgagcgtgatccccggcagcttcgcggccgatgcgggtcgcgtcgggggtgcgccgcgcatcgagaccatcgccgtgtccctcgatggtgctggtgcacgaggcgagggtgtgcgcgagcccgaggcgagtggcgtcgacatcaccgcagcggatctgttggtgtccgtcggtcggggcatcggctccaaggagaacctcgagctggtccaagagctcgccgatgcactcaaggtgccgctcgcggcctcccggcccatcatcgaccagggctggctccccaagccgcatcaggtcggcaagtcgggcaagaaggtcaagccgcaggtctacctcgcgctcggcatctcaggggcgcccgaacacctcgaaggtatgcgctctgccgggaccatcatcgcgtgcaacaccgatccgaaggcgcctatcttcgaggtcgcacactacggcacgacggtggatctgttcgatctcgtgccggagctgaccgagcggctctaagggtgagcatggtcgcgctggttgagacgaggccgatcttcggcggagagacggagacggccaagctcgtgttctacgcgctggcgctcatcgtcatcgtggtcttcttctgggggctcgctcggcgagtgcgggcatggtcgcggggtcgccggcccgccggttggcactggctccgtcggcgagaccctgccgacatcgccgacgtcaccgagcgtccgaaggtcgcgtcgtcggtcgcggtgatcgcagccaacaagacggtcacgaagacgaagcactcggtggggatggcgcacctgttggtgttctggggcttcatcggcctcttcgtcgccacgtcgatcctgtcggtcgactacgacatcctcggcaacctgtcgcggctgatcgtcggccacaccgtgagcttcttccaaggtccgttctacctgggctacaacgcggtcttcgatcttgcgggcctcgcggcgatcgtcgggacgctcctgctcgcgctgcgacgctggttcagcccggagatccaactcgacctgcaccgcgccgagcagcccgagggaggctactcgcgcgcgaagatcgccctcggcgaccaggtgttcatcgtcgggctcttgctgatcctcctcaccggtgtggccatccaggcgctccgcatcgatggcgagggctttccgagtttcgagcgctggacctggctcgggtggctggtggcgaagctcttcgtgagcctgggtgtcggtcgggttgcggctcgtcacatccacgcctggctctggtgggtgcacgtcgggatggcactggcgttcatcgcctacatcccgttctcgaaggccctgcacatgctgtcggcccctgccaatctcatcgtgcgcgatcccaagcaggttcgccagctgccgccaccgcccgagggcaaggtgggctacagcgagctcggcgacttcacgcccgccgaattgctctcgctggacgcgtgcaccaaatgcggccgctgccatggcgtgtgcccggcgcggaccgccggcgcgcccctctcaccccgtgacctggtgctggatctgcgttcctggctcgatcgggcccaaggcatcgagctcctgctcgactcggaggatcggcccaccccgaccggcccacgggccccatcggggccgctcgcaggcaacgtcgtggccgagcgcgtgctctggtcgtgcacgacgtgcatggcgtgcgtcgaggtgtgtccggtgggcatcgagcacgttccgctcatcgtccaactgcgccgccccctcgtcgacgctggccagatggacccgacgcttcagagcgcgctccagaacatcgcccagcaaggcaactccttcggcaagtcctcgcgtatgcgggcgcgctggaccaaggggctcgagacgccgatccccgatgcgcgcaaggagccggtggagtacctgtggttcgtgggtgactacgcctccttcgacgagcgagtcgcggagctctcacggaccttcgctcggatcttgcagggagcgggcgtctccttcggcatcctctacgagggtgagcgcaacgccggcaacgacgtgcggcgcgtgggtgaagagggcctgttcgagatgctcgtcgaatcgaacttgcaggcgctctcgcaggcgacgttcgagacgatcgtcacgacggacccgcacagcttgaacaccttgcgcaatgagtaccccgccttcggtctcgacaagccggtgctgcactactcggagctgctcgcgaagctgatctatcagggaacggtggagccgaggcagctggggttgcgggtgacctaccacgacccgtgctatctcggtcgttacaaccgtgtcttcgatgcgccgcgtgccgtcatcggcggtctcggctgcgacctcgtcgagatgccgcgcaaccgacagggatcgttctgctgcggagcgggcggcgggcgtatctggatggacgattccttcttggccgagcgcccgagcgtgaaccgcatcaaggaggcccttgcgctcggcgtcgacgtcttcgtcgttgcgtgcccgaaggactacgcgatgttctccgatgccgtgaagagcgtcggtgccgaagggacgttgcgcgtcatggacatcaccgagctctttgccgaggccgtgctcggggcgcctgcgctcgaaggggcgagtgagtgagcgatggcggcgagttcatcctcacgtgcttcgtgtgcggcgagcaggggagctaccggagcctgcacgcgcaccttgtcgacgcacacccggaactcgtcgtcatcgaatcgggtccgcgaccgagctatgcgcttcgctgtccggtgtgcggcgaggcctaccgtcaggcgatcaagcgcgggcgggccgatcgcgacttcgtcgccgcgttcgaacgcgacgtgcgggtggtcggcatggacatcatgctccagcacgtcatcggcgagcatcccgatgcagtcggcgtcgacctcgacgcgttggcgacggatgccgatgagccggaggagtgaggggagcgagcccccgcgcgctcgtggagcgatcgtcgtcgcgggaccgcagcgagagcgcagaaccgagtctccaagagaggaaaggatggattggcatggctgaggtgcgatcgtgcaacctccccgaggacctgtactacctcgtcgaccggcacgtctgggttcgcccggagggtgacgtgttggtggtggggctcaccgatgtggcccagaacctggcgaagacgatcatctcggtgtcgctgaagcctgcgggcaagccggtgaaggctggacgctcgctcgcgaccgtggagagtgggaagtgggtcggcccggtgcccgcaccggtggacggcgaggtggtcgaggtcaatggtgcccttgcgacccatcctggcctcttgaacgacgatccctacggcgagggctgggtcgcgaagctgcgagcagacgccttcgatccggctgctgccggtctcgtcaccggcgatgagggcattgcgcgctacagcgccttcctcgaagagcaggggatcagctgcggctgaggtggcgcgatgagtgagacctgggcgggctgcgaggtcccgccggagctgcgctacgacttggatgccgacgtgtgggttcgcttcgagggcgagctcgtgcgactcggcatgaccgatgtggcgcagtcgcgcatgggcaagctcgttcagctgtcgtggaagcgcgtcgggcggacgatcacgcggggacgacccctctcggtgctcgagagtgccaagtgggtcggaccgatggtctcaccgctgacgggcaccatcgtcgcgacgaacgaagccgcattcggtcgggacgtcgcgatcgcaaaccgagatccctatggcgacggttggctctatgtcgtcgagccaacggtgcctgctgagttcgacgccttggtcgacggacgaaccgcgttcgagcactaccgacgtgtgatcgacgagtccggattgcgctgtttccgctgtgaggacccggtgatattcgtggatgaagatccttgaatgatccctgatcatggcgtagactcaccaggtgaacaccgcgggggatttggtgttcacctggagggtgatcgcgttggacgagcggttcagagtcggtgcggtcgtcgcacgctgatcgagtaggggcatggaggctcagtcaacgacacaagggtgacagaggggcatcgaggcgtcgcgggcgtggcgcgcgtggcgcgcgacccggaggagccgttgcggttgaatccgacgaccacgacggtagccctcccgaagagccgatcactacggcgcatgccgcagcggaacggttcggcatcacagagacaggtacgggttgtacgaagggggaaccatggcaaaggatgacggcacccagtcgatggcgatgatctgctggagttccgatctcgatcgggtctggccggtcttgatcctcgcgaccacggcagccgcttccgggctcgaagtggacgtgttcttcacgttctggggtctgcgagtcctgcagcggtcggacgttcgcatcacgggtgagaactggaagcagaagctcgagtcattgatggatccgggctcgaccgatcgccttcgactcgggaagttgaacatgggtggcatgggcacgaagatgatcaagatgctggcggacgagcacaaggtgtcgtcgcccaccgagctcttggagatggcgctcgatctcggcgtgcgcttgcatccgtgccagatgacgatggagctctacggcctgtcgaaggacgacttcatcgagggcctgcagcctcccattggagcggcaagcttcatcaatatggctgccgaagccgacatcaccctgttcatctagtgctgagcgtcgccgtcgtcggtgacgaaggggtggtcgcgcgcgtagtgcgcgccgcctccccattcggctgggaggtaacgagcgaccttggggctgccgatgtcgtggtcgtgccggccggcgaccccgaggcacttcgagcggtcggtgctcgccgtgcccgaggcgaggcgatcgtcgcgatcgcctatgtcgccgagccagatcagctggcctggcgcgcagccgagcgcggcggtgcggatcgcgtcgtcaacgtcggtgcgttgacgaagacgcttcgcgaggtgctcggggatccctcgcgaggcgtcaggcgcctcgtcgtggggcacgtcgaggacgtggcggggcggttgggcctcgtgggcgaggtcgagatcgacggcgcttcgttcatggtcctgcgcgtcgagggacgatgggtctgcctcgaggcgacctgtccgcatcagggagcgcgtcttgccggggtcccgtgcgaggagggtgtgctgacgtgtccggcgcacggctcgcagttctcgtgcgagagcggggagcgcgtgcgtggtccggctgaccgggcactccgttcgctcgctgtggtggtggaaggatcggagctggtcgtacgtgggggaggggttggctgactcacgaggggtcggtacccaggcgcggtattcggctggatggtccccagtggtcccgggccggtcagcggaaccacttctgtcgtatgttgccccgtgcggcttgtgaatcgattgacatccaaaggggcagcgagactcgcaaggcgtccatggcaatgggactcccattgggcagcggctcccggtgacaaggttccgcttgccccggaggtcatggtgcagggaggtgatgccgagcaccacgatctggggagctagtccctatagctgtgtcgcgggtgggtcacttctgaccggtgatcccgggtcaaaagaaggccggtgcctacacacccccgcctgcgcggggagcacctcgccagcaacgtcacggaccacaccgaggtcggatcacccccgcctgcgcggggagcaccgaaatccagttgagccaggcgcaagttcaggcggatcacccccgcctgcgcggggagcaccccaacgcactcctcgtccgcacgcccgaggagggatcacccccgcctgcgcggggagcactcagtcaacgcggccagccgcgcgcaagtacggggatcacccccgcctgcgcggggagcactcgacggtgatcccctcaatctcggtctggccgggatcacccccgcctgcgcggggagcaccagaacctggccatccagcagtcgagcgtcgccggatcacccccgcctgcgcggggagcactccgtcatcgcgtcctttcttgagtcctgctgaggatcacccccgcctgcgcggggagcaccccgccgcgaccgacagccgcaggcgatcttcgggatcacccccgcctgcgcggggagcacgacgtgggtgcccctcaccgacgcgagcgggtcggatcacccccgcctgcgcggggagcactatctatccaccgaacctggcgagcgcccaggtggatcacccccgcctgcgcggggagcacagcttgccctcaatctccagcaatccacgtaccggatcacccccgcctgcgcggggagcacagatcccacacaaggacgccctcggggagctggggatcacccccgcctgcgcggggagcacacgcggggtggtacggatccatcctcaacgcgcggatcacccccgcctgcgcggggagcacacgaccaccaccacgtcgtcgggcttcggcttcggatcacccccgcctgcgcggggagcaccacgcgcggattgctcatgtaacgccacgcggcggatcacccccgcctgcgcggggagcaccgaccatcagaagcttcggttggcgaccgagaaggatcacccccgcctgcgcggggagcaccgctttgcagcggcgtgaggccgaaggtactgcggatcacccccgcctgcgcggggagcacaaaagcccgacggggagtattgcatgcgacgccggatcacccccgcctgcgcggggagcacacccgtgaagagatgcgctcgtgggtagagcgcggatcacccccgcctgcgcggggagcaccggtaatgcccacttctgtctcctttctgctcacggatcacccccgcctgcgcggggagcacctcacctgcgcggcgcgctgagccaggaatgtcggatcacccccgcctgcgcggggagcacttgggcagctcaggacagtagacctccgctgcgggatcacccccgcctgcgcggggagcacatcgcccttggccttggccttggctgcctcagcggatcacccccgcctgcgcggggagcactcggcgtccttcgccacccagttcgggaggtgcggatcacccccgcctgcgcggggagcacacggtggcctgggggctgtcgccgggctggatcggatcacccccgcctgcgcggggagcactacttgaccaccatgtgcagcacacagataccaggatcacccccgcctgcgcggggagcacgggtcgccagcgcggagggcgtcgaggatcgggggatcacccccgcctgcgcggggagcacacgtgggacctccagatcgccggacagacgaccggtgggcttccccccatttgcttgacagtctgaatttaggccacggccacctcccggcaggcccaggagagctcgtactcgacgggcggtaggtacccgaggcttgagtgcaggcggaccgtgttgtaacggtgaatccagctagcgatggcagagcgagcccctgagaggttcgcgaagcggtagcgagccaccagctcgcgcttcaagctcccgaagaaggactcggccacggcgttgtcgtagcaggtcgcgaccctccccaccgactggcgaatgccaagggtcgcgagcaggctccgtaccttccgggagaggtactggctgccgcgatcgctgtgaaagatcgccccagccaggctgccccgagtcccgagtgcttcgcggatcgcctcgaccaccaggtcatcgggcatgtgacgcccaagtgaccagcccacgatgcgcctcgagccaagatctgccaccgtggcgagatagcagaacccctcatcggtgcggacgtaggtgatgtcgctcacatacctgcgcttcggctcaccaggagcgaagtcctgacggacgaggtccgggagcgctgcgtcctctccccgcctcgtcgtgactacgaagcgccggcgtgggcccgctgccatctcgagctcgcgcatcaggcgttccacccgcttgtggttcacgcagaacccgcgccgtcgcagctcgtgggtgatgcgggggctgccgtaggtgccgtcgctctcgtgccagatggcgcgaagctcgctcgcgagcaccaggtgctcgggatcctcgcctcggtcccgacggtgtcgccaggcgtagtaggcctggcgagagaccccgatgactcgtgggcttccccccatttgcttgacagtctgaatttaggccacggccacctcccggcaggcccaggagagctcgtactcgacgggcggtaggtacccgaggcttgagtgcaggcggaccgtgttgtaacggtgaatccagctagcgatggcagagcgagcccctgagaggttcgcgaagcggtagcgagccaccagctcgcgcttcaagctcccgaagaaggactcggccacggcgttgtcgtagcaggtcgcgaccctccccaccgactggcgaatgccaagggtcgcgagcaggctccgtaccttccgggagaggtactggctgccgcgatcgctgtgaaagatcgccccagccaggctgccccgagtcccgagtgcttcgcggatcgcctcgaccaccaggtcatcgggcatgtgacgcccaagtgaccagcccacgatgcgcctcgagccaagatctgccaccgtggcgagatagcagaacccctcatcggtgcggacgtaggtgatgtcgctcacatacctgcgcttcggctcaccaggagcgaagtcctgacggacgaggtccgggagcgctgcgtcctctccccgcctcgtcgtgactacgaagcgccggcgtgggcccgctgccatctcgagctcgcgcatcaggcgttccacccgcttgtggttcacgcagaacccgcgccgtcgcagctcgtgggtgatgcgggggctgccgtaggtgccgtcgctctcgtgccagatggcgcgaagctcgctcgcgagcaccaggtgctcgggatcctcgcctcggtcccgacggtgtcgccaggcgtagtaggcctggcgagagaccccgatgactcgtgctgctgccgctacagagaagcccttggcctcctggcgggagatccagtggtagcggctcactgtcccccctccttcacccagaaggccatcgctcgcttgagcagctcgcgttccacggtgagctgcttgacctggcggcgcagccgtgtcagctcctcgcgctcggcgctcgtcaggccctctcgctcacctcggtcgatgcgttcctgacggacccagttaccaagggtctgctcgttgatgccaagctcacgggcgacgtcagcgatggtgcggcgctggtcgagaaccaacgctgccgcgtccttgcggaactggctcgggtagcggccgcgtcgtcgtccagcggggccgtcgcccggtggtgggttcggtgtctggctcatcccttcctcctatagcaggtgtcaacctggaggggggaaggccatcgtgctgctgccgctacagagaagcccttggcctcctggcgggagatccagtggtagcggctcactgtcccccctccttcacccagaaggccatcgctcgcttgagcagctcgcgttccacggtgagctgcttgacctggcggcgcagccgtgtcagctcctcgcgctcggcgctcgtcaggccctctcgctcacctcggtcgatgcgttcctgacggacccagttaccaagggtctgctcgttgatgccaagctcacgggcgacgtcagcgatggtgcggcgctggtcgagaaccaacgctgccgcgtccttgcggaactggctcgggtagcggccgcgtcgtcgtccagcggggccgtcgcccggtggtgggttcggtgtctggctcatcccttcctcctatagcaggtgtcaacctggaggggggaaggccacggatcacccccgcctgcgcggggagcactacttgaccaccatgtgcagcacacagataccaggatcacccccgcctgcgcggggagcacgggtcgccagcgcggagggcgtcgaggatcgggggatcacccccgcctgcgcggggagcacacgtgggacctccagatcgccggacagacgaccggatcacccccgcctgcgcggggagcacttgagggtggcgggtgaggtaccccaatgcgagggatcacccccgcctgcgcggggagcacgagggtgacgctctcgaccggatcgcggacctcggatcacccccgcctgcgcggggagcacggctactcagtggtcagtcttgaggagaccccgggatcacccccgcctgcgcggggagcacccgtcggcgacctctctggttgccttgtatatcggatcacccccgcctgcgcggggagcactcgaacagcacgagcgacgagccgacctgcaacggatcacccccgcctgcgcggggagcacctaacgtcacatggtatgtggtgatgctcaggaggatcacccccgcctgcgcggggagcactgcgataagccatggggagctgtcgaccaagcgtggatcacccccgcctgcgcggggagcacggcctcaccggcctcaccacgacccgccaagtcggatcacccccgcctgcgcggggagcactgctgaactcgtgatcgtgttccccgccaagtaggatcacccccgcctgcgcggggagcaccgaagtcccagctcaggggcactgggggaaaaaggatcacccccgcctgcgcggggagcactgcccgccgatcccgtagccatcgaccggatcgggatcacccccgcctgcgcggggagcacacctcgttgaccccgaggttctccacaatcgtcggatcacccccgcctgcgcggggagcacctcgctcctccctcttcgtcctctcgtccccacggatcacccccgcctgcgcggggagcacggtaggggccgtgctcatcgctgagggcgctggggatcacccccgcctgcgcggggagcacccgttcgttgcccggggcaacgcagcccactggggatcacccccgcctgcgcggggagcaccgccgttaccgatcacgatccaaccgggaagcaggatcacccccgcctgcgcggggagcactcgcgttgatgacccggacgagctctggctggcggatcacccccgcctgcgcggggagcacttgatgcagaccagtgctgatccgcgcatcgacggatcacccccgcctgcgcggggagcactgccgtggcgacctgcgcgtcgtcggcgttcagggatcacccccgcctgcgcggggagcacaccatagcgtcgagggggtactgcggatgagcaggatcacccccgcctgcgcggggagcacctgctatcgatgactgctctcatgctcttcagaggatcacccccgcctgcgcggggagcaccaagttcagcttcagaatgcgtactgagtcggaggatcacccccgcctgcgcggggagcacgtcagttgacagatcgactacctgaggcgactcggatcacccccgcctgcgcggggagcacccgtcgtgattctgtccttcttcggcgtggtgaggatcacccccgcctgcgcggggagcacgagttgtcgaggtgcatgtgctccgagcaagggggatcacccccgcctgcgcggggagcacagctcgcgttgcgggtcgtcaccaggcacgaggggatcacccccgcctgcgcggggagcacccccagtcgcccgagaagctgagcttgtccgagggatcacccccgcctgcgcggggagcactcaaccgcgtgccccccacccgcgaggccaagcggatcacccccgcctgcgcggggagcacggaatcttgactacttcaccatccactgcctccggatcacccccgcctgcgcggggagcactcagcctgagactctctgatgatggataccgccggatcacccccgcctgcgcggggagcactacattgccttcactggcccgtacctgacccagggatcacccccgcctgcgcggggagcactgctcccgttgctgtcgcagtgcgttggccatgggatcacccccgcctgcgcggggagcacccgatagtcccgaagatcggagagtatcccgaaggatcacccccgcctgcgcggggagcacgtctcactcgggaagagctcgaggagtctccgcggatcacccccgcctgcgcggggagcacccaacccacatgaccaacgtcggcccggttcgaggatcacccccgcctgcgcggggagcacttccgtgtgcggcccgtacttaccagtcatcccggatcacccccgcctgcgcggggagcacatgtcgtctgtgtaggtagtcacttctgccaccggatcacccccgcctgcgcggggagcacacttcaccacatggatgtttaccggctgggcttgcgaataagtgtaagtccctcaaagtccacgggctcccatgtgccgcctacgactttgaaggcaaggccctgttcgttgcgagcggggtagaccatgaccgctcggccgccttctcccaggtgctcgttgactcgttgccacatgaggtcacgaacgcgggcggtcacggttcccacgaagaccccaggagcgatttcgagcagccacctggtgatgtggccacggagcccaacggggacagcggtaagcacgagaaccgtcatacgtcggagctgtagtcggtgcccgctgggacctcgccgatgcgatcgtcgaagagaacgagaccgggttcgcccccaaggtcggcatctggcgtaccaagcaagagacgaatgtcgtcgacggctcgttcgaggagatgtgcctcgtgaatccgttcccgcatcgttcgtcggacctgactcgacagacttcccgttcgctgggcggctgcctcgaaggccaccggtatcgccagttctaccttgtagaggtcggcgacgtcgtagacgaacgacagcgagtggccagtgtggacgaagcccaggccgggactacagccgagtgcaacgatcgccgtatggaccacgccgtagagcacgctgttcgcgatggagagcgcgcgattgacatcatcgcccgcggacgagttgttggggtcgtagtgccgaccatgccagtcgatcccaaaggcgctggcaaggtgacgatacgtgcgacggatgcgcgcgccctccatgcctcggagccgctgcatagtggccttgctcacgtcctcgccgggaaagcgcatctgatacatctggcgcgcgacccggagtcgatcttgccgattcgagacgagacgagcttgcgcctcgaggaagcgcgtagactggaacagcgacggtgcccaggcgtacagacgagtatcaccttcgcccacccagcacaccacgaccccggattctcccaggagcagcatggcttgatgggtgatgcgcgttccgggaccgaggaggagcgtgccgaccgctgctgcaggcaggtaggtcgtgccggactctgttaccgacacgactgcattcgcatcccgatggacgacgcagtgctcgaggtagacgaacgaggatcgtcgtgagaccggctggagttcgcctatcccgacgcgctctccactgagtgggacacggccttcagtcatcggggtctcgctggtgcagcaagcgtgagcaggccgcaaccataggcgcgtgcgtggcctatgccggtgaccaagctgcgccgaaggagctcccggtcgagaacctcgagatggcccatgaactcggtcaacgcgatggtcactcgttggccttgcctgcggaacaccatccggcgaccgcctgtcaccgccacgtctggttcgcctgtcgaaccggtacggatcgtgaaaccgtgctgctcggaccgcgcaaggagccagccgagctgctgtgtgatggtgacgtggccgtggcgcttcgtgtctgcggatccggacgaactccgaccgctccgcaccgcattggctgcgagccggaaggcgtagacctggcctgtctcgagtcgatcgaggaggggcccgtagggcttcgtgtcgtagtccgtgcctcggacgacttgccctacgctcgccgcgaagtgggcgaactgcggctggactgcgctcaccacgtagagaatcgggacccgagggtcgtcgccgtcgacgcgccagagcgttcggccaatcgaattcgcctcctgcggcacactggccgacgtcgcttgggcgatgatcgcgtgcatgcgctgcgggttccgcagaacgctgagagcagcctgcttctgtgggtcgatgtagagccgagtgaggaacatctcaatcgccctcctcgagcagggccatcgggtcatgggtcgagcgagccgattcgtggccgtggccgatggtcacctcgacgtagtgatgactgacccggcggcgcgtgtaggagcgcgtgagtgggtcgaagcttcgtgcctggtccgcaagctcgacatcgccggcgggattctcgacgacgagttcacaccgtatcgacgtcgcggactgcgcggggtcgttggcctgccacgggatgcttgccagcacgtcgatgagcccgccgtcgtagacgccgagccgcagcggcttgtccggggggcaggagcgtcgcccgaggtacaggggaaacaccggagtcctgagtgcgtcgtcgagctcttggagctgcgcggcgtcgccttcgagcccagcgacgaagcaggcgtcggcgaggtagaaccgttcggtgacttgcgtgctcgtagcggcagagcgatagccgcccgatgcagtcggcagtctcccctcgccgggcgcgaaccgcttcttgtcgtcgaacagactcgacagtgtgtggaagtctcgcaagacttcacctggtcgatcgatgcgcacggcgaagcgcagcgcgccgagatcgtcgagagctgcggaccgaggacgccccagggcggctgcgagcagcccgatgacccctgacttagttgggaaacgctccgttcgtcggtagtggtcgagacgctggctgctgccccaggcctgcaatggtcctccaaggcgcagtgcgagcacgctcatgatgccatgtgctccgcggttgcggcctcgacggcgtcgaggagctggggaaaggcgatggagtcgccgaggtgagtcgcgaccgcctgctccagcttcgggacatagctcgcccagccgttcaggcgaggcacgccatagagtccgtcgatgtcgtcggcgtaggtcgccaagcgctcggcagatgcgtggacgtacccacgatcgctctcgactggtgcctcgaaggccccgaccagactgaccggctggtcgcctcgcatggacacaaacaccaagtcgggcaccgtcaatgctgcaaacgtgttctggtgtcccgttggcaggctcttggcaaacgcttcgataaaggcgcgcacgcccgtcggtaccgcgtcgggatcccccaggttgtctgccagtcgtccaaggctcacggtggcgaagcgatagacggtcgcggaattgaactcgatgaaccccatcatggccgcgccggtctcgtcgtcgcctgccaggtcgtcgacggtggtgtaaaagtcgaactcggaggtgacgcgatgggtcgagatggcatgcgcgacctggcacgcggcgtcgacgttgagattcggggtgtcagcgatcatcctgccgaacagagcgacatcgagggagagatccctgcccatcgcggtcgtcagaacgtcgaggtcgaggtcatcgccggcacggagggagcgttccagctctcccaccgccgcatcgattgcactctcggagacgaacaacgcgtattcgagatctgcaggttgggtctcctgggcgcgcttcttgagcttctcctccttgaggccgagcagcgctcccgcggcgaggttgacgagtcgtgcgacgtcgtcctcgcgcacatcgagatcgcgcacgcgggcctggactcgctcgtggaggaggccggcaagcttacgcgtgcgaattccgcccccgcggctgcgcagccagtcggtgccgatggttgcgaggttctcattgaagtagcgcctcgtcgcgcgcttccacgactgtgacgacacccgagctcgacgagcaccgccatagagcgcggtctttggtgcgttggtgtcgtcgcggttcagacatgagggcggcaacgtttgcaggacgtgcacgtcgatgactgcgcgggtgggatggttcatggttcctccttctgttcggcgggtgattgctggtcagggtcgagcgcgtagtagtctcgtgcccatctcaggctgactctctgtagtttctcgggcaggagccaggtactgagatcttggtagagccggggatagtcgagggacacgtccgcaccgcgcatgagcgtgaccagtccccgaaggtgaacgccgagggcgtcgatggtctcgctcgcgagcgcgctccggaagcgccgttctatcccttgctcggatgcgccgctatcgccgcgagaggttcgcaatctccgagttgcgagcccgaaggtcgagccttccttgtcgagggcgccaggcgtcttcgattggtggtgcaacgcgaagagaccgagcgcgaggtgcgcagccggctcacgccagcgcgagcgtcccgtcaccatgaggacgtacggccaagagtcaggggactcgtcaaagctccggccgacgttgcggcgaagcgtcgcgagcgctcccgggtctcgggcgatcatgtcacgtacctgacggaacagtgtgtcgttcgtcgaggtcgacgaagttgtggtcatgcagctcccttctctgggctatccgatggactgaactcgttgcgagcccgtgcgagcattcgtcggaagcggtcctcgccagcgacacccgcgaaggcctgcgccggggcgagctgcgctagctcccggctcgcgagatcccgagcgacggcctcgacgagggcagcccactcagcccgagggcgctcgaggtcgtcgatgttcgcgagtcccgtcaggaagtggcgatagggcgcgtcgagccgaccgtagagctcctcggcgagcgccgaccgtgccgccttggcgagcgctgccttcccttcgggcacccggtgtcgctttgattcctcgtggaaggagaggtcgtaggagaggtagcgagcttcggcgacgtagccgagtgcttgggcagcgtgcgctgcgaaggtgactgcgtcgattgcgacggtggctgctgcgggatcctcctggttcagtacggcaagaggagtgtcgagtcggtcgtaggccaggtcgtcgagggtggtcgacatgttcccgaactttgcggaagtgacgaggagggacacgagggcgatcccccgcgattgcagaccctcgacgaaggacaggacgcctgcgcgctgttcctcagcgccgagcgcgagcacgctgctcaggccccgccacacctgctggcccgggcgcgcccgcagtggcacatagctgacctctgcaccacgcctgctctccatccgccatccgacgtgaggatcgacgtctcgcgcggcgcgacgatcaacctcatcgccagcgcagatgagtacccgcgggacgacgatagcatcgccgcggcgctccgggaagaggcgaatccgccgaccttgccaggtgaacaggtcgcacacaccgtcgggcgcgcgcatcacccgtgtcggccccagcgggtcacgttcccatgcgggcacgtcgtcctcgcctccacggatgagattgcgatactgccacgggacgaggttgaggaggagtgtctcgcgcagtgtctgcccgacgggcgcgacgaacccgatccaagcgaggtagccgatcgcgggggtgtccttgccgcccttgaccttcggattccccttggccccagtcttgtcggatgccgagccgaaggcatggcgctccacgagccagcgtgctgcctcggcggggctcagtgccagctccgtgcggtcggtgatgggcgtgaagacgggcacgttgttgcctgatggcgcgtaggccaccagactgttggcggtcttgacgccgcccttgcctgctggctcgaggtcggcgacctgaaagaacgggaactccttcgagaacaggtcgaagcgatggcgccaacgggcgaagtaatcgtcgatggcgtcctccgaaaaccggtcagcctcccagaggcgaccccactcggcgtcatccttcgggcctcgcaagatgcggtaggcgagggcgagcacgagtcgaagcaaggccggctccagggtcgggaagtcgacgtcgaagccaacgatcgtatgggcgagcacgaatatgtctcgaagactcacctcgcttcgccgaccgtctctgaaccgtacgggcagccacggctcggaggagaggtcaaagtgcatctcaggctccaccgctcaccacctccaatccctctacgtcagtatatcgaatgcgataatacccgagcgagcattcaccgtcaagtcccaacacgagcacccgctgacgccgtagccaggggtgacgacgccaaccctccggcacggcgagactggttgcagcttccgtgaggtaactaggcagccggaccaccgagccgaggaccgcctcgacgtcatcgggcgtcggaggatgctcgagactgacctcggtcgtcccgaagcgcgcgatgttcggcgaggggccgacacacgcgatcgcaacctcgatgctcgggacgctgtcgcgcaccgccgcttggacacgaggatcatcgtcgtcttcagggtcgccaagacggatacgttcaagttccaggagataccccgccctcgtcgggtccgagatgacgaactgctccgcccgtcgttctcgttcgtgttgctccgattgccattcgacggcgacccgagcgccatgatcatgccaggctggagcgatgacgtcgtcgtccccatagacggccgccaccagggaggggacgtcatcggggagcgtcagcgagtcccgagcgagcagcagggcggccgttcgaagcaacaggtgctctccgtacactcgcaccgagcccgaaggaaacgcgggtggtccggttggcgagcgcgtgaaccctgtcacgatgacacgaggctctgtgaagccgacggggcgtcgcgtgccgcggtggcgatggaccctgccgattcgctggaggacgaggtcgaccggcgcgaggtcggtcgcgagtacgtcgaaatcgatgtcgagcgattgttcgagcacctgtgtgccaacgacaacctgccctgagaggcgtgtgccaccgcggccgaagtgctccgcgagccaggactccttcctcagtcgatcagctgtggtgaatcgagcgtgcagcaggtgtactgtgcccatgggtcgccgctcagcgacggcgcggtaggtgcgttgcgcccttgccacggtgttgcggatgacgaggatgttcgccccggcctctgccatttgggcgaccatctccagtagcggcatcgaggattcgtcctcagggtcctcgtcaaggtgctcgaggcgcaccgtaaccgatgatgcgtccgtagcaactggagtcgtggtgacgtggccgtcggtcgagacagttgtgatcgagggatagcccacgagcccgagtggtgtcgagtgtcccgcatacgcctcgatgagacgtgcgcgcacggcaggagggagcgttgcggagaggagaatcaccggaatccgctccgcgccgagccactcgaggacacggcggaggaagaccgacatgtaggcgtcgtaggcatggacctcgtcgaggatgaccacttttccggcgagaccgacgtgtcgcaaggccacgtggcggaccttggcggttccgagcaggatctgatcgatcgtgcccacgacgaagggggcgagcaggcggcgtttgggaccggtgaaccatgcttcggccgtgacgcgtgcgatgtcgccttcgtcgacatcgaccgcggacggagcgccgttctcaaggaggtcacggaacgctggcacctgctgtgcgcggccgtgggcaagttcgagcacaaaggtgccgggcccaagctgctccaaccagcgcctggtgcggtggaacatctggttgctcgtggcttgtgttggcaggccgatgaaggctccgccgtgaccttggcgagtggccaagacctcggccgcagcgagggcggcttcggtcttacccatgcccatcggcgcctcgataagaactaggcccccgtcgccttgctcgacggcctcgagcgtctggcgctgtagggcgttcggcgagaagccgaaacgatgctcgaaggcgggcgcgccgaccacggctccgaggttggcgactccgtgccatccgagttgcacgagcgcctcggcggcgcgctgctgagctgcgtggaggtaggcgtcgtcataggggaggcagaggtaggggaagagctgctcgttgctcgcgatccagtccgcgaggatgacgaaccctgcgagtgcgagtcgccgcgcactgccgagttcggttgtgcctgcgaggccgagtacctgctgcgcaccggcgacctcgacgacgaggtcgaacaggcgctcgcgcgcggcactccaggggtctccggcaccgccgagaggtcgtcccgccagaccatagagttcggggcgcttgatcggttctcgctcatagcccagaggagggaaccaaccgtggtgaccaccgaggatcgctgcaactccgcggatagcgggttcgctccagccgcgagctgcgagcagcggctgcaccgtggccgccgaggcgagtgcgtgaggtgccttcgagcgctgggggagcggcttgtccacggcgaggccggcgtcgcggagttgcgggtgcagccagtcgacctggatttggaaagcgggtgttcaggacgaacgctggcggcgtgcttaacacatgcaagtcgaacggggtaccaaggtagcaatactagaagtacctagtggcgaacgggtgagtatcacgtgagtaacctgcctcaaagtaagggataacaccgggaaaccggtgctaataccgaatactctcattcggccgcatgactgaatgaggaaagatttatcactctgggacgggctcgcggcctatcagcttgttggtgaggtaacggctcaccaaggctacgacgggtagctggtctgagaggacgatcagccacgctgggactgagacacggcccagactcctacgggaggcagcagtggggaatattgcgcaatgggggaaaccctgacgccgcgacgccgcgtgcgggatgaaggccttcgggttgtaaaccgctttcagcagggacgaaattgacggtacctgcagaagaagccccggccaactacgtgccggcagccgcggtaagacgtagggggcaagtgttgtccggatttattgggcgtaaagagctcgtaggcggctcggcaagtcggatgtgaaatctccaggctcaacctcgggttgcagtgggatacgggcatggctagagtgcggtaggggtgactggaattcctggtgtagcggtgaaatgcgcagatatcaggaggaacaccaacggcgaaggcagcgatctgggccggtactgacgctgaggagcgaaagcatggcgagcgaacaggattagataccctggtagtccacgccctaaacgttgggcactaggtgtggggcctatttcgacgggttccgggccgtagctaccgccttaagtgcagcgcttggggagtacggtcgcaaggcttaaactcaaaggaattgacgggggcccgcacaagcggcggagcatgcggcttaattcgatgcaacgcgaagaacctcacctgggtttgacatgtagggaaaagctgcccggatgcggtgtcctttcgaggccgtacacaggtggtgcatggttgtcgtcagctcgtgtcgtgagatgttgggttaagtcccgcaacgagcgcaacccttgtcctatgttgccagcgggtagtgccggggactcgtaggagactgccggggacaactcggaggaaggtggggacgacgtcaagtcatcatgccccttacatccagggctgcacgcatgctacaatggccggtacccggcgtcgccaacccgcgagggggagccaatcccaaaaaaccggtctcagttcggatcgcagtctgcaactcgactgcgtgaagtcggagtcgctagtaatcccgaatcagcacgtcggggtgaatacgttcccgggccttgtacacaccgcccgtcacaccacgaaagtcggcaacacccgaagccggtggcccaaccagcaagggagggagccgtcgaaggtggggtcggcgattggggtggccctaaatccatccgatttttcaggcgccggatgggaggtgggtcagcctggctgcgcgtggacgagccgagccgcggctacggtcaccgatgtcggcgtagttcagatcctgaggcgtggcgtcgggggcagcggcacacatcctccggcctcgggtgtgtcctcggctctgacgtgctgaggcgggagctgtcgtgatggacgatgacggacctcgacgcagcccggtcagtgccatctcgtgcggcctcgtgggcacggtgaccccgctgcatgagctgcgctgtgttgtaccagtgcaccgaggccgaggtgagctccgcgagcgtcgcgatgggtccgcgacgaaagggcgagcgaaggtggagtcgttggcctacgggctggtcgtggtctctgtggggcgtggcgtcgtcgccgtcctcggcgaacttcgaggcccctggacctgttggcaatggcaccacgtcgctgtggacggcggcgctcgacgatcctgcgtctgcatgagaggtggcgatcgcagccaagagcatcctcggcctgctggaggcccttggctgtgcacgcggcgctctcgacgaactcggtgccgctgcgaagcgagcctgtctccctggtgatggcgtgccgacgaagacgcagctgtgaacgccgtgcagccgaaccagttggtgagcccgacgtcggtggcgtcgaccacgtcgagctcgcggggcagacggctagcggtctcgtgcgcccgaagcgccactgaacgaggcagggggcgagttgcaggctcggattgcggaccgtcgcgtgtcgtctcgtgtcccgtcgcatcccgcgccagctatgggggcacggggagctgcggacgcggccggtcgcggagaggctcgttgcgcccttggtacgggtactgatcgtcgttcagggggcctgagccgatggacaggtggagcctcggacgatcgaggtgcgcgtgcggtgcgcccgagcgatcggtgcgaccccgaatgcgtgcgttgcgtggccacgtcaaggagtcgcagatcacactgatcgtctcatcttccgcacgcgtcggacgccgtcgtcatgtgtcgagatcatgcgcttgacgtcgaggttcccgggttcggagcgcgcacatcgcgggcgtgatcggtggtgaagcccggctgctcgcgagcttcgatgcagtcctggtcgtgcccctgtggcgcgtcgttcgggtggcgtcgcgccgttcggccgtgggcttcgggaatgagtagcgagcccggcatggttgttcgatggtccgtgtgagcttcgatggctcagctacgatcgtcgagaccggtgatcgcagcgagcaggctctcgactgtgaactcggacgtcggggcgtcacgtaccactcgaccgagccgcaacacgatgatccggtcgcagacctccagcacgtgggggagcgtgtgggagatgaagaggacgctgagcccacggtcgcgcgccgcgcggatgaccttgagcacctcgaggctctggcgtgctccgaggtggttcgtgggttcgtcgaggatgatgacatggcgagcccaggtgatcgtgcgcgcgatggcgaccgcctggcgctgtccgccggagagctcggcgaccgtgcggcccatgccctcgatggtgatgccgacacgctggagttcggcgagggcctcgcgctccatgcttcgctgatcgacgaagccgagcctgccgagcaacccacgccgacgtcgctcacggccgaggaagaggttcgatccgatggagagatccggtgcgagtccggagtcctggtaaagggtttcgataccggcggttcgcgcctcgcggggtgagcgccagtgtcgttgctcgccgtcgacccagatctcgcccttgtcgggttcgaggacgcccgagatcgtcttgatgagggaggacttgccggcaccgttgtcgccgacgatgccgatgacctcgctcgggtacacctggaggctgacgtcctcgagggcgaccacggatccgtaggtgagcgagaggtggcgcagttcgagcaccggttggcgcgtcgtcgtggtgctggtcatgtggtcatcctcccggtcgcgttcgaacgacgtcggagcgtctggagcagcgccgcgagggcgataattgcgccaacgacgacttgaatccatgtcggggccacgttgatgaagatgaggccgtcgctcaccacggtgaggagagccgcgccgaggatcacaccccaccacctgccgacgccgccgtagagggaggcgccgccgatcacgaccgcggcgatggcgagcagattggccgagttgctgacctcggtcgtcggggcggccgagccggatcggatgtagaaaaacatcccggtgagtccagcgaggacccccgagaggatgtagatcgaggcgacgtgacggcgggtcttgatgccggcggcaagggcagcaaactcgttcgagccgatcgcgtaggtgtagcgcccatagacggtgaagtgcaagacgacgccgagcacgatcgcgatcacgatcacgatgatgtcgagccaggtgaacaggctgatgcccgaggtgctccagacgatggcccgcggatcgtagcccaccggcgctccgttggagatcacgagtgcgaggccggcccctgcgctgtaggtgatgagggtcgccacgaacggcaccaggcggaacaccgtgatgagcaacgcgctgatggctccggcgactgccccgaggcccgcgcacaggatcgtgccgagcaccaagatgacggcgaggttgtcgccgtgggtgacgagtggctggatccatcccgccacgatcaccccggtgaccgcggcggtcgatccgacggcgaggtcgatgccaccagcgatgatgacgaacgcctcggcgatggcgatcatgacgagaccgctgaagtcggtgagcaggttcgtgaactcgccgatccggaagaagagcgtgttgcgggcaccgaagaacaagatcagtgcaatgagtaccacgacgagcacgaactgctggttggtgacgatacgccgcaaggttggcgtcgtcggtcggctcgtcacggccgctggggccgcgtcgtcatcacgcgtcaggctcacgtcaactcctcccgccagggctcatggcaaccacgagatgcgtgtgtctccccggccccgggggttgggtaccggggagacacgtgcgcgtcgagctagctctggacgtactggtacttctggaggatgctctgtggtgtcgagggcgtgagcaagatgttcgggatgagctgcaggtggggcaccggcttgtggtgcagtgcgtccacggcgtactcgatgatcagcttgccctcgagggtcggctgctgggagatgatcgccgagagcgacccctgtccgcccgcctccatcgactggatgttggtcgcgtaggcgtcgtagcccacgatcttcacgttcgcgccttcggcgccggccgccttgacagctgcgctcgcaccttctgcatccgtgccatccaccgcgaagatgccgtcgaggtggtgggcgctgatgtcctgggcgaacccagactgcgcgacgctcggctccgactcgctcacgacgtcattgagcacctggatgttcgggtagtgcgccttgatctcggccttgaagcccgcgacgcgttgggcgtcggtggtggtggtcagcgacgagacgccgaccgcaaccgtgcacgggttggacgcggtgcagttctttgcgtagtccatggcggaggccagtgcttgggccgccgtctcgccaccttggtagttgtcaccggtgacccaggaggtgatcatgctctggtccgacgatccggagtcgacgttgaggaccttgataccttccttgacggcctcttgcatgtaggtgttcaaggccttcggatcggtgggcgcgaccacgatggcgttcggatgcagcgcgaggacctgctgcaggatcgggatctgcgtcgctggcgagtagtcgaccgggtcgccctgccagacgagcttcacgccgagcgccttggcttcggcggccgcgccgacgtacatcgactggaagaacggatcggcttctgcgccgacgacgaaaccgatggtggtgccgctgctcgaggccgtcgtggacgacgacgtcgtggacgaggacgacgacgtggatccacacgcggcagccaggagcgatgcgccagcgagcaccgcgccgacgacggctggccgacgccaggtccgaagagaccgagtcatgaattcccccttctcccacgcgggacgtgctctccgttccgcggttgggtgtgagactagcgggctctgatatcgttgtcaacgaccatcgggcgcggggatctcacccgatcctcgagcgacgaggcgccacggtgcgtacgcggtctggatggggagcgatgggtcgtccatccgtgcgaacagcagggaggcggcgagcgctccgatctgctcgacctcctggctgatgacactgacgggcgggtcgaggaggtcggcgaggtcgaagtcgtcgaagccgatcagcgcgacggatcgctcgagccctgcggcgcgcagtgcgtagatgacaccgatggtgatgaggttctgacccgcgagtatggcagttggcgggtgcgggccagcgaggagttcacgggtgcgctcggcggcctcgccgacggagtgcacgtccatgaccgcgaggcgcggatcgatcactagaccgccagcgaccaggccgtcgaggtagccaagcctccggtcgacggcggtggcgatcgtggagagatcgccgagaaaggcgatgcgccgatgaccgtgggcgatgaggtgctcgacggcggctcgcgcgccagcgcgattgtcgatgaggacggcgtcggcatcgagatggcgcgggggtcgatcgacgaagatgaccgggacggacgcgcgctgaagctcggcaaggtagtggtggtcgtcggcggccggttcgacgacgatgccgtcgacgccgtggcgccacatcgctgcgacgagctggcgttctcggtcggggcgctcctcgtggctcgcggcgagcaccgagacgccgcgatcgcgcgcggccagctcgatcatgcggaggatccgcgctgggtgggggttcgagagatcgtcgaagatcgcggcgatcgtggaggagcgtcgatcgagacgacgcagcgagcgcgcggagaggttgggctcgtagcgtaactcacggatcgcggcgcgcacgcgctcggtgacctcggccgtgacgcctggctcgtcgttgacgacgcgcgacaccgtcttcagcgagacccccgcgcgatgggcgacgtccttcatcgtggctcgagccttcggggtcgggcgcgtgaactcggtcgtcacggtgctccttcgtggtccggtgcccaacgggtacgagtgctcattggtcgactcgcgctcagcataggcagctcggcctggtgcgtcgaggcacgtcccgagctcgggcctcctcaggactcctaggtccaagtcgacgtcggcaccgatcgcctcggtgggtcggcgcctcggcgggtgcaggtctcgcgagcgacctcgatgccgtcgcgcacggccgcgagcacaaactcggtgtcgtcgaccgtgcgccggccgtggtaggcgaacgtcgcggcgacggtgccggtgagcgcgtcgcccgcgccgacggtgtcgacgacgcggaccggagcgacgggaagctcgaccacgcgaccgtgtaccgagacgaggacggggcctgccccctggctcatgatgacagcggctggtcccgaggtcgcgagatgggcgagggcctcggccacggtcacgtccggctcgagccagcggaggtcgtcgtcggaggccttgacgatgtcggcatgggcgatggcctcgtggaggcgctcgcgatagcgctcggggctcgcgaccgcactcggacgtacgttgaggtcgacgatgcgcaacgatgcggcgcaggcacgaaggacctcgacgacgctcgttgcgagcgtgtcgagcgcgagggcgagaccaccggtgacgaggacgtcgccggcgtgcgcggcgtcgttcacgcgatcgtggcccaccgggtcgtccagggccgtgccctcgaggtagaagcggtagtcggcgacgccgtcgtcgagggtcgcgagcgcgagcgtcgtcggcagccgcgagcgccacgagaagccgaggtcgaccccgtcgtcgcggagaaagcgcaggaggcgctcaccgaggggatcgtcgccgacgccggtcgcgagcgtgaccggcacgccgtggcgagcgatggtgcgagcgacgttcgcgggtccaccaccgggcgtgaacgatggcgagcccgaccctggaaggaggcagtcgaagagtgcctcgccgatgacgacagcctgagacgtgctcggggagcctagctgcgagctggctcgatcacgacgtggaaggcaagctcggggcagaggtgctcggcgtggcgggcggcatcgaggtcctcggtgacgatcggatcggtgacgagagggaagtgccagggatcgagctcgagatggcgcgcgaggagggccacgcaggtgccatggcctcggcatcgggtcgggtcgatcacgatccgagcgcggctagccacggctcggctcccggctctcgagcgcgaaggggcgctcgtggcagcgccggcgctggtggccggccgcatcggccggggtgatggccgtcgcgaggtgtgctgcggcgtcgggtagcgcgcaagcgcctcggcgggcgatcagcctcgccacggtcgcaagttcggcgggacgagccccggcaccgagtgcacgggcaagttcggggagcccacggtcacagggtccgcactggccggctcgctcctcgctgaggtagccgacgagctcgctggtcgcacagacgacgcaggtcgccgatggggcgagcagcacggagcccgcgccgagcgccagctcgtccgatgagtcggcacggtcgacgaggacacgtgccatcgcccgctcgtcggcgaccgagatgagctcgccgaagagaccgccgacgagggcgagacccgtggtgacgccgaccgcgtcgaggaggctccgaacggtcgcccctggggcgagttcgaccaccgtgggcgtcgagcccgggagcgcgatcgagacgatgcgcgtcgagcggtcgtggcctcgggttccggcgctctggtgccaggaggtgccaaagcgcgcggcgagggcccactgcgcgagcgtctcgacgttggcgacgagggtcggcctgctcttgtagccgcgctctgcgacgcgtgcgagctggaaccgcgggagtgcgggacgcccctcgagcgcggcgagcagcgccgtctcttgaccggtgagatacgagcggtcgaggagtgcgacgcggaccgcgtcgctgcgttcacgaatggctcgctcgaggacgtcggctgcggtcgcgtcctcgacggccacgatggcttctcgggcctcgaggagtcgtgtcgcgagcccgaggccatcgagcacgaggtgcggcgcatgggtgagcagcgccttgtccttgcgcgcgccgggctcgctctcggcgccgttggcgaccacgacacgtggcccacgctgggacgcgaccgcagcaagcttgcgcgccagggggaagcccgcgccgcccctgccgacgatgtgctcggcggtggcgagtggtggtcgtgggggcagggagccgtagatggcgcggtgcgcgtcgagcgagagaggcggcgcatcgagctcagcgatcgcgaggtcgtcgctcacgagtcggctccagccggcgctgaggcgtgcgacggacctgggcggcggcgtcatgcgtcgctgccttcggagccatcggcctcgggagcgccgatcgagggtgcagcgttcagggcttccgatggcgcggtggagaaggagacctggcccgtcgcaccgttcgcgtcgatggcgagcgccgcggtgccttccaccgtggcatgggggcaggcgagcgagaaggagatcgtcgagcccccgagcgcggtgacgctcccgtggcacaggtttggcgcgctgggggtccccaaggtcaccgtgccacccgagacggcaaagacgccctcgctcggctgtccggtgagcacgaccgtgagccgttcgttcgtgccgccgatggcgcccgcgatcgtgaggtccgtggcgctcgtggcctgggtctgcgtcacggtggcggtgatgggcccgccgaggggctcggacgagcgtgtcacggcggcggtggtcgccgtcgtcggggcggtgccgtcgatgcgcgcagaccagccagggcgaagcggtccgctccgtgcccacagcgccacgaccccgggcacgccgaggacccccaccatgccgagggtacgggcagtatgtgcgagatcggggtcgcgacggatgcgcaagaccgcgaggacgatgacgcctgcggtgatggcaccgtagacggcgaggaccgcggcgagccgcgtgtcggaaccggtcccgagcccgtggacgatggcgagcgcgagcacgagccacacgagcatgtgcgtccgcttccagagcgcaaagccaaggtgctggcgtgcgagcgaggaggcgatcacgatcagcaggccatcgaaggcgagcgtgccgaacccgacgaaggcgcgtcgatagtgggagaggaacgggatgacggctgccgtccagccgatcggcacgaagctgtcggcaagtgccgtcagaatgtggatcgcgagcacgaccaccaaggtgagcgagagccgtcgatggaggtccgggccgaggaagcgggcgacgccggaagggaggattttgcccgccaccgcgatgccgagcagggcgaccgcaccgagcatgacgagcgcggcgagaccgctcacgcgggtcaggtaccacagcagcggggatgtcgtcgcgatcagcacgcggccgcttcctcgagacgtggtggccagccgccaagggggaggcgttcgccggcattcgtcacgacgagcgccgacagctcgtagcggcgccacatgcggtgccaggcgcgtccagcggcgatgatcgcgaggctggctgcattggccgccgcggcgctctcggcgacgacggtggcgcggcgggcagcgccagggagcgtggaggcaccgacgatgtgatcgagaccccgtggcgatcggcgcgtcgcgcggtcactcgtcgcgaccgcgccagcggggatgtggatccgctggccgggcgcgtcgggccgcaaagatccatcgtcggtgacgaggatcgaccagggggcttctccgacgcagcggaggtcgccaccgaggttgacgaggatggcaccggcggcgtcggctgcgagttcgagggcgatcgcatcggcgatggccgccttggcgaggccgccgaggtcgatcagcgttccgggtgggcgtcgaaccatgtcatcgtcccgttcgacgtcgtcccaggtcgcgctggagcgacggccgaggcgcgccaccgggtggtctggttcgagcgcgctcggatcggcggcgcgcaccggatcgatgacgccgccacttgcgcggaccgcctcgtcggtgacctggaggaggtgtgcgagacgtgccgacacccgcacctccggtgtcggatcggcgttcagctgcgagagctcgctgtggggatcgtggaagctcgcgacggcgccccactcgtccaggagcgcacgaaacctgtcgacgagggcgcgatcagcggggtccgtgccgaccagttcgcagcgtgtggtgtaggcaggcagcacgctcgaccacacgttaggagcctccggtcggggtcggggttgcggcagagggagcttggctcaccgtgggagcggacgatcccgacgacgtcgacggtgaggagctgcccgacgagcccgacgacacgaagggtgccgtcgagttcgacgtcgaagaggtgtgggaatgggtcgtggccttggtggtgtggccggggaacgatcggatcgcttcgaagccgagtgcaccggccgcgaggacgagcgctgcgacgaccgtgcggtggatgcgcttcgcttgggccatgaggtccgtcacgggtcctccttgggtcgggggagcggggacgacgccctcaagtcaaacggcgcgatctggcgtggaccttgagtcaggctcgaaagcccctgagaagggtggtcctgcgaagggcgttcaggactggtgggtctccaaggagaaggcgtcctcgaccgcctcgcgcagatggacgccggcgaggccaggagcgtcgtcgagcgttcgatcaccggcctcctcggcaaccctcgcgagagccgcgggatcggccggttggccgatcagggcatcggcgatctcgcgcggtgcctccatgggccagacggtgaagtccccctcgacggtggcgtcgatcacgtggccctcggcgacgacgaggaggatccgcacgagcccgctcggtgccttggtgcggccgacgaggacgtcggcaccttcgcgaatgtgcaccccgaggacgcgccgccccccgccatcgttgacccaggcgggatcgacgagtcgttcgcgcaccgcggcgacgtggcggcgctcgtcctcgctcaaggtgccgagttcgagtgggcgtccgagtgcctcggcgaggatcgggaggtagcgctcgacgatggcgtcctccgacggtgccgatccgagctcgcgctccatggaggtgacgtaggtgcgcatcgtggcggcgagcttgtcgcggagcttcacggagtcgacgcgcagcacggcggcgagggcgtcggtgtcgatcgtgcggatgaacgaacccacgagcacctcggcgcccgcgatgcgagccgcaccggtgccgccgatcttgcggtcggcgacgtggatgtcgttgaccgggcgatggcgcgcgtcgatcccgaaggcacgcagcgtcgtcacgagtggcgcaatgtaggccgcgtagcgtgcctccagcgagagcggtacgtggtctgggtgcatgatccactggacgaacagctgaccagcgtcgaggtacacggcgcccccgccgaccatgcgccgcgtgatcggtaggccgcgcgccgcggccgcttcgacgtcgagttctcgttcgaccgcctggtggtagccgacgcacacgtaggggtctcgcggtgacaccaggcagatggtgtcggggtcgtcgggaccgagcctctcggcgagggcgtggtagatcgcctgggagtcgatggcctcgaggccggtggcgacgatgatgcgaacgggtcgtgtcatggtcgtagctccgtcatcacgatgacgtcgtggccggcgtcgatctgtcgattggcttggtgggagatgcgcacgagtacggcgacgaggagatagttcgcgagcagcgacgaccctccgtaggcgacgaaggggagcgtgacgccggtcaggggcaggagtcgcacgatccctgccatgatgaagaaggtctggagtccgaggatgaccgacagggcgaaggccagcagcgacgagaactccgttcgcgcacgcagggcggtgcgcacgccggcgccgacgaggagcacgaaggcgatcacgagggcactcgtgccgagcagacccatctcctcgccgaaggcggcgaagatgaagtcgctggtgacgaccgggatgagctgcgggtggccgagcccgagcccggtgccggcgagtccaccgatgccgaaggcgtactgtgcctggacgagctggtagccgatggtctgggcgtagcgccatggatcgagccagaccacgacgcgctcgtgcacctgggtgaagagggctccggccaggaccgccccgatggcgaaggccgcgaggccgaggaccaggtagctccggttcgccgtgcccacccagaggacgatgacgaaggtggagaagatcaacagcgcgaagccgacgtcgcgctcggccgccatgacgacgagtgcgagcgcgaacgcgagtgcgatggggccgaggcggcggatgccgccaccacgaagccggctgagcatgtcgcggcgctcgacgatccaggacgcgaggaacagagcgagcaggagcttggcgatctcgacgggttggaagctgaaggggccgacgtggatccagagccgcgcaccgttgatgtcgagcccgagcccgggtagcagcggcaggaacagcagggcgatcccgccgatcgcgaggaggtagcggtagcgatcgagcgcgtccgcgttacgcacgacggcgagggtcacgacgtaggcgatgacgctgagagccgtccagagggcctggagggtgccctcgtgggggtcgagtcggttgatcatgacgaacccgagcccattgagcagtcccacgaggggcaccatcgtgggatcggcggccggtgcgagcagccggttcgcgatggcgaggacgaacggcgcgaccatcacgctgacgagtgcgaggttggggtccaggtgtgccttcgggttctcgccccaggtcgcgagcgcccacgcgaagacggtgatgacgtcggcggcgagcaccagttcgagttctcggcgtcgccggtcacgagcccatggtgatcgctcgcgacgggcggcgagcatggtgcgcatcggtccttgtccccctggctggtgcgagcggattctagcgggcatgacgctggcgcaggtggtggcggaccgggcgtcgacgcactacggcgagaggctaggttggcggccaaggaggtgctggtggctgaggcgcaacgcatgctggccgagggctccctgcgcagttcgtctgagcgcttcgtgaatcgggagttgtcctgggtggacttcgcctcccggatcctcgaactcgccgccgatgcgcgcgaaccggcgctcgagcgcgccaagttcctcgccgtgctcgcacaaggcatggacgagttcttccaggtgcgcgtggccggcctcaaggatcagctcctcgcacagcatccgattcgctccccggacggactcgatgccagggcgcagctgcgcgcgattcgcacgcggctcgagccggtctgggagcgccagagcgaggtctggcacgacgggatccgaccggcactcgctgcgctcgggatcgagatcgtcgccgtcgaggacctctctccgacgctccatcgtcgcctccacgagcgcttcttggaagagctgttcccgatcctcacgcccttgtccgtcgatcccgcgcatccctttccctacatctccaacctgtcgctcaacctcgcggttcgcgtccgtgacagccaaggcggtgagctccggttcgctcgtgtgaaggtgcccacgaatgtgccgcgcctcttcccgctcggggacctgcgctactgcttggtcgaggacgtcatcgcgagcttcatcgcccgcctgttcccgggcatgatcatcgaggaagtcggcacgttccgcgtcacgcgcaacaccgacctcgtcctcgaggagggcgaggcggacgacctgctcgagctggtcgagaccgaactgcgacgccggcgcttcggtcgtgcggtgcggctcgaggtgtcgtcgcgcatgagtcgtgagctcgtcgacgtgctcgtcgacgagctcgagctccatccggatgacgtctgggcgacggacatgccgatcgacggttcgttcgcatgggagatcgtcgcactgcccatcgacgaggggcgaggcatcgccgccgcgggtgtgacgccgtcgatcttcaccgtgggcgacgacggcgctggcgcgctgttcggccgcctggcggccggcgaggtgctggtgcaccatccctacgagagcttcgcctcgacggtggaggcgttcgtgcgtgcagcggcggccgatccggacgtcctcgcgatcaagcagacgctctatcgcacctcgggtgactcggcgatcgtcgaggccctcgtcgaggccgccgaggctggcaagcaggtcgtggtcatcatcgaggtcaaggcccgcttcgacgagctcgccaacatcgcctgggcgcgtcatctcgaagaagccggcgtccacgtggtctacggcgtcgttggtctgaagacccacctcaaggccgcgatggtggtccgccgtgagggcgcccgcctcgtgcgttactgtcacgtcggcacgggcaactacaacgcccggacggcacggacctacgaggacctcggcctcttcagcgccgacacggtcctcggcgacgacctggccgaggtgttcaactacctcaccggattctcgcacccgaatcggttgcggcgcgtcgtgctcgctccccagcagctgcgcgggtggttgctcgagcgcatcgcccgagagcgcgatcgcggaccgagcggacgcattcgcttcaaggtgaactcgctcgtcgatcccgagatcatcgatgcgctctacgacgcgtcggcggccggcactcccgtcgagggtgtggtccggggcctgtgctcggctcgcgtgggggtcgaggggctctcggagcaccttcggatccgatcgatcgtggggagcttcctcgagcattcacggatctacgtcttcggccaaggacccgacgccgatgtggcgatcgcctcggccgatctcatgcagcgcaatctcgatcggcgcgtcgagctgttgatcccgctcgaggcgccggcgactcgagcgcgcgtggagcacatcctcgatctcgccttcgcggacgacacctacgcatgggagctcaccgccgatggccgctggcatcgtcaacgcggtggcgagggcatctcgctccagcggcggctcaacgacgaggcgggggctcgggggtgagcgaaggcgcgatcgggaccgagcgggaactgaagttccgcccgcgcgacgtcgacgaggcacgagtcctcgtcgccaggttccgtgaccggctcggtctgcctgcggcccccgcggtgacgaccacgctcgagtcgcgctacctcgacacggccgatcaccagctcgcgcgctgcggccttggcgtgcgagcccgctgggcgctcgaggctttggatcccgaggccgcacgctggacggccaagctcgcactcgaagaggacgacggcacctacgtgtcggtcgagttcgaggtcgacggcgagcgcgagcgcctcccggccgagatcgctggtcggcttcggagcgtcgtcggatcggcgcggttggtggagctcgcgcggattcgcaaccaccgtaccagctggcgcgatgcgaccggtggtgtcgagatcgagctcgacgtggtggacgtgctcgctccgcgaactgggcacttcgtcgaggtcgaggtcgaggtcgccgacgacgagcagctgcgcgcgctgcggcgctgggtcggggcggtcccggtgtcgacgacccacaagctcggcgcggccctcgggcaggtcgtgagcgtcgatccggagtgcgtcgcgcgggtgcgtgccctcctcgaggcgccgagcgaccccggctggtgcgaggagcctgctccatgggcacgctgagtgcggcggcgatcgatctcggctccaactcgttccatctcgtcgtggcgcgggtgcgtccggagcgcctcctcgagcccgtctacgaggacaaggtcatgctgcgcctcggggaggtggtcgcacgcctcggtcgcttcgacgacgaggccgaagcacgtgcccacgaggcgttcgagcgcttcgtctcgctcgcacgcgcgttcggcgcgacggtcatcgtcgccgcggcgaccgcgagcttccgtgatgcccagaacgggcgtgacgtcgccgacgcgctcgaggcgcgaaccggggtgcacgttcgtatcctcaccggtcacgaagaggccagcacgatcttctcggcggtgcgctcggccggcagcatcggccaggtccccgtcgtcgtggccgacctcggcggaggcagcttggagctcgcgctcgggacccaacgatccctcctgcgcgcgcgcagcctcccactgggtgtgggcaagctgtcggtgcgctaccgctgtagcgacccgccacggcacgacgaactggctcggatccgggcccacgtcgaggcggtcgccggtgccgagctccgcgagatggcctcgttcgagccgcgccggctggtcctggcgagcgggacgttcgccgcgatcgcgaaggtcgcgcgtcgactcggtcgcgtcgatcagctcgccgacgggcaggtgttgcgggtcgtggacgtcgcctccctcaccggtgcgctcgatgcgatcgtgcgtgccgatcgagaggcccgcatcgaccgtctcgggatcgatcggcggcgcagcgataccgtcgtgccgggcgtcctgatcgttcgcgccctcctcgatgagctcggggtcgacgaggtgtggaccagtcggtgggcgcttcgggagggcctgttgatccaggccgtggaggagggcgacgccatgggcttcgccttcgacgctgccgagctccgcgctggctcgctccgacacctcatgcggaagtaccagatcgaggaggatcacgcccgcgctgtggagcggcacgcactcgcgctcttcgacggactgggcggtgccctcgagctcgtgcccgaggatcgtgacttgctcgcggtggcggcgctgctgcacgacgtcggtgcgttcgtctcgggccggaaccacgaccgtcacggtgcgtatctgctcgcggccgacccaccacgcgggctgtcggtgcgcgagcggctggtggtcgagggcgtcgtcggctcgcaccgtcgcggcgcgcctcgttcccccgacgccctctcgacggccgatcgcgaccgtgtggctgcgctcgccgcactcctgcgcgtcgccgatgggctcgatgcctcccacacccaagtggtcgaaggggtcgaggtccagctcgaggcggacgagatccgtctcgtggtgcacgccgacgaggcgctcggtgccgagcgcgttgctctcgagacgaagaccgagctgctcagctccctcctggggcgcagagtcgaactcgacgtggtgccggtggcgcgagatggggcggcacgagcgcggtccgtgctcgactgagcgctcgcactccgcggtcgcgctcacggatcggggagcaggacaccagggttcacgatgccgtagggatcccagatccccttcagcgatcggagcgccgcctcgtcgatggggtcgaggaggagccgggcccagcgacgtttggtgcggccgatcccgtgttcggacgcgatgacgccgccgagggccgccacacgtgtgagcaccgtctcgtagagcggaccgggatcggccccgtgtgcgatcgcgaggttgacgtggcacgtcccctcggcgagatggccgaagaggacggtggcgcgcacctcgtcgcgctcggccaccaggtcgaggtgggccgcgagctccccgagtgccccgagtgggacggcgacgtccagcttgaccggggtgccgaagcgctcggcgagcagcgggagcatctcgcgcaggtgccagagccgtgccctctgggaggggtcggtcgccacgtgggcgtcgaggtgggccggtgcgagcaggaggggccgatcgtcgtcgggatagggactcgtgagctggaggatgaggaggaggggatgcgggtcgggcggggtgaggccggcgcttcggacgtcggccgtacgcacgaactcggctgcctcgagccacggcgcaacgagtggccggagcgtctcgaagaggctgacgaggtcgacgaagtcgtcagcgccgatggcgatggcgatgcgggtgcgtgggcgcgggtggacccggagcgcgacggccgtgatgacgccgtagatgccctcgctcccggcgacgaagcggcaggtgtcgagcccggcggccttcggaggccgaccgatgcgacggtgggttcgcccgagcccgtcgacgaggtcgacgtggacgagctggttggccgtcgagccgtagcggacgacccgttgaccgcccgcgttggtcgcgacgagaccgccgagggtggcgttggcgcgcgatccgaggtcgataccgacctcgagtcctgcagcctcgagctcggcgtcgagatcggcgagcgtcacgccggcttcggcgacgacggtcatcgtggccggctccagtcgaacgatgcgtcggagtcgttcggtgctgacggcgatggcgccggggtggggtaccgcaccggccacgagcgaggtcctgccaccttggatggtgatcgcgacacgagcgctcccagccgcctcgaggaggcgcgcgaccgcgggagcgtcggcggggcgtgcgagcgctgcggcatcccctcgcgtcgtggcggtccagtcgaggttgatcggctcgagggccgcggggtcgtcggtccagtcgacgttcgcctcgtcgaggacgcgagccgcatcggacgctgctgccatggggccatggtaggtgtgggcatgctgctcgcgccatcgcccgagggctcttcgagggatcgggttaggctgcctagcggtacgtcggagcgtgcctgtgtccggatcgtggccaggctgctcgagcgagtcgcccgacgacgagcgcgtgtggcgcatggtcgggcggcgcgcgtcgtggcgatgcgacagaagggagcgctcggtggagacggtggatccgagatcgcttcgggtgtggcgtgagctcgaggccgaggccgcggagctgcgcgacgtgcctcttggcacgttggtggccgagggaagcgatcgcgagcgtcggctcgtcctcgatgccgggctgctccggatcgatgcgacgcgacagctcgtacgcgctcgcacgttggagctgctcggtgagctcgcgcgcgagacgaaggtggtcgagctgcgtgaggcgatgttcggcggtggccacatcaacaccaccgaggatcgagccgtggggcacgtatggctgcgcgcgccgcggggaggggcacccgtcgtcgacgggatcgacgtctcttccgcggtccacgacgtcctcgagcgcatggcggaggccgccgttcgtctgcgcgacggcagctggacgggtgtgaccggcgaacggatcgagcgcgtcgtgtcgatcgggatcggcggctccgatctcggccctcgcatggcggccctcgccctggaggccttcggccacggcgggcccgaggtccggttcgtctcgaacgtcgatcccgtcgacctcgagcgagcgctcgtcggcgccgagcccgcccggacgctgttcgtcgtggtctcgaagacgttccggaccctcgagacgctccagaacgccacggcggcgctcgcgtggctgcgctccgagctgggagagggccctgaggtggtggcgcgccacgtggtcgcggtctcgtcgaacgtcgaggccgcgacggcgttcggtgtcgaccccgccaacgtcttcggcttctgggacttcgtcggtgggcgctactcggtgtggtcggcggtgggttttgcgctgatggtcgccgtcggaccggagggcttcctcagtctgctcgccggggcccacgccatggacgagcactttcggaccgagccgatggatgtgaacgcccccgtcctgcacggcttgttgatgctgtggtatcgcacctttctcggcgcccagacctacgcggtgctgccgtacgcggagcgtctcgcgctcttgccgtcgtacctgcagcagctgaccatggagtcgaacggcaagtccgtccgacgcgacggcgagcgcgtggactacgacacgggcgccatcgtctggggagagccggggacgaagggccagcacgccttctatcagctgctgcaccaggggacgaccctcgtgcctgcggacatcatcgtggtcgccgaggcacaagccggtcccgagcgccaccacgacctgctggtggcgaacgccttcgcgcaggcccaggcactcgccttcggccgggacgaggcgtcgttgcgggcggcaggggtgcccgagcgcctcgtgccgcacaaacggatgcccggttcacgcccctcgagcgtggtgatgatgccccgactcgcgccggagacgctcggcgcgctgatcgcactctacgagcactcggtgttcgtccagggggctgtgtgggggatcgactcgttcgaccagtggggcgtcgagctcggcaaggagctcgccgaccagctcgcgcccttcacgacgggcgagcgcgacgtcgagggtgccgacctcgacccgacgacggcgcggctcatcgagtggtaccgttcgtggcggcaagggccgccgaagagagaggagatgccatgaagagggctcgcttgctggcggaacacggccagagcgtctggctggatgcgatctcgaggcgactgctcgccaagggcacgctcgcgcactacatcgacgagctcgcggtgaccggcttgacgtcgaacccgtcgatcctgtcgcacgccatcgccggttcgaccgactacgacgagcgcattgccgatgcggtcgctcgcggtgtccacgatccagaggccgtcgtctacgaactcgcccactgggacctcgccgaggctgccgggctgttcgcgccggtgtacgagcgcaccgacggcgtcgacggctacgtgtcgatcgaggtgcctccccagtacgcgcacgacacccaggcgacgctgtcgtgggcgcgtgagctgcggtcgcgcttcgcggagccgaacgtgctcgtcaaggtacccggtaccccagagggcctccccgcgatcagcgagttgatcgcctcggggatcggcgtgaacgtcaccttgctgttctccgtcgagcactacaccgcagccgcggaggcctacctcgagggcatcgagcggcgttcgagcgccgggttgtccctcgtggtgccctcggtcgcgagcgtcttcgtctcccgctgggactcggccgtcgatccgctcgtgccccgtgagctccagggccgtacgggccttgcgatcatgcgtcggatctacgcggcctaccaggcgctcctcgcgtcggagcgcttcagcaggctcgccggccagggtgcgagagcccagcggctcctctgggcctcgacctcgacgaagaaccccgagctccccgatacctactacctcgggcgactggtggcgccagggacgatcgacaccgtcccggaggggaccctgctggccttcgacgaccacggcgagatcgagcccgtgctcgacgacgacctcgcgggggccgatgcactgctcgaggaggtcgcctcggcgggagtcgatctcgcgggccttggcgacgtcttgcaggagcaaggtgcccacgccttcagcgccgactggacgacgctgctcgacaccgtggcacggcgggtgaaggggtgagcccgcgcggcgtcgtcgtccgcgaggatgggggcacggtcgcagctcgcgtcgaggagctcgacgagagcctgctcggccacgatccagtgcggatccgcgtgcactactcgaccctcaactacaaagacggcatggtcctcggagggctcgggaggctggttcggcgctacccccatgtcgccggtgtcgaccttgccggtgaggtgatcgaagaccggacggggacgttcgctccggggacccgcgtcgtggtcacggggttccacgtcggcgagcgccatccgggcggtcttgcccaagaggccagggtgcgtccggagtgggtcgttccgttgcccgagggcctcgatgcgcgaagggcgatggcgatcgggacggctggcctgagcgccatgctcgcgatcatggccgtcgagcagcgggggcgttccgatcggaccttccccctgctcgtgactggagccgcgggtggggtgggctccatcgcggtcgctgtcgccgctcgacgagggtggggggtggctgcgtcgaccggtcggaccgacgaggcgccctacctgcgctcgctgggtgcgagcagcatcatcgccagagccgagctcgcgagggacgacgtgcgcccgctcgagtcggagcgcttcggcggggccatcgatgcggtcgggggctcgacgctcgcgaccgcgcttgcccagatggcccacggcgcggccgtcgcatccgtgggtcttgccggcggcgaccgcttttgcgcctcggtgatgcccttcttgctccgcggcgtgagtatcgtcgggatcgactcgacgctcgcaccgctcgaggatcggcgagcggcatgggcagcgctcgcgagcgacctcgaccccgcactgctggcggaggtgacccgggaggtggggctcgaggacgtgcccgccctcggacctgagatcctcgccgggcacgttcgcgggcggatcgtcgtcgacgtgaaccgctgagacgtgcccacggtcatcgtcgtgtgtggcccgaccggctcgggcaagtcgacgttgcgtgctcggctcgtcgagcgaggtgcggtgggcatcgacgccgacgaggtggcgcgagcggtcgtcgagccaggttccgaggtgctcgcctcgttggtggcggctttcggcgatgacatctgcgacaacgaggggcggctccggcgtgacgtgctggccgcgcgcgcctttggctcggccgagacgacggcgctcctcggtcggctcacccatcctgcgatccgtgccgagatcgaggcccagttggcgtcagccggcgatggggacgtcgtcgtcgtcgaggtcccgctgtggcggcgggcggacgactggatctgccccgatctcgtcgtgtgggtcggggcgagcgccgagcgcgcgggcgctcgcgtcgcggaggaggggcgcatgagcgaggcggagctacgccagcgtcgtgctcgcttcgacttcgaggcccagcggcacgaggcggacctcgtcatcgacaacgacggtggtccagaggccctcgccaaggctgccgatcgtgtgtggtcgctcgcgctcgctgccgacggtaaaggtcatcgccgcgcgtgacgatgggttcgcgaggaggtgaccatggctgaggtgatcaccgcggagcagctgacggcccggatcgcggagttcgaaccatcgaggagcgtcgccgaacgcgtgctcgcggtcatcgatcgcgacgacatcggtgctgccgagctcgcgactgtcgtcggcacggatccggcgctcgtcgagcgggtcatgcgaacggcgaactcggtggtcttctcgagtcaggccaacgtgcgcaccttgcagcacgcggtggcggtgatcgggttcgagaccgtccgttcgctcgcgctggcctcgttcgtcgagggcgtcatgagcgtctcccggcaggactggcaacgatcggtgatgtcggcggtgggtgcggcggccgtcgcgcgggggatcgggctcgatccgcagctcgccttctcgaccggactcctccacgacatcggccacgcgctcctcgagagtctggacccgagctacgccgccgtcgtcggggcgttccgtgccgagccgctcacggcctcgtccgaggccgccctcgtgcgagccgaacgtggtcgctacgggatccaccatgcgctcatcgcgggcgacgtcctcgcctactggaacttcgccccggacatcgtcgaggccgtgagccaccaccacacgccgaagggttctctgtcgcgactccacggcgccatcgtcgacggctaccgtctcacccactggctcgcctcggggctcgatctcgaggagtacagccgcgccgacgacgtgctgctgccgacctacctgcgacccgagaacctccacgtcgtggccgccgatgtccggtcgcgggccgagacgctcctcgaggatctgttcgggatcccggcgtcgcacgcgagcgcacggtagactcccggtgtagtgccggagcgcttcgaggtccacgcgccgtatcgcccgagtggcgatcagccgagggcgatcgacgagctcgtcacctcgatcgagtcgggcaaccggttcacgacgctgctcgggatcacgggctccggcaagagcgccaccatcgcctggacgatcgagcgactgcagcgccccacgctcgtcatcgcgccgaacaagtcactcgcggcccagctcgccaatgagtttcgcggcttcatgccccgcaatcgggtcgagtacttcgtgtcgtactacgactactaccaacccgaggcctacataccctcctccgatacctacatcgagaaggactcgtccatcaacgacgagatcgaccgactgcggcactcggcgacgtcggccctgctcacgaggcgagacgtggtggtcgtggcctccgtctcgtgcatctacggcctcgggagcccgagcgcctacgaaggtcagatcctccccatcgaggtcgggatggatcagccgatggggctcgtggtgcgaaggctcgtggccatgcagtaccagcgcaacgacctcgagctcgcccgtggccgtttccgcgtgcgaggcgacgtgctcgaggtccacccggcctacgaggagcgcatcgtgcgcgtcgagttcttcggcgacgaggtcgagcggatcgtgagcgtggatcagacgacgggggaggtgctgcgcgagctggaggacatcgttctgttcccggcgacgcactacctcgcgagcccggaggtggtcgagcgtgcgcttcggtccatcagcgacgagctcggggagcggctccgtgagctcgagagcgcgggcaagctgctcgaggcgcagcggctccgcatgcgcaccgaactcgacctcgagatgctccaagaagtcggctactgcaatgggatcgagaactactcccgccacctcgatggtcgcgagcccggacaggcgccctacacgctgctcgactacttccccaaggacttcctcgtcgtcatcgacgagagccacgtcggcctcccccagctccgcgcgcagtacgcaggcgatcgctctcgcaaggagaccctcgtcgagcacgggttccgcctgccgagcgcactcgacaaccgtccgcttcgcttcgacgagttcctcgaacgggtccctcaagccatcttcatgtcagcgacccctggtccgttcgagcgtgagcacgctgggcgcacggtggagctgatcgtgcgtccgacgggcctcctcgatcccaaagtcgaggtccgccccacgaagggccagatcgacgacctgctcgcggagatccgcgctcgggtcgagcgcgaccagcgggtgctcgtcaccacgctcaccaagcgcatggccgaggacctcaccgagtacttcgagggcctcggcgtcagggtgcgctacctccactcgacgatcgagaccttggagcgcatcgagatcgtgcgcgatctgcgcctcggggtcttcgacgtcctcgtcgggatcaacctgctgcgcgagggcctcgatctgccagaagtggggctcgtggcgatcatggacgccgacaaggagggcttcttgcgctccgagacctcgctcatccagaccatcggccgagccgcacgcaacgtcgagggcacggtgatcctctatgcggatgccgtcacgccctcgatggcccgagcgatctcggagaccgaacgccgccggagcatccaggccgactacaacgcacgccacgggatcacgccgcgctccgtgagcgcgaggatcgacgacctcgtcaccgagcgcacgcgcagcgcgccgacgccgacgctcgggcgtcgagcgatcgaagagcggaccgctggcatgaacccggagcaggtgcgcgacgtcatcgactcgctccgcgaagagatggagcgcgccgccaccgagctgcgcttcgaggaggcggccaagctgcgtgacgacatccgggcgctcgaggcactcctcggttcggacgcgatctcctagcgagcttattgccgctatcacaccccctatggtataatcggagataccgctgggggtatagcggttggtacctaggaggacacaggatgctcgatctcatcatcgtcccgacgctcgagctcggcgaccggtcgtacatcgtgcacgacgggcgtcgcgcgatcgtgatcgatccgcagcgcgacatcgaccgtatgctcgccatcctcgcggagcgcggcctcgaggcggtcgcggtcggcgacacccacatgcacaacgactacgtcaccggcggctatgcgctcgcgaaggagctcgacgtcgactacctcgtgttcgagggcgagcaggtgcacttcgagcgccgagcggtcgccgaccgcgaggtgctgcgcctcggcgacatggaggtcaccgtgctgcacacgcctggccatacgccgacgcacatctcgttcgtggtgcgcgatccggccgacgatcggccaccggtgctgctctcgggtgggtcgttgctctatggatccgtaggacgcacggacctcatcagcccggaggcgacctacggcctcgcgaaggaccagtggcactcggcccagcgcttcgcgaccgagctccccgggccgacgatcttgatgccgacgcacggcttcggctcgttctgctcgtcggtgtcggtcgaggaggccggcgactcgacgctcgatggcgagaagcgcgtcaacatcgtctacaagtacgactccgcggagtcgttcgcggacatgttggtggcgacctacgatccgttcccggcctactaccgccacatggggcctgcgaacgtctcgggtcccgcgccgctgcgcatcgacagcctcccgaagctcgacgttgcccaggtgaccgagctgcgcgatcatcacgaggccgcggtcgtggacatccggccccggaagcagagcctcgagggtcgtccggccggcacgctcgcgttcgagtactcgaacgtgttctcgacctatctcgggtggctccaccactacggtcgcccgatcgtcttggtctcgtccgacgaggcgaccgcacgtgaggcggcgctcagcctcggtcgtatcgggatcgacgaggtgcgtggctggatcgagcccgaaccgctgatggatgcctggggcgtcgagcgtctcgagcgcatcagctggcaggagtacgtgcagcagtatcgggggagcgatcacacgctcctcgacctgcgcaatccgtccgaggctcgggccctgccgatcccgggcgccatccagatcccgatctacttcttgccgaaccagatcgacgaggtggcgacggatcggaccgtggtggtgcactgcgccggagggtatcgcgccgcagcgggtgcggcgtggctgtcggcgaacaagcacattcgccctgtcgtcatcgacgacggggccgacgtcggcgcgcagctgctcgcggcgcagtcgtagtccgtcgcggcccgacgacgagacgttaggctcgtccccgccatggtgggtggggacgagcagcgtcgcggcggcgacacgccgctcgtcgtggtcgtcggcggtgcgcgctcagaggttccgatcgataggggcgcggtcgcagcgatcgtgcgcctcgttggtgtcggcgacctccacgaggcggcagcgatcgccgatgagcccagcagcgaacgggctctcgtgggtcgtcgtggcgtccttgcaggactctcgctgaccagcgatgagcccgccatcgcaggcgccctgatcgaaggggtcgccttcgaggcggcgcggatcgtcgatgggctcgacgaggcggtcgcgggctctcctgaggcccgcatccttctggagggtctctacgccgtctcggcggtggcgcaggtggtggcggacgtcctgggacgtgcggtcctcgacggcgccgggcagagggcgatgcccggaccacgcgcgagaagccggcgttccaggtggcgccggtggctcgaggatcaagggagcttgacgtaagcccagccgtcgccctggcgcgccacgaggtgagcgatggcggcaggcacatggccgacatcgctggcgaggtcgctgctcgtcgcgccgagtgcctggaggctgttgtcacaggcgaggacgcggcgccattcgagggcagggctcaggagtggctcgagcggtgagggcgccagcaggcggcgaacggccgcaccttggcagacgacctcgatcgtgaggtccggagcggcccgatggaggttcgcggccgacccgagtgctgctcgcagtgcgtccaggtcgtcggtcgtgacgtggatgagggcacctcgtgcgatcatcggatctgctcggcgtgcaggtccgaacggctccgtccgaagagggcgaggtgcatgaaggcgaacttggcgaaccacagcacgacgaaggaagcgaagtaggttccctggaccacgatgtcctggtcgagtcgggatgcaccgagcgcgagggcatgggcgtgcgccacgtcgactgcccaggtcgagacgatcaggctggtgagtgacatcgcgacgtagggcaggacctcacgggcgagcgacgagcgatcacgacggcgccaggcccaggagcgattgagccagtaggacggtgggatgccgacgagcgtggccacgatggcagcgtcacgcgcatcgaggagatgccagagtgagtagacgacgaggaggaccagctgcgacaagacggcggtcgctgccgacccggccgcgtagcgccagaagcgatcccacagcgggacgaaccgtcgcaggccgaccacctcgaggagtcggcgccccatgcgatcgattcggtccacgctctcccagcatagaaccgggcgccgagcgagcgcggatggtgacgtgttaccgatcggttaggaaccctcgggttgttgctcgtgcatccggatggtcgagtaaggtaacgaggtggtagcgctgcggtcgccacgaggtggcgaagcgcgttgcctgaccggagagtcgctggcgaaaggtggtcacgtgcggcagcaggcagagtgggcgatcgtcaccggcggctcgggattcatcgggaccgcggtcgctcgtgcgcttcgagcgcgcggcgtgcgggtcgcgatcgtcgatcgcaacgcgccgcagcaccgcgaactcgatgtgttcgtcaagggcgcgatcgagcacgagcgcacctggctcgccctcgcgaccgagctcgctggcgagcacgtccgtgcgctctaccacttcgcggcccgcaccagcgtcttgcagtcggtgaacgaccctcacgacgtctttgtgtccaacctggtgggctacgagaacgcgctcgagttcgcgcgcacgcacgaggtcgcgagcgtcctcttcgcgtcgaccaacgcggtcgtgggtgcgggtgacagcggcaccatctcggagcgctcgccgttggcgccactcacgccctatggcgcgacgaaggcggcaggggagatgctcgggagcgcgtacgccgctagctacggcatccacgtcgcgtcggtgcgcctgacgaacgtctacggtccggggatgtggcacaaggactcgatcgtgccgcgcctcctgcgtcatgtggtcggcctgtctgaggcgaccatctacggagacggtgagcaggtgcgtgacttcgtctacatcggtgacgtcgtggacgccttcgtgcgcctcgaggagctcggcttcgtgggcgcggtctcgttcggttccggcacgagcgtcagcgtgaatgagctggtcgatctcgtcggcgacgtcacgggccacgagctgcgcctgcgtcatgtgcctgcgaaggctggtgagatgccgggcgtgagcgtggacctgtcgctcgcgcgctcgctcggcctgaaggctgacgtcgaactggcggagggtctgcagttcgcgtggtcggacttccaggaggatcagggccgcgtcgccggctgagcgcagatcgcgcgcgctcgacgcgcctgtgagcgcgcgttgcggtgaccaccgacgcgggtgcttggcacaggatcgggttcgcgagccccggtggcggctcgcgctccatggcgcgtcacgcgtgtgggcggcctgagggtcgcaaggtcgaacgatcgatggcggaggcggtgtgcttcgagcgccgctcgcggccgagttcgctgcgctgtgcgctctcgctgctcgggtggggcggagtgggcaggcgctgccgacggctcgtgccgtgacgcgcccagcggcggagcgctcagcgttcggagccggggcgtgcttcgagttcggcgaggcgcgcgagcagtgccgagcgccgctcgtgccaccagtgctcgacgggggcgaaggcgctgccgagacgccagcgatcttgttcggtcgcgctctggcgtacgagggcgagggcctcacgggggtctgcctcgaggagcgatcggaagctgaagcgacggcctccgaagcggatgggcacctcggcgcggttggcggcggcgagaatgccgcgccgcgtgagcacgatccccgacagggcgggggagaggcacagctcgaggagcccgtcgaggtcatcgggagtctcgagatccggggcggctcgcaggtgcagtgggagagccgagggcacacccaggcgttcggcgaggctgttgagggtggcgaggaggtgttctgcccacggtgcgtactcggggggaccgagtgcgcgagcggcgcatgcgtacaacggaccgatcggtgcgagctgctcccagaggaaggcgcgtgcgaagtcgagcgcatcgcgatcgagcgcggcggcgaggacggagagcaagaagcccacgtgatcgcagagcgctggggtcgtgagatcggcgacgtaggtcgcgaggaactcgcgtgtgcgctccgtgggctcgccgccgagcagcgggccgcgcgtcaggaagaagctcgtgtaggggggcagctcgaagtcgaacagctcggtgaaggcggcacgcgagcgtcctaccccgaagagggcgaggagctcggggtcgggctcggggttctcgctgagctcggcgaggccccggacgacctcggcgagcttgcgcgtgtcactgtcgagttggttcactggcggtcgccgaggtcgggagtcggaaggcctctggggtcggcttgagcggacgcatgagccagcgagggcggcgcgtcccgtcggggctgacctcgcgggcggaacgagcgagctcgagccagcggtggaacacctcgcgcgaacgagcggtgtcgacgtagacctcggcgtggcggtcgccaggctgggctcgggtcacggtgacgacctggtgccagcagtgcatccccgagatcggatcggggtgcacgccgaaggtgaggttctggtgcacgcccacgtcggtccaccagatgcgctgggtgtcgggatcggccgactcgtagggcgcgacgccgtcggaggggtcgagcgtccagcgtgatccctggcggcgcagggcgacgagacgcatcatgcccttcgatccgacgtcgccgaggcgccaccgtcccatgtggtgcgagcaggcgacgacaccgggacggatgccttcggtgacccacgccttgacgacgaagtagccgagatcggtggtgacgcggacgagctcaccgtcgcgcacgccgatgcgggccgcgtcggtcggatggatccacagtgggttcgtgtgggcgatctcgtcgagccacttcgagttggccgaccgggtgtggatctgcacgggcaggcggaaggtcgagatcaggggcatctgcccgtcggcgagcttcgacggatggacgtggctcgggatgtaggtcgggatggcgtactctggccatccccacgaggcgacggtggccgagtagaactcgagccgaccggagggcgtggggaagcctcgcaggatcgcgccgtcgacctcgacgccgacgggccgacgtccctcgtcgtcggggctcgggtcgccggtcgggacgatgttggcactcgcgggcttcggagctcgagtccagacccggccatggtcgtcgacgtggacgtcgtcgagttcctcggccgggacgggccgttcgtagacctggccgacctggcgcgcgacctcgaaggcaccgtagcggcgcatgtagccgagcggcgtgaggccctccttggccgcggcttcggggagtcctggcaccgaatgctcgaacatccaggcgtagtactcctcgacggagagcttctggccggggttggctcgagactcgaagtagcgccggatacccagggagccgtcggggtcgatgcgccacgacagctcgatccagaactcgttctcctcccacacctcaccgggattgacctggcgggtgtcggtgacggtctcgccgagacgctcacgagccgctcggagcacgggttggcgaaacccgatccactggccgtcgtactgctcgtaggagtgggtgtcgtggcgttcggaggcgtgacccatcggcaagatgtagtccgcgaagaacgcggtctcgttccaggtgggcgtgagcgcgacgtagcacccgactttgtgctcgtcgagcagcatctcgatccaggcaaagccatccgggttggtccacacggggttgtagaccctcgtgaagtacacctcgagtcgcttgccgtactcctccatgaggtgcgggagcaagaacgagagctcgttctgggcaagtggatagtcgacgggccaggacagctcctgccagaccttcgggtgcggcgggacgtggatcggtcgtggcacgaacttgttccaggcattgaggttcgtgccccctggcgtcgcgacggcccccagtagtgcgttcaggaggaacagcgtccgagagacctgccagccaccgaggttgccggcggctgccgagcgccaggtatgcgtggcgagctgggtgccggcgtcggcgacgagctcggcgacctcgcggagcgtggcttcgtcgacaccgctctccttggccgcgtacgcgaaggtgaagtcggagtagagctgcttgagcacccccacgaaggcatcgaaggtcaccgggagctcggggtggaccgcctcgaggtactcgcgccagttccaccaccgctcgacgaaggcgcggttgaagcggtcgtgctggatcaggtagttcgcgatcgagaggttgatcgccgcttcggagccgggccacggcgacatccacacgtccgcgtgcgtcgaggtgttcgacaggcgcgtgtcggcgacgatgagcttcgcgccgcgctcgcgggcttcggtgatgcgctgcgcatgagggttgaagtagtgaccggtctcgaggtgggagctgatgaggtagatcaccttcgcgttggcgaagtcggcgctgggccgatcgatcccgctccagaactgatagccagttcgtccacccgacgagcacacgttggtgtgcgagttgtggccgtcgacgccccaagcggcaaggacacgctcggtgaagccgtcttccccaggacgaccgaggtggatcatgatctcgttctggcggtcctcgacgagcgcctggcggaggcgacgggcgagatcgtcgagcgcctcgtcccagctcacgcgctcccacttcccgctcccgcgggcccccacccgccgaagggggaagaggatgcggtcagggtcggtgatctggttgagcgtcgcgggacccttggcgcagttgcgccctcgcgagccgggatgttcggggttgccctcgaacttgcgcacggccaaggtgtcgcgatcgacataggcgaggaggccgcaggcgctctcgcagttgaagcaggtggtgggcacgagcatcgatcgatgctcgacgcgcttcggccaggcgcgcgagtcgagctcgacccagtcgtcccagcgctccttgggcgggaagctcgcgaggtcgatgcgcgagggcccctggtagaaggtttccccgcgtgcctcggtctgctcgcggagcgcgcgaatgcgagccgagagagattcgacgtcgttcgtagccatggtggtcgtacctccgagggttacgccaacgggacgcgttggccggcttggacgtaggcgtgttcgagcgggaggatgcacaggagcgctgctgcggcaagggccatgccgagcggggtgaggatcccgacgagatcgagcgcgaatcccagccagaagaggcgcccgagtgcgccgtgggtcatctcccacacggcaaggtgggccttggccgtggggtgcgtgatggtgatctcacccaccacgagcagcgcgttcaggatcgcgagcgcgcctgtgagacgctcgaggtagccgaccgtcgagccgggatcggtgatggccgcgacgaagacgctgacggccgatccgagcaggagcgcctggatgacgaggtggatcggcatcagggggctctgccagagatcgcgtgctttggcttgggcgaacaggaacgcggtatagagcgccgcgagtgcggcaaggggaatccccgggatggcgaggatgcccatggcggtcgagctgtgcaggatgccggcgatgagggtcagcgtgtcgatgccgccgaagaggaggagtccgtagccccccctgacgagccagctctcgggtcgacccttgaggaagagcaggtagaagcgttcgggatgcttgaggtcgccgatcaggagccccccggtgatcgcgaggaaggcgagcgagatcgacggtccccagatgcggacgaggtccgacgagaacggcagcttcccgagcaaccacagcgtgatcggcacgaggtaggcaccggccgagaggcccttcgtccaggtgtagaggctgaccaggccgccccacggtgcattgtgggcgacgtcgtagaccagcttggccttggccgacgagttcggcacgtgggcgtcggccgggtggcccgaggcgatgacgtgcggtccgctcgggatctgggaccacatgtacgtatcgccgcgcggacgctcggccgcgatgggatccagggttgcctggtgtgcgccgcgatagaacagcttcggacgggtccccttctccgggttgcgcacggccaccggggtgcggtggacgacgcgggtcgcgcgtgcggtgtcgtcctcgagcttgccgatgaggatggcctcggtcgggcagacgacgacgcacgccggttcgaggccgatgtcgagacgatgcgcacagaagttgcacttctcggcggagtggtcctcgggattgatgaagatggcgtcgtaggggcatgcggccatgcacgccttgcagccgatgcagatggccttgttgaaatcgacgatgccatcgggtcgctgatacatcgccccagtcgggcaggccgcgacgcacggtgggttggtgcactggttgcagcgtgtgacctggaacgagcgccgaacctgcgggaacgtaccgacctcgacggccttgacgtaggtccgcgtcacccccagcgggacctggttctccgacttgcacgcggtcgtgcacgcatggcagccgatgcacttggtttgatccaggaccttgatccaggtctctttggatgtcgtccgttgctccgtgagcacgctcgccccaccccctgcagcacacagccgtgcgtacgatcggcgcacgcacgcatgtcaacgcatacccagtggggattctaggaacgtgctgcggctacgtccaggaggcgccacggcggccccgggacgacaaaggcagcccatcagggcgtgtgagctgcgatgatgggcgattctgccgccagaggctcacagctggccgggtggcgagatgtgagccctggcaacgctattgcctgcgtgacaggcgttattcgaggagtgatcgagccgcagaattagcgcatcgcgtgttcgcgctcggctcgggcgcagaaggcgcagccgacggtcgttcgatcgccgaagagccgatagagcgggcagtagccggtcagcccggtgatcagcatgatggccgcgagcgcgtagagaacaacgctgccgacgctgccgttgccgaccatgacgccaagcgcccagaacactggcgtcgcgacgacgatccgcagtgctcgatcccagatacccatgttccgtcgcattggtgcctccttgagtggtcctagaccatccaacgcgcggctccgacgagcaacgtcccgggcggcaccgacaagcgacgagggtcctaggaggtcgggaccttcgtccgacgacgggtgaggacgagagcccctacgaaccaggcggcgaggccgagggcgctcgcggcgaggccctcgccgaaccgtggagcgtggtagctcatgacgaggtgctggcgcccagctccgacgtcgacggtcatctgatcggaagggctggaaccaacgggagccgggtgaccgtcgagctgggccgaccagccgggcgcccacgcgaaggggaggacgagccgggtcgggtgggtcgtgacgacggtcgccgtgatggtgcccgatgcagcttgggaggcgtcgaggacgcgcaggccctgctcgggctcgatccagtgggcgggctcagggagctcgaatgcgagtgctgcgccccgaacgatcagttcgtgccaactgctcggagcgagggcagtgtcgagcgggccaccgaggaggtaggcgccgctcgaagcgacggcgacgacacggacggggagcgtggcgcccttggaagcgctgagacggacgctctggaccgtctcgccgccgggaatggcgagctggacggacgatgcccggtgctcggtcgcggcctggatcgtcgcgccgctcgtgagcgtcacgctcatggccaggcgtcggacgggactggcgacggtggcggtgagcttcgtgacgccggtgagatcgccggcgtagacgtcgaggcgaccgtcgcggagcgagagcggagatgacgcggggagtcgggacgccgtcggagcttccgtggcgaagtagcggcgtgaggtgacgacgaggcggacattgaagtcgcgaaccaaggtggacagatcggccggatcgaacgtcgactccggcttggtgccggtggcggcgtcgtagcgagcgaggccgagcgagctgtagcccgaggccgacagtgtgtgggcgtagatgttggtgtcgggctgcgcgtcggtcgcgatcaggctctcgtagagatagagctcagggtcgtagacgacgtagcgcagaggtcgtcggagcaacgatgcgaccgtcggtgccgtcggcattcgcaccggtggcgagagcgacgagagcagcgggaactcgaggacttggttggcgacgtcgaggacgaggacgaggacgaggatgcgcagggcccaaccgcgcaagggcgagccgaggagcacgatggtcgccgctcccacggcgatggccatgacgacgaggtagccgcgcagtgcggcgagggagatccctgtgggcagcgacaccacgttgaagtgttcgagcagcgcagcgggcgcgacgatctcgacgagcgcaaagcccacggcgagggtgccaaagacgatgagtgccactcgagtcgggaggtggtggcggaaggagtcggggtgggcaagtgcccagtcggcgctgccggccgcgaggagcacggcggcgaagtcgaccccgatgaggtaacgggacgcgagtcgctggaggtcgaacagcgggagccggtagacgaggtgcgcgaacggcgtgtggccaccgagtgcgaacagcatgctgagcaccgccgcactccacagggcaggtgctgcaccacgtcggagcgtgctcgcacggggacgcacggctgcgaggaggaggaaggcgaggccgagcgcggtgatcgagacgttgatctcgtaggggttgtagttgccgaagtaggagatcagctctcccccaaaagccatgggatagacggcgagcggcgtgaagatccccgaaaacggtccggcaccggcgtagtgcgggggcaggtgggctcgcgtcgacagggcggtaaaggcgagcccgggtacccactggatcgctgcgagcatgagtgcttcgagcgcgcagatcgcgatgacgacgagatcacgaacgtcgagtcgtcgcccgagggtccacacgacggcggccaccgccaagacgacgaggcccgcgagcatggcttcgggcgcgccggcgagcacgtcgagcgcgaagccggcagcgagcccgagggcgttggcaagtcgagaggagcgtccgtaggcgaggcgagccaggaagacgaaggcaagcatccatcccgcgtcgccttcgatcatgtcgaggtggacactctggccgatcgccgcacccgtgagggcgaggacgaggccggcgacggtggcgaccttgaccccgatgcccagggttcgcgccgagagataccccgacagtgcgatggtcgcgaaggcggatccggcggcgacggagaaggcgagccccgtcgggaggacgatgaacgggatgatgaaggggctgaaggcacccgcgttgaagccagcggcgaggggcacgccgctccagatggcgggatcccacagtggccaggagccatggcgcaggtcgaggccgacgagcgtgcgaagcggtgcgttctgcgtcgcgttgtcgccaaagaggagtgggtgccccgcgagtgccgggacgacgaagaggacgatcgggacgacgatgaggatgacgacggctcggcgcgcaccggcatcgcccgtggtcgtcagcgcggcgcgatccatcgctcacgaagataggtacgcgccaccacgcgcccatagcgcaggccgtagcgccagttgcggcccttcttcgaggtgccggcgcggcgagcgaccatcgtgacagggaactcgacgatcgttgcgccggcgaacgctgcggcgaggaggagttcggcggattggtactggggctggtcgagccggagccgtccgaggagctcggccgcgatgacgcggatacccgatgacgtgtccccgacccgctgaccgatgagcgcggacacgacgagcgagaagactcgaacgccaaggtcgcggatggggtcgcccaccgtgctcgtgccgagtcggcgtgagccttgtgcgaacgtggcgacgtggtgatcgacgagatccacgcccgtcgcaaggtcggctgggtcccactggccatcggcgtcgacgatgccgacgatgcgtgcgccccgacggatcgcgaggaggtaaccgagacggagtgcagcgccttggccgcggttgatcgggacgtcgaggacgagcgcaccttcgcggcgtgccacgtcgacggtggcgtctcgggaaccatcggacacgacgacgacgagcggtggtgagccggcgagctgtcggggcacgcgccggatgacgtcggcgatggtggcttcctcgtcgaatgcggggatgaccaccatgactgccgcctcgggcaacctcgggttgtcgtcgtcgaagcgtgcgaggacgaggcggtcgatggcgtcatccgggtcgaaggctgcgctgcgcacgtcgggtgtgacgcgcacgggaccaccacctttctcgagccggatcctcgcgatgtccgaggctcggctcatcctaggggcgcgcgcgaggaggccagggccgagcgctgcgaaggcggcgcgaacagcgccaccgcggccccgatcggtgctagcatgcgctggcacaaaccctacggatagggtgcgaacgacacacgagggcactagttctgtggtagcgtttcgcaacacggtcgatcggctacggacggtggtggatcggggttcggggctggaggcctccagtccagaggtggaggacgagcaacgtcggtgggctgcgtcggtcggatgggacgcacgttcacgcggtcgtgactcagcaggccaacggacgttggcctgaccaagaaggggagtgagagggaggcgcagtggcaaggtccacgagtgcacggattcagcggcatttcacggctccggggctgcacccgtacgagacggtgggatgggagcgtcgcgacgcgcggatcacgaactggcgtaccggcgacgtcgcctttgagcaacgagacgtcgaggttcccgtgacgtggagccagaacgccacgaacattctcgcgcagaagtacttccggggccatctcggcacaccggagcgggagggctcgttgcgccaggtcgtcgatcggatcgtgaatcggatcgtggcctggggcgaggccgatggctacttcgccgacgacgacgagcgcgatgccttcgcggacgagttgcgctggctgctcgtccatcagcgagcggcgttcaactcgccggtctggttcaacatcggggtcgagggcgtgccgcagcaggcgagcgcctgtttcatcctctccgtcgatgacacgatggagtccatcttgaactggtaccacgaggaagggatcatcttcaagggtggttctggtgccggggtgaacctctccaccatccgctcctcggtcgagccgttggcaggtggtggcaccgcttcggggccggtgagcttcatgcgaggcgccgatgcctcagcgggcaccatcaagtcgggaggcaagacgcggcgggctgccaagatggtcatcttgaacgtcgaccaccccgacgtcgaggagttcgtctggacgaaggccatcgaggaacgcaaggcgcgcgtgctcgcagaagccggcttcgacatgggcgtcgacggcaaggatgcgttctcgatccagtaccagaacgccaacaactccgtgcgcgtgaccgatgagttcatgcaggccgtcgtcgaagaccgggagtgggaactgcgggcggtgacgacgggcgaggtcaccaagacggtgcgtgcccgtgacctcttccatcagatcgccgaggccgcctgggagtgcgctgatccagggctccagttcgacaccaccatcaatcgctggcataccacgccgaatgccgggcggatcaacgggtcgaatccgtgcttcccgggctcggccagggtccacaccaacaaaggcctcatcgccttcgaggagttgaccaggcgcgtgctcgatggcgaggagttcctggtctacacgcacgacagcacgagccctgacgatcctacggagcaggtgctgctctcctcgccagaggcgttcatggtcaccgggtacaaccaagtcgtcaagttgcgcttcgacaacggcgccgaacttcgctgcacaccgggacaccgcatcttcacggtcaatcgcggttacgtcgcggccgaggacctcaccccggaggacgaggtgcagctgctggatcttccggcgccagccacggatgcatcctgggtgttgccggtggcaaccgatccggagttctaccatcacaagggcgaccgccgcgacccgatgaccttcccagagcgctggagcgaggacttcgcccacttcttgggttggctcatcggagacgggtcgctctccaatgggacggtcgtggcgacctatgggtctccagacgaccagcaggagatcttgccgatccaccagcaactcctgctcgagatcaacggcaacaggcctctgaaggtgtcgacccaagccaacggcaccgtccagctgcgctttggcaggcaacggttcatgcggttcttggaagcgctcggcatgaagagggcgaagggaccggacaaggatgtgccgtgggcgatcgagcaggctccagcggagatcgtcggcgcctttcttcgaggcttgttcgacgccgatggcacggtgatcgtcgaccgcaacaaggggtcctacgtttcccttggctcgatctcgacgggcttgctccgctcggtgcagcgactgctgacgacgttcggcatcacgagccggatctacaagacgcgttcggggtcgtcgaatgggtcgttctcgtacaccgggcgtgatggggacgtgagggtgtacccgaaccacgatgcttatcagctacggatcacctcggcgtcgatcgtgcgcttcgccgagcacgtcgggttcggcctcggcgccaagcaggcgcggctgcgcgacatcgtgggtggacagcagtcctacgaggttcggcggacggcgcggctgacggagcgtctcgaggacgggatcgagctcacctacaacctgagcgagcccaagaaccattcctacatcgtcgatgggattgtggtccggaactgctcggagtacatgcatctcgacaactcgtcgtgcaatttggcttccatcaacctgcttgcctacctggacgaggacggcaacttcgacgtcgaggggttccgtcacacggcgcgagtgctcatcacggcgcaagacatcctcgccggcaacgccgactacccgacaccgaggatcgcggagacgtcgcgggcctatcggcaactcgggctcggctatgcgaatctcggggcgatgctgatggcgctcgggctcccatacgactcagacggcgggcgcgcctatgcggctgcggtgacggcgctcatgacaggagctgcgtacgagcgttctgcagagctcgccgagcgcctcggccccttcgctggatacgccgacgatgctgagtccatgctgcgggtgctcgggatgcatcgcgacgccttggcgaaggtcgatggcgctccggaggcgatcgtcgaggccgctcgtgcttcgtgggacatggccatcgcgcgcgcgagcgaggtcggcgtccgtaatgcccaggcatcgctgctcgcgccgaccggcacgatcgggtttctcatggactgtgacaccaccggtatcgagccggacttctcactggtgaagtacaagaccctcgtcggtggcggcaccatgaagatcgtcaaccagaccgtgccacgggcgttgcggacactggggtatccggagcacgagatcgaccagatcacggcctatctcgccgagcacgactccatcgtcggtgcgcctgggctcaagccggagcacgaagccgtcttcgcatgcgctgtcggggaatacccgatcagcccgacgggacacctcgcgatgatgggggccgtgcagccgttcctctctggtgcgatctcgaagacggtgaacctgccgagcacctccaccgttgaggacgtggagcagacatacctggatgcctggcggctcgggatcaaggcggtcgcgctctatcgcgacggatcgaaggtcggtcagcccctttcgacgacccatgaggaggattctgaggccatcacgtcgctcaaggaacagctgagcgagctcgaacgccagctcgcagcctcgcggacgcgccccgttcgggaacgcttgccgcgacaccggcggagccgtacctatgcgttccaggtcgctgacgccgagggctacgtgacggtcggggagtatgacgacggtcgtccgggcgaggtgttcgtcaaggtctccaagcaaggctcgacgctcgctggtgtgatggacgcgttctctatcgcagtgtcgctcgggctccagcacggcgtgcctctcgagacgttcgtgcgcaagtacgtcaacatgcgcttcgaaccggccggcatgaccgatgacccggatgtgcgcatcgcctcgagcctcgtcgactacatcttccgccggctcgccatcgactatctgccgcgagaggtgcgcgaggacctgggggtgctgacgacggcggagcggcgaacggagttgctgttcccagtcgaggaggtcagtgagccgacaacgcgtgcgagtgcgcagacgtactctcaggctgagcatcgcttggactcgggtcgggatgacgtcgtgcatgagactgcgactcgtgagagcgggctgcacgtctcggcgagcgcgtcggacgcaccgtactgcttctcgtgtggcaacgtcatgcagaggtctggctcgtgctacgtctgtcctgcgtgcgggacgacgagcggttgtagttaggtcgagcctgtcgcgagttttcgcgttgcgagttgcgagtttcgcgacccggggtagacgcagacggtgaagggtcatgatgcaaccaggggcgccgcatgagcggctcccctggtgctgtcatacggtagggcgggagccgccttggcagcggttcctcacatcgatgctgctctccggtgagaagagtcgggcctctgatccctgcgagcgatcggccgagtagccgcgtcggtcgcccgcagagatcgtggtcgcggtcgaggcgtcgggccggcgggacgagagcgagcagcgctctcgtcgtgaaccagggccgaacgtcgggtcgtgctggaccacaagtcccttcgtggacccgctctgggagcgacgccatggccctactaataccctctggggtatgacgaataccacaacgtcgcacgagcggccggagggggtggggcggcgcatcgtcgtcgtcggtggcgtcgctggcggtatgtcggctgctgcgcgtcttcggcgactctgtgagcatgcttccatcaccgtgatcgagcgatccggacacgtctcctacgccaactgcggtttgccctactacgtcggctcggtgatcgaggaccgtgaggacctcgtgctccagacgcccgaacgtctccaggcccgcttccggttggacgttcgagtcaacgccgaggttgtctcgatcgatcgtgagcgtcgcgaggtccgtgtccgcagcgtggagaccggtgaggcctcggtgctcccctacgacacgctcatcctgagtcctggggcggtcccgatccgcccgagcatccccggggcagaccggatgcgcgtgctgcgcaccgtcgaagatgccgaacggctcgcctcggaggtgacgacgcggcctcggagcgcgatcgtcgtcggcgcggggttcgtcggtctcgagacggcagaaaacctggctcaccatggcatcccagtgacggtggtcgaggcgcgatcgcaggtgctgccggtgctcgatccagaactcgccatcgcgatcgaagagacgctggagcgccacggcgtccgtgtgatcacgggggctggggtggccgaggtccatgcgtggggcgtcacgctcgacgatggccaggaggtcgagggagacctggtcgtggctgctgtcggtgtgcgtccggacgttcgactggctcgcgcagcagggctcgagctcggtccgcacggcggcatcctggtcgacgagacctctcgcacgagcgacccggcgatctatgccgtgggtgacgcggtcgagaaggtcgacgccatcagcggatcgctcgagctcgtgacgctcgcacatgtcgccaaccgccaaggccggcgagtcgccgatcacatctgtggacgcgcggtcgaggcgcgaccgtcgatcggcaccgcgatcgtgcgcatcttcgacacggtcgccgcatcgaccggcctgagcgaacagcgcctacgggcactcggtcgtgcgtaccaggtcgtgcgcgcgcaccccatgagtcacgcgagctactacccaggtgcccagccgatgtcgctcaaggtcatgttcgacccgagcgacgggcgcatcctcggcgcgcaggcggtcggcggcgaaggggtcgacaagcgcatcgacgtgctcgcgacggcgatcgcggcaggattgccggtcgacgagctcgcgaacctggagctcgcctatgcaccgcccttctcgtcggcgaaggaccccgtgaacatggtgggttacatcgccgagaacatccggagcggtacctgcgacgtggtggagccggaggaggtggagtcgctggtgcgcgatgggtggacgctgctcgatgtgcgcaccgccgaggagcatcggcacggtgcaatcccaggcagcgtctcggtaccggtcgacgagctgcgcgagcacctcgaatcgctcggggacgggccgttcgtggtctactgcgccgtcgggctccgtggtcacgtcgctaccacggcgctcctcgagcatggcttcaaggctcgcaacctgaacggtgggcatcgctcgtgggcagcgtggaaggctgctgaacgcatggcgctcgccgggtgagccggctgaggctcacccggccacgatcggcgtcaccatcgacccatggctaggcccgctcggattctgccgtggtggcgaagtagtcgcggtactggcttcgaaggaggtgcttctggaccttgccggtggcggtgcgtgggagttcgtcgacgaggatcaccgcctttggcaccttgaagccggggagggcgctgcgggccgcggcgaggacgtcggtctcggtgagtcctgagccggggcgtggccgtacgatcgcaacgactgcctcggtccagtgcgcgtgcggcaggcccaccacgacgacctcgtcgatgcgcggctcagctccgtagagtgcacgctcgacctcgagggatgcgacgttctcgccgcccgtcttgatcacgtccttgcggcgatcctcgaaccacagcaccccgtcggcatcgaggtaacccacgtcgccggagtggaaccatcccccggcgaacgcctcgttcgtcgcctgctcgtcgtggagatagccctgcatcgcgtgaggaccgcgatagacgatctcgccacgcgtgtaagcgggcacgagctcgccggcgtcgttcacgatggcgacctgcacgttcggcaccgcgccccccacggcaccggcgtgggagagctgttgctccgggaggagcacggtggtgaggggattcatctcggtttggccgaagccgagggcgaggtcgcagccgagcacctccgtcacgcgcttgacgtcggtctcggccatgggcgccatggcgtagatcccgagtcggaggctcgagaggtcgcggcgggagacgtcggggtgatcgatgagcgcgcggtacatcatcggcaggaggaagatctgcgtgatccgttcgcgctcgatgctcgcgagcagagccgcagcgtcgaaggatcggtgcaggacgacggtgccgccgaggtagagcaggcccgtggtgaggccgttcagctgcgccgtgtggaacagtggcatcacgacggcactgcggtcggcgtcgctgtagtgcatcacgatcggaccggtgagcgactcgatgtagaccgcgacgtgactcgagaccacacccttgggcgccgacgtggtgccactcgtgtagaggtaggtcagcggatctcggtcgtcgacgaagcaggccggctcgctggttgcgttcgggtcgacgaaggcatcgagcgtgtgccaggtgccctgtggcgctggttcccactcggcccctgttccaggggcgacgatgacgtcgacgaggtcgtggtgctcggcgatcgccagcgcaccggagatgagggggacgaactgggcctcgaccaccgcgccgcgggctctggcgtggccgagcacgtaggccagctcgttgggcccccacgccagattgatgggcacgcagacggtgccggtcttggcgcaggcgtagtaggtgacgaggaactcgatgctgttgccgctgatgagcaggagtgcggtgcccctgccatagcccgcgtcgaggagggcatgggcgaatgcgttcacacggtcgttcagcgctcggtaggtcagtcgctcgtcgcccgcgatcaccgcctccttctcgccgagacgccacgcgctccgcgtgagcatgtcgccgacgttgacgcgctgaatcaggttgcgttcgagatcgtgcgatgtcatggttccccctgtcctcggggccggtcctcggggcctgtcctcgagcgtgtgctcggagctacgtgcgccagaccacctcgccccccgctcgttggcaagtatgccaggggctggtctcgctgtcgagggatcgaggaccgtctcggcgggcgggtgcgatcacccgtgagaaggtgcgatcagggagcgaggccgatggcgcgcgcccagatctcggtcatcgcatcgacggcggcctcgtcgtcgaaggggaggccgaggtcgtggctgcgctcgacgaagttctcgaccatcccgcacagcaacgccgccgtcacgtcggcgtcgagggtcgggtcggcgactccttgcgcttggagctggcggaggccacgagtggcccgctcgatgaacaccgagcgcgaggcgagtcggcgacgtcggacctcgtcgttgaaggacgcggcctggacgatcactccgtagaggttcccatggcgacggaacgcctcgacgaagcgcgcgttcgaggtgcggatgcgctggcgtgggtctggaccggcgacttccccgacgtgcgactgctcgtagagcgcggcgatgaacgcatcgacgagcgcgacgaagatcgcgtccttcgagtcgaagtaggtgtagaaggtcccgatcgcgacgttcgcgcgctcggcgatgtcgctcacccgggtctcgaggaagccacgctcctcgaagacggcacgagcggcctcgagcagccggtccctggtacgccgtccgcgttcggtgaccggggcggcgctcatcgcctcggctcgccggagcgctcgacgagtcgcacggtcggggtcgggagctggtcgaggctccggggatcattgcgtgcggtcacggtgacgggtacgctaccagatgaaagtgacgtcaggttcatgttctggcatcggcgtggccggcggccctcgcggtcgcctcgaatcgaggggggagcatgcgcttcaccgaggagcacgacgtctttcgacgcagcgtacgtggggtgctcgagcgcgaggtgctcccgcacctggaggagtgggaacgggctcacagcttcccgggccatacggtcttcaaggccctcggcgccgccggtctgctcggcctcgagtacgacccggcctacggcggccagggcgcggaccactcctacacggtcattttcggcgaggagctcggtcgcatgggcttcggggcgctcgccatggccatctcggtggtgaccgacatggcgaccccgtcgctggcccgttacggctcgcacgaactcaagctgcactatctcgtgccgaccctgcggggggactccatcgcatcggtcgcggtgtcggagccggacgcgggttctgacgtcgcggcgctccggactcgcgccgtgcgcgacggcgacgactgggtcatcaccggcaccaagctctacatcacgaatggcacccaggcagactggatctgcctgcttgcgcgcacgagcgatgagggcggctatcgggggatgtcccagatcgtcgtcccgaccgacgcgccggggtttcgggtcgcgcgcgccctcgacaagctcggcaaccacgcctccgacaccgccgagctggtgctcgaggagtgtcgcgtgcccgtgtcgaacaccatcgggaccatcgggcggggcttccagcagcagatggcacagttccagaacgagcgcatgatcgcgtcctactcggcggtcggcgcgatggaacgtgcgctcgagcgaaccgcggcctatgcacgcgagcggatggtcttcggggagccactccttgccaagcagtacgtgcagtttcgcttggcggagctcagcgccgaggtcgatctgcttcgtcactacaactacgcgtgcgccgaggcctatatggcaggcgaggacaccacgcgctttgccaccattgccaagctcaccgcgggccgcctgagccgcgccgtcgctgactggtgtctgcagctccacggtggggctggctacatggaggagacgtgggtgtcgcgctacttccgcgatgcgcggctcctctcgatcggaggcggtgccgacgaggtgatgctccagatcctgacgcgcctcgagggctacgagccatgagcggatccgggctcgatctcgtcgggctcatcgacgacctccaggccgagcaccgaaccctccgtgcgaccctccacgacgcagggtgggaggtgtgggagctcccgacgcgcgcagcgccgtggcggatccgagagcaggtggcccacctcaccttcttcgacgaggtggccatgtggtcgatcgaccaccctgagcgcctcgacacactgcgcgccgcgttcgacgcatccatcgatccgagcgagcgcgccgacgtggtctgggcacgcgagctcgctccccagaccctctgggagcgctggtgccgagcgaacgacactctcgttacccggctcgcccggctcgtcgacgaggatcccggacggcgcctcgactggatcgggccgtcgatggggcttgcgagcttcgtgagcgcgcggctcatggagacctgggcacacggggtcgacgtcgtcaacgcactcggccacgacgtggcggacacggtgagcgaccggcttcgccacgtgtgctttctcggttgggccgcgagacgcttcgcccttgcgacccacggcatcaccgacctcgacgatccactccgactcgaagcgatcgggccctcgggcgagctctgggcctgggggcccgaggatgccccgaatcgcgtgcgcggctcggcgctcgagatcgccctcgtcgtgacgcagcgacgccacgtgtcacgcacctcggtcgaggccacgggggcgcttgctcgtcgttggctcgaggtcgcccaggccttcgccggcccaccgacggtcgcctcgaaggagcgctgagccgtggcagcgccgatcctcgaacgccccgtcgacccgcgcgacccaggcttcgtcgcgaaccgggcggcgatggtcgagctcgtggaacagctcgagtcgctcctcgaccaagccgctctcgggggaggtgccgaggcccacgcgcgcagggccgcgcgaggcctgctcggggtgcgcgaacgtgtcggcctcctcgtcgatccggagagccccttcctcgagctgtcacccctggctggctatgggacggagtaccgactcggtggcgccatggtgcttggcatcggcgtcgtggaggggaccgagtgcgtcatcgtcgcgaacgacccatcggatctcggcggtgccctcacgcagatcagcgtgcgcaagctcctccgagggctcgagatcgctcgcgcgaatcggatgccgctcatccagctggtcgagtcggccgggggcgacctgcggggcttcgtaccaggcgacgatccggacgctgccctgcgtcgcaacctcgagcacttcgccacctccggccgcatgttccacgacatcaccaccctctctgccgagggcatcccgacgatcgccgtcgtgttcggctcgtcgaccgctggtggtgcgtaccaaccaggcctctccgactacaccatcctcgttcgcgaccgcgcgaaggtgttcctcggcggcccgccgctcgtgcgcatggcgaccggcgagctctccagcgacgaggagctcggcggcgccgagatgcacgcgacggtgagcggcctcgccgactatctcgcacgagacgagctcgacgccatccgcagcgcacgcagcgtcgtcgcccatctccagtggcgcaaggcgggtcccgggccggttcggcgcgatcctcgaccgccgcgctacgaccccgaggagctcctcgggctcatgcccatcgatctgcgcggcccggtcgacatgcgggcgatcatcgcgcgcatcgtcgacgacagccgtttcgaagagttcaagccctcctacggccccacgctcatcaccggatgggccgaggtgcacggctttgcggtcggcatcgtcgccaacgacggtgtgctcctctcggaggcgtctgccaagggggcgcagttcatccagctgtgcaaccagcgcgcgacgccgctcgtgttcttgcagcacatcaccggcttcatggtggggagcgactacgagcggtccgggatcatcaagcacggcagtcagctcatcaacgcggtctcgaactcgaccgtgcctcacgtgacgatcatcctcggtgcgagctacggtgcgggcaactacgccatgagcggtcaggcgttcgacacgcggttcgtgttcgcgtggccgacggcccggatcgcgatcatgggaccgacccagatggcgggtgtgatgtcgatcgtacggcacgagcaggcagctcggcgcggcgtcgagatcgacgaggaggccgaagcggtgcttcggtctcgggtcgaggcgttcgcgcacgcccagtcgttagcgctctacgcgacgggccgcgtcgccgacgacggcgtgatcgacccgcgcgacacccgcgacgtcgtgggcatggcgctctctgcgtgtcacagcgcgccggtcatcggggctcggggctacggagtgttccgcctatgatccgccgcctgctcatcgccaaccgtggcgagatcgtcgctcggatcgcgcgcacggcgcgcatgctcggtatctggaccgtgggggtgtacgcgccgcccgatcgctcagcgccgtggctggacgcgaccgatgacgtgatcgggttgatcggtgacggcgtccaggagacctacctgagtgtcgaggcgctcctgcgggcggcgcagcgtgtcggtgcggatgcgctccaccctggctacgggttcttgtcggaacatccgggctttgccgaagccgtgatcgccgccggcctcacgtggatcgggccgccaccggaggccatcgccctcatgggcgacaaggagcgcgccaaggcacacatggctcgcgcgggtgtgccgacgctaccgacgttcgcgcccgacgacccggacgtcgtgctgccggtcctcgtgaagcccactgccggcggcgggggcaagggcatggacgtcgtgcgcgagcgtgcggcgctcggcgcggccatcgacgctgctcgacgcacggctgcgggcgccttcggcgacgatcgggtcttcctcgagcgcttcgtcgaggtgggtcgacacgtcgagatccaggtggtcgccgacgggcacggggcagtggtgcactgcttcgagcgtgagtgctccatccagcgtcgtcaccagaaggtgctcgaggaggcgccctcgccggtcctcgatgcggaccttcgcgagcgcatgggggcagcggcgtgcgcggccgctcgcgcggtcggctaccgaggcgtggggacggtcgagttcctcctcgagcccgacgggtcgtactggttcctcgagatgaacacgcgcctccaggtcgagcacccggtgaccgaagccatcaccggcatcgacctcgtcgccgagcagctgcgcatcgccgagggccgaccgacgtcgctgcgccaggacggcctcggcatcgacggccacgcgatcgaggtccgcctctacgcggaggacccggcggccgggttcttgccccagaccggcacgctcgtcgagtgggcgcctgcggacgagcctgggatccggtgggattcggccgtggcgacgggcaccacggtcgcgatcgagtacgacccactgctcgccaaggtcatcgcgcacgctccgacgcgcgacgaggctgcccgtctgctcgctcgagccttgcgccgtagccggatccgtggcgtgacgacgaaccgggcgttcctcgtcgccctgctcgagcacccggagttcctcgccggtgcgacgaccaccgacttcatcgagcgcactggcatcgcccatctcgctgcggcgcatgcgcctctcgctgacgatgcgctcatcgcggcgtcgcttcgcgcacgtgccgacgaccgggctcgggtggagctcgcgacgacgctgcctgcgggtcggcgcctcgggcggctgccggcgacggcacgtacctggcgcgtcggcgacgaggtgcgcacggtcgcgctcacggaggatcgcgccgggcggttgtggatcggggatcgtcggctcgatcgggtgggggtcgaaggcggctgggtcgagtggttcgagcgggaggtgggctgcgagcttcgacgccggttccacgtgctgcgcgacggcgacaccttctacgtccagggcgacggggtggatgtgcgcatcgagcgcgtcgatccgtttgccgggcctgccacagagcccgcccttcggggcggcctcgaggcgccgatgcccggacgggtcctctcggtggaggtgggggtcggcgatcgggtacgcgccggggcgctgctcgcgatcctcgaggcgatgaagatggagcaccacgtcctcgcgccccacgacggcgtgatcggcgaggtgcgcgtggcggtcggggagcaggtcgatcgcggcgacgtgctggtggtcctcgaggaggggtagatggcgcgcccggttcgcatcgccaacgtgagtggcttctggggcgatcgcgtggccgccgcgcgcgagatggtcgacggcgggccggtagatgtgttgacgggggactggctcgccgagctcaccatggtcatcctcgcgcgccagcgggcccgagatccgctggccggctttgcgacctcctttctcacccaggtcgaggacgtgctcggcacctgtctcgatcgcgggatccgcttcgtcgccaacgcaggcggtctcgcacccgagcgttgcgcagcggcggtggaggcgatcgcagcccggctcggactcgcaccacgcgtggcgttcgtcgacggcgacgacctcgcaggttcgctcgaggcgatcgcagccggcgggacgccactcgtgcacgccgagacgggagaggccctcggtcagcggacggtcctcacggcgaacgcctacctcgggggctggggcatccgcaccgcgctcgacgacgacgccgacgtcgtcgtcactggacgcgtcgccgacgcatcgctcgtcgtaggggcggcagcgtggcaccacggttgggctcgcaccgatttcgaccgaatcgccggcgccatcgtggctgggcacgcgatcgagtgcggcacccaggtcaccgggggcaactacgccttcttcgacgagatcccgaacgccctccacctcggcttcccgatcgccgaggtcgcagacgacgggagtgccatcatcaccaagcaccccggtcacggtggtgcggtcaccgtcgggaccgtgaccgcacagctgctctacgagatcggggcgccgagctacgtcggaccggatgcgatcgcgcgcttcgacacgatcgtgctcgaggacctcggacacgatcgagtccgcattcacggcgtgcgcggggagccacctccccgaaccgccaaggttgggctcgccgtcgcagacggatggcgcctccgcctcggggttgcgatcaccggactcgacgtcgaggccaaggccgctctcttcgagcggcagctgcgcgcagccaccgagggtctcgggctgcgtcgactcgaggcgcacctcgtgcgcaccgacaagcgcgatccgcgctccaatgaggaggcgaccgccactctcgagatctccgccgacgccgacgacgaggcggtggtcgggcgagctctccgcgctcgcgtgaccgagctcgcactcgcgtccttcccgggcctctgggtgagaggggtcacggcccgcccagagcccttggtgcgcttctggccgaccttcgtcggctgggaatggattcacgaacgcgtcaccacgccatcggcgacgatcacgctggagccgccgccgtggagcgacggcgcgcatcgcgaggtcgcccaacccgagcccgccgtcgatgcgaccgtccagccgagcgatgcgttcggcccgtgccggatcgtgccgctcggtcggctcgtcggagcgcgctcgggcgacaaggggggctcggcgaacctcggggtgtgggccagaacggaggaagcctacgcctggctcgctggcttcttggacgtcgacgagctccgaaggctgctgccggaggttgcgccgctccaggtcgagcgctgtgcactccccaacctgcgagcgctcaacttcgtcatccatggactgctcggggagggcgcctcagcaccgcgacgggcggatgcgcaggccaagagtcttggcgaatggctgcgtgcccgactcgtccctattccgctacggttcctcgtgtgagcgagactgacgagatcctgctcctcgagcgtcgagacggcgtggtgaggatgaccctgaacgacgtcgcgcgacggaacgcgctctcgccagcgctcctcgatgcgctccatggtgccctgcgcgaggggagcagtgatgaggacgtgcgcgccatggtgatcacgaacgcgggatccgtcttttgcgcgggagccgatctcgccgcggcgggcacgagcgccggcgatcacgcgacgctcgccgacgtcctccttgccatcgaggagtccccgaagccggtcatcggccgcatcggcggacatgccttcggcggcgggctcgggctggctgcagcgtgcgacatctccatcgcttcgtcggaggcgcgcttcggcttcaccgaggtgcgcctcggtgtcgcacccgccatcatctcggtggtgtgcctcccgaagctgcgtcgcagcgacgcgctcgagctcttcttgaccgcagaacgcttcgaggcgactcgtgccgtcgcgagtgggctcatcacccgtgccgtcgagcccgctcgactcgacgccgaggtcgacgaggtgatcgctgccgtcctccgcggtgctccaggggcgctcgcggtcgcgaagcgcctcgccctcggtcacgatcgcgaggcctcgcgcgaggcctatgccgccatgaccgagctctcgcaggcgctgtttgcgggtgcggaggctgccgagggcatcgcggctttccgagagcgccgagctgccgcctgggttccactcgggctcgggggcgcacgcacctgagcccggtgcgagccgtggccgcgcgacagtgcagtcgcggcatctcgcgcgccgtcggtggatcgtgatcgcagatcccctcgcgcaagggtctcgtgccttgctcgaaccgcccggtcgtccgcggagacggtggggcgagcgcctggcggtgctggtgcgtgccggcccaggagacttcggctcgatggcgcacggcaagcgggcctcatcacgacgagcagggtccgagaggtccaacggtgggcctctccagcggccatcaccctgtgctgcggcgtcatcacggatcttctggacctcgccgcgggcggcggctaccatatcgtcaccattgcgagcgatgaagggggagatgagggtatgaccacagttccgtccggcgacggggataccgcgtcgggccatccgcggctcaggcacaacgcgctcggcgtcggtgacatcctcggggtgtcgttggccgatacggcgccggccatgagctttttcttttcgttcgccgcgatcgctgcggccgcaggcgtggcttcgccgatcgcgatcgtcgtcgccgcgatcgccgttctgctcaagctcaacagcctggtcgagttcaccaaggtgataccgagtgccgggtcgtacgtgtcctacatcgccaaggcgttcggcggtcgggtgggtgtggtcaccgcgtgggccctcgggttcggctacatcgtcgcggtcggctacgtgatggcggtgatgggtggcttcacctcccaggtgatccagcaatacctgcacgtccacgtgccctggcaaccgatcgcggtcgtcttcgtggtgctcgtgtcctacctcgtctatcgaggcgtcaccatcagtgcacgctgggcaagcgcctcgttcgcgttcgaactcgcgctgatcgtcgtagccatgattgccatcgttgtccactaccacaaccagctctcgctcgtgagcctcgatcccgccaagatctcgcggggcatctcgggtctcgggctcgccttcccgctggcggtgttcctcttcatcggcgtcgggaatccgggtgcgatggtggaggagacgcgtgatgcgcgccggagcgttccgcgagcgatctacacagcggtcatcgttgccaccatcatctacgtcctcatggcggtgacgacgtcgatcgcgttccacaacgatccgacgaccatcggcaaccttgccgcgcccttcgtgacggcggcgagccatgcactcgggccctttgcgatcctcgtctacctggccggcttgaccagcacgttctcgtcgctgctcggggcgacgacggcgcagacacggatcttgttcagcgcggggcgcgacggcatgttgccacgaggtctcgcgcgcctctcctcgcggcaccagaccccggtgagcgcgctcgcggtgtactggatcggggccggggtcatgaccttgatctgggccagcaccggcaacccgctggtgcttgccggtgacatcgccaccctcggaaccatcccgatcgcgctgacctacctcgcgctcaacatcgcactgccggtgtactacctgcgcttccaccgcgaggcgttcgccccgctgcgccatctcgtgatccctgtccttggcgttgcctcgctcatcttgccgctgtggggcctgatcaagcctggtcagccctacccgttcaacgtgttcccctacatcgcactcgcggtgatcgcgatcggtgtggtggtctcgctcgccacgggtcatcgtgtccggccgcttgccgaggcaccgttcgatccgctcgctgaggccaccgactgagatcgcccgagcccagctacgacactgccccggccagacgtggccggggcagtgtcgtgtgatgggtcacggcaggagaacggctcaggcggagcgagcggacccgcgagcctcggagaagagatcgtcgtcgggatcgaggaccccgagcgtgtccgcgatggcctcgacgaggcttgccgcggtctcggaggttgcgccctcaccgagcgtctccgcgatgaccgcacggcgcgcatcgtcgagtgcggcccgagcggttcgccccgcctcggtgagctcgatgacgtccgcgtcggtgcgcacgaggccagcgtcgcggagtcgagcgagcgcgtcggacagatcccagccggctcgcgtcgccatcgtgagcgtgctctgtggcagccgcccatcgcgcgcccggaagagcagccaggtcgccgccggagtcgtgccgagtccggcgtcttgtgcgagtcgtcgatacagccgctcgacaccgccgtcgcgtgagagccgttcgaggacgcggctgatggcgtccttggcgggatcggcttcgggcatggcgaatccctcaccgaggtccgcggccgcgacggagcggcgcaggcgcagctcgggcaggaagagcgtgagcacgaaggccaagaggccgatcggcgctgcgacgaggaagactcggtccagggagcttgcgaacgcgtgcaggagctggggcaggatctgggccgggatggcggtgagtgccttcgggctctcctcggcctgaaccgccaggttggccgggaggtggtagcgggtggcgacggcagcgagcttggagtcgagcgcattggtgaagatcgagccgaagatcgccacgccgaacgaggcgccgatggagcggaagaacgtcgccccagaggttgcgacgccgaggtcttcgtagcccaccgcgttctgcaccgcgatgacgagcacctgcatcacgccgccgatccccaccccgagcacgatcatgtcgaaggcgatgacgccgtaggacgtgtgcacgctgaggcggctcagcagccacagtccgaccgtcatgagggccgtgccgacgatcgggaagaccttgtagcgcccgaatcgactgatgagcaggcctgccccgatgctcatgacgagcaggccggccatgagcggcagcagctggatcccgctgaccgtgggggaggcaccgcgaacgatctgcaagaaggtggggaggaaggtgattgcgccgaacatcgcaaagccgaccacgaacccgatcgcactcgtcatcgagaaggtgcggttgcggaagaggcccatgcgcaagatgggctcggaggcgcgctgctcgacgaggacgaaggcgaccagggcgacggtggatgcgatcgtgagggtgatgatctgccacgaaccccatgggtacgtcaacccaccgagggtcgtgacgaggatgtagccggtcgcggcgagggccacgagcagcgtgccgaggtagtcgacgcgatgctggacgcgcgtggagagctggggcagggcgctcgagatcaccgcgatcgcgatgatgccgatgggcaggttgatgtagaacacccagcgccacgagagcgagtcgacgaagaagccaccgagcaacggtccgacgacgctcgcgaccccgaagatcgcgccgaagagcccctggtacttgccccgatcgcgcggtgacaccacgtcgccgatgatcgcttgcgcgcccacgatgaggccaccgccaccgagtccctggagaccgcggaacagaatcagctccagcatgttctgcgacaggccggagagcgccgaaccgacgaggaagatgaggatcgcgagctggaagaagcgcttgcgtccgtagaggtcgccgagcttgccccacagcggcgtcgaggcggtcgaggcgatgaggtatgccgtgaccacccagctcaggtggctgaagccatgcaggtcgttggcgatggtcgggagtgcggtggcgacgatggtctgatcgagggctgccaccagcatcccgagcaagaggccagtgagaatcagcccaaggcgagcgccgtgggcgcgtaccgtcgacgacggcgagagcgtggtgtcggtcatcgaatcctcctggtggtggtgtcggtcatggtgtggtcgaaggcactctggagatcggctccgaagcgccgaagtaggtgggcgagtgttgcaatgtcatcgtcgttccagtcggcgagcgcgtcgtcgaggaatcgtcgatgtccctcgcggatctgggcgaggtgtgctcgtcccttgtcggtaagggcgatgacctgcgccctgcggtcgttggcgtcactgcgacgcgtgacgtagccgagagcttcgaggctcgcgacgtgccgactggcgaccgagtgcgagaggccaaggtcgctggccacctcgccgaggcgcctgggtccgagcttcgcgagtacgccgaggatcgccagcgcgccaccttcgatctcgaggccgagggcgcgggcgagcggaccggtgtgttggcgcgcgatcctcgagagacgcgacagctcctcccagaccgcgctgacatcggctcgcgtcggagcgacgtcaccggaagcgcgcataatggtcgtcctctcattcatcggcgctcccgtctcctgggatcgtcgacggggcttgctcaataggtgtgtgacgaacacaacaatagacggtgcgtcgatgttcccgaccgcgtgccggcttgtggtccgatcggtgctcgagcgccatcagccagctctccgcgcggacaggcccttgcgtctgctgcagcggtcgcggatcgcggttcgtcaccagggggtcgataggctgccggctggggagcgagggagagccgacggtgtcgtatggagttgttggtccgctgctgcgcaatcgcagggccggaccttcgtcgttgttgtgggcgagcccggaggcacggggccctgagacgctcgtcgtcagctctccggcctttcgcgatggcgagccgctgccagatcgctaccgcggtcgcatggtcgggctgaacgtctcaccgccgcttcggtggtcgacgccacccgcgtcagccgtcgagctcgtcctcgtggtcgaggatccggacgcaccgcggcgccgggcaccggtgcacgcagtcgcacgaggcatcgagccggtgctcgagttcttgcccgaaggcgccctcgctcggccgagttcggtaccgggggtcgtgctcggcaagggactcctcggacagcaggcctgggtgggtccgatgccgctgcgcgcccacggtccgcaccactacacgttccagctcttcgcgctcgacgtccggctcgacctgccaagggtcttcacccgcgacgatgtacgcaccgcgatggacggccacgtcgttgcacggggtcagctggtggggacctacgaacgctgaacccctcggtcggcgcgagcgtggtgcgtcgtgttcggatcacgccgacggggactcgtcgaggcgagtcggtagctgggatcggtagatcgagtcgtcgacggccttgacgatcagccaggcgatcgcgaccgcgatcatcgctggtcccaacaaggcgatggtgccggtcatctccgcgaccatcagcatcaccgcgatcggtgcacgagagatgccgccgaacatcgccatcatgcccactacgacgaaggcggaggcgtcgtggccgatcgctgggacgagcggtgcgaggatgcgccagaccgcaaggccggtgaaggcaccgatgaccatgccgggcccgaacacgccaccggagcctccggtgccgatcgacagcgacgtcgcgacgatgcgagcgatgggcagcaccacgatcacgaggagcggggtgtggagcatctggtcgctgagacccttctggacccatccatagccggtcccgagcacctcggggagccagagggcgaggagaccgacgaggaggccgccgatcgccggacggaagtgtcgagggatcgggagccgtcgagcaaggcgcaccgtgccgtagaacgagcgcgcgtacagcaggccgatggccccggccacgaccccgacgatggcgaaccacacgagggtgagcggcgtcgtgagctcgaagtggccagcgacggcgaacagggggcggaacccgtagacagcgtcgaagatcgccgaggcgatgagcgaggcgagcagccctgggagcagtgcttcgtactcgaagtcgtcgcggtagacgatctcggccgcgagcacggcgccaccgagcggggcgccgaagatggcaccgatcccagacccgatcccgaccgagaccgcgacgcgcccgtcctcggtgccgaggtcgaggactcgagcaagcagcgagccgaagccggcgctgatctgggcggtgggtccctcgcgtccacccgagccacccgatccgatggtcagcgccgaggcgatgatcttgacgacgaccgcgcgcagacggataccccgggggtcgtggaggacggcatcgatggcggcgtccgtcccgtgcccctctgcttcgggtgcgagcgtgaacaccagcatgcccgcgccgatggcgcccagcaccacgctgagggggatcgcccatggccgcgcgtagtggagcgatcctggagcattgccctctccggctggcgtcgggacctgatagccggcgagcacggcgaggaactcatgggtggcgaacgtgagggccgcgtagaagatgacggcgccggccccggcgatgacgccgagcgcgatcgcgaggatcacccgtcgtagcagcgtgggctgccgacgaagccaccgtgacgtctgcgttcggatcgtcatcgccgagatcctcctgatcgacgagcaccgtctcgatgtgcgctcgagcgagggtgccaccgatcgggcgtcgcggctgggtcatcgagtcctctcgtcacgggtgctcctctggttctcgagactggccctgggccaggtgccggtcgcgggctccctcgatcaggaagttcaacgagatcgcgaactgctcgaccgtcgtgaagcgcgcgaggtccgcttccatcgggtcacgcggtacgtgctggttgcggaggcgctcggcgcgcaggacagcgaagccgatggtgtaggtgtggagggcggcgtagacctgatgggctgcctccggcgtgaacccgcccgccgcgagccgcgttgccatcgcgtccatacgggtacgagcgagctgcgtcgcgacgggccgacggaggtagagctcgagaagcggcgggtaggcgaggagcagctccagcagccgcgtggcggcgtcgacgatccagtcgcgccaggggagcgaagggtcaggctcccatcggttcgcgaagagcttgtcgaggagcgcttcgaggagatcgtcgcggtctcggacgtggccgtagatcgtcatcggcgccacgccgagcctgcgggcaagggtgcgcatggtgagcccgctcccgctcggatcggtcgcgagcgactcgagggctgcggcgacgacacgctcccgcgtgagcgcgactcgccgagacgtggtcggtttcgagccggcgccgccgactgctccagcatgcacgacgatcagcctagcgcgtctatccgtacgcgtacggcactggttcaccgagattacgcgccgcgagtggcgaggcgacgagtacggacacggcgcccgtggggcgacactcctgcagccgacgacgggcggtgagccctcgctgtgggtcgatcgtcggcgagactcagtcggatgccgcaggggtcgggttcgtctcgctgggcgatgccatgatgcgacgagatcgacgagcccgcggtcgtgtggaggccgtcgccgcctcggctgcgagagccgcctcccgcgagggtgcgaccatgtcggactcgagctcgtcgaaggagcggatgccgaggagtgccatggtgcgcgtgacgccgtcggcgaggatgcgccctgcgaccgcgacgccgcgctctcccccggccatgaggccatagaggtaggcccgcccgacgagcacgaactgtgctcccaggccgatcgcggccacgacatcggatccggcgcgtacgccgccgtcgacccatacctccacccggccatcgagacgctctcggacgatgggtaggagcgcgaggggcgcgagggttcgatcgagctggcgccccccgtggttggagaccacgatggcgtcgaccccgatcgcagcgaggcgctcggcgtcgtcgatacgctggacgcccttcacgacgatcttgcccgaccacagcgatcgaacccactcgatgtcgtcgaaggtgacggtgggatcgaacatgcggtcgatgaaggagccagcggtcccttcgaagcccgtctcgagcgatgcgaagcgaacgggcggcttggtgagaaaatctcgcgaccacgctggatgcagtgcaccctggaggaacgtccgaagcgagggtgtcggcggcagcgtgaggccgttgcgcacgtcacgcatgcgtgccccggccacggggacgtcgacggtcaggattaatgcctcgaaccccgcctctcgggctcgctcgacgaaggcccgggtcggaccccgatcgcgccagacgtagagctggaaccagcgacgcaggtgcggcagttcggccgcgagttcttccggcgtggtcgtaccgaccgtcgagaggccataggggataccaagagacgctgcgacacgaccgaccgcgagttcgccgtcggtgtgcatcatgcgtgtgaagcccgtcggggcaaagccgaaggggagcgcactcggactgccgaggacggtccaggtcgggtcaaccgagctgacgtcacgcaggacatggggtcggaagacgacgtcggcgaacgagccctcgttgcgaagcatggaccgctccgcttcggcggcgccgtcgacgtagtcgaagaccggccgaggggtacggagcttggcgagacgccgcaggtcgtcgatcgttgcggcccggtccagggtcggcaggagcgtgcgcaggccacctcgtggcttgatgaggtcccagcgctcgcgcagctcgtgcactcgtgtcacgtccacctcccatcgcgtcgcgtgaggatcggtggcgagggcgaccggctccacgaggccgccgatggagtacgccgcacggtgagtcagcgcctcgcctgcagcgcctcgacgatgaagcgccgttcctcgctcccttcgacgaagaactcggcgacgggatgataggtgtccgccgttcgcacgatgcgctcggcgacctcgcagcgtcggagcagttctccaatgccgagagtgtccaggatggcccgcggatcgctgacattggcgcagccatgagccgccagaagttcggcgagcgtcgcgctcagggtttcgaggccctcgtcgatggatggcgcgtgcgcgctgtcgtagtcagccatggacacctccgcctcgctggtgagtgtagctcggtcctctgctgggtgctggacggccaggtggacgcacacaatcccgcgaccggccgaagtctcggagtacttcgtcgtggctgcagggatcgatgatcgcgcgccgtgcaacctgcgcagtgtggctcgcgtcgatcaggtcggaagcgctcgcccgcgcgaacgggtccgtcgaggcgaccggggagcgaggagtcgttccgggtcgaacgtgcgcgcgagcaccgcgaggccgacgatctcgacgaggaggagcgcacctgcgagtgcaacgccgtcggccacgctcaggctgataactccttgcacgagtaagacgatcacgaggaggaccgggacggacgcaagcgccgagagctgctgtgccacgcgaacatcactcgcacgactggatgcgaacagtccaaccagcaccgcccaaccgctgagcagcacatcgaggccgagttgacgcacgacgaggggagcggtgatgagatgggcactgaccgatgcggcggctgcgaagtgaacgacgacgagggtgagcgcgtacaggccccacgatccgatgaacgtcggcgcgaggacggcgagcagcttggcgacgtagagttcggtcgcgctgaggggggagctgagcagcggctcgagcgtcccctgatcccgctcgccgacgatggcaaagcccgccagcacgcccgggagcacgagcggggggagcaggaactcgatgctgctcgccgtcgtcaccttgtcgaggagggacatgggggcagcttccggcagcgaggtcagggagagcaccggcgcgaccagcgaaatgaggggcagagcgaccatgctgtagagcacgtagcggttccgacgaaagtcggtgaactccttggcgatgaccgcccgtatccgccaccacgtcatcgatcgctctccttggtttcgcccccgacaagctcgaggtagacctcttccaagcgctctcgggggcttgcgagctcgaggaggcggtcaccggcgtggaccagcgcctccgcgacgactggtgccagctcgtccggctcagctccgtcgatgcgcaacgtgtgttcgtcggtgacgacgacatgggcggcctcgacgacgggtgcgagatgcgccttggcgtcctctgcggcacctccgacgcggacgacgagggaccgctgactcccgagtccgagttcccctggcttgccgacagcgaggagacgctgacgaaggatcgcgacgcgatcgcacacccgttccgcctcatcgagccgatgcgtcgtgatgagtacggtgcggccctgggctcgcagactggcaatgagttcgagaacatcgcgggctgcgaccgggtcgagaccggacgtgggttcgtcgaggaagatcagttccggctggccgaggagcgtacgagcgatggcgacgcgctgacggagacccttcgacagggcgcgacaggcatcgtcgcgtcgactcgagagatcgaccgcgtcgagggcctcacgaatggcgcggtcgacgtcgtggactccgtagagccgtgcgaacaggcgcaggttctcgacgacgctgaggttgccgtagaggcctggagcctccggcatcaccgcgatccggcgtcggatctcgggcccgttggaggcctcgaggtcgataccgagcacacgcgcgcgcccctcgctggggcgcaccagggtcgcacaggtccgtaccagcgtggtcttcccagcgccgttcggccccaagagtccgaagacctcgccgcgatcgactcgaagggtcacgctctcgaaggcgacgcgatcgccgaagcgcttcgtgagaccatcaagctcgagtgcagggtgagcgtgagagtctccagcactccagtcggcgctcgtcgccgagagagcgtggtcgggcatgacctcgaacactaccagctgtcgtgatcctcatcatgccccggacgcggtgagacgaggaacatcgcgacacgtgctgactgaacacgtccgcgaagaccgtcgtgccctactcggaaccaacaccggatgctgcgcgccagcgcgtcttcgttcacctgagtgtggggcatactgacgaggaccatgctcgaggatcgtgagcacgatgtccggctccgggtggtccgcctcgccgccgcgtcgttcgtgttcgcgggcgacatctggcaagttgtcgcgacgggacgcggctgacacctctggttgaggagcctcgtcgtcggctctctccttgtgggactgacggcaccctgcaacgatcccacccggtgtgtgacgatcccgatcagccagaccgcacgggagggagaccacctgatgggagcacgcgccacacaggcgaaggtcacgcttgtgctggcaccaaccacgccgaagccgtcgctgccgttgacaggaaggctgaggcggtagcgccgaggccagcaggttctggtggagggaggatcgtgagctcgcgatgcaaggcgcccgacggtgtgagcgcgacgatcctcgtgatcgaggggaggggcggcgaggccagggtgagagcgagcaagcagccgtcgtggttgcacgcgagggcggcgttgatcggcagtgccgaggctggtgccgcgaggcggagctggtgcaccgcgaagcctgatcccgtgacggtgccggtgtacacgagtgccgacaggcccgtgcgcggctggaggttacttgcgctgacgacgccgacgcacccggtgtcgtggcaggacagggcggtcgctgggtcatcggcgagggccctgggttcagggccgcgcacggtcatgagatgccagatgcggccgccgtcgcggctctccgcgatggcgggggcgatggaaccgtagccgagagcgaaatcgtgctcggcgatcgccacgcaggacaaccccgtcgggcatgcgatcgaaagcaccgagaggtcgttcggggcgttggtgatggtcgctcgctcgaaggtcgtcccggcgttgtcggtgacgagcaccgggaagccgtggtggtggcttatgcccgcgactgccaccacgcagtggcgtgcgcttgcgcacgcgagtccctgggccagcgtcccacgagggagggtatggtccgccacgacatggccgtgctcgagctcgacgaggaacgtcggaccattgatcgatccggtgagcaggtcgcagacggtcgtcgttgggcacgagagtgcgatgggcgagagcagtacggccgcgttggggagctgtagcacctctctcatgctcgggcgtgtcgcgagggagttgaagccgaggagctgcggaccacgtgctgcctcgagcacctcgaagcagatcgattgcacacaggaggtcaggctcgcaggtgatgggttcatcccgagctgctgaccgaggctgatcgaggaaccgacggcgagacggttgccgcgaggtgcgacgtggataatgacggccggtccggcgctgcccggggttgcggtcgcgatgcactcagtcgcaccctgcgtgcagaacaggctgagctcctcagcggccgggctcgatggcagcgtgagcgcgcgaggacgaggtccgagctggaacaccacggacgtggtcttcgtggcacccgagagctgggcgagacagaaggagctcgagcacgccagaccgcgcagcgcggaggtcgacgatggtgcggagatcgtcacggcggtcgcgtgtgctgcggtgagctcggttgcctggaccgctccgctcgaggtgaccgggttcgcgacgaaccagcagttcgctgggtcgcagctcgcttggagtccgaaggcgttcgggctcgggtgggcgagcaccgtcgcaaagcccttcgagagcgagccctcgtaggccccgctctcgaaggggccgttcgtgttggccgtgggagtcgccccttgcgggggagggagcgtcgagaccacgtcgacgcacaaggaggcgttggcgcaggcgatcgagttgcgctctgccggcgcgatgtcggggagctggagcggttcccagggtgcagcagaggtgaggcggacgtagccggcggtggtgccgtcacgcgtaccagtggtccagcagggtccggaagggatgcaacccagtgtggatggttcgtagccggctgcgaccgcgacgctctggagaccgacgctgtcggcagtatcggtctcgaagagctggcccgtgccggagttctcgagtgggggctcggcgaggacgtagcagacccggggactctggcaggcggtcgcgggaacgaaggcgtcggacgggagcgaaatgggggagaaggtgaggcttgcgttcgtgcttgcccagaggctgctcgccccctgcgcgttcgatgtggcgagaaggcaggtcgatccggcgcacgagtactgcctcgagagccctggagtactgacgctctgcccctcgccgaccgcgatcgggatggctcgcaggttcgtcggcagggaagcggcgccggccgggggagccgggcgcgacgacgtcgaggcgatgacgacagcgagcgttcctcccacgaggacgatgacgagggccgggacgacgagtgggccggtacgagcggagcgcgccatggtgggattctacatcacgttgtcgacacggaaagggctgtcgcccggcaacggtgcgagcgtgaacccgtaggaacagctggtgggcgcgatgtcgagcgacgacctcgttggggaccggtcgagtgcacggcgctcctcagggagctgtcgtgccgacactctctgaaccacccccaagtttcgtgcacacctcgtgacgtgtgaacggtctcggactcggccgccagatggccatcgtactcctgttcgacctcgacgggcggacgacgtcccagccggtgcgtgagcctgcgcgtgctggagcggtgcacccaggctgaggtcgtctcctcgaggtccgtgaggctcacgaggggcccgcgcgcgcagggtgagccaggccacacgcactcggttgtggagagaccgatcgtggtctcggcgagcgcgttgtcatagccatccccgacagagccgatcgagggcaccaggcccggcagcaggagcgatttgccaacgtgaagcgccgagtgggtttggcctgcatcttgcgtgatggatcgtgcgttcggttgcgggggtgcccctcgtgtgctcgtcggccctcggccatgcgcagggcacgctcgacgagtcgggtgtcgtggcaaagcacgagacccaccccctttgagatcgtgccggcgaaggcgtcgatcacgaaggccgtggtggcacgccacccgtgagccggacgcaggtgacgtccgccgcgcacagctcgttatggggccccctggtgggggacccggtgctcgcgacggccatcctggaccgcttgctccaccacgccacggtcctgaacatccgaggcgagagctaccgcctgaaggaccgcaccaagcaacggctccgcggtgggctgctgccccaggcagccgaggccatggcgaagggaggtgatgccgagcaccacgctctggggagctatcccctatagttgtgtcgcaggtgggtcacttctgaccggtgatctcgggtcaaaagaaggccggtgcctacaatcggcacccggcgagatcagcgagcggtagcgtgaggacgtcgggtctcacattgagggtggactcggttgtgggggccggtcacatggcatcgagctttctcgggcatctatcgaacaacgatcacctccaggtcatgcgccatcctgcgcagcagcacaacgtcaacgtcatcgagtcgctcatccgtcgtcttcgtcaatgccgcaccttcgaccagtacgacgacgttcagcgcgagctgttccagcacctacactgccgcgaacagcaccgttccgactgccgacgctgtgctgctcgacttcagcggggacgatctcttcccgcattactcccgcagctccctctcggtgtagacccactcgacccagagacctggcgcatcgaggacctcgtcttcgatcgcgtatgtcgccagctccgagcggtcggcgacgcactcgcgtggcgggcatcgggctacgaccgccggtacgtcatcgcgctgagcagcaacgcctccccgggggtcatggcgggaaagactggcctgcctgctgaacttggtgctgcgaccgagcttcgcaagagagggagcttcgctctcctccacgatctcacgaactgcctgcgcatcggggacatcacggagttcaagtcggatggttcgaagctcctctacgaaatcaagtcaagtcccacggcgaagaaaggaccacaacgcagacgcatggaggccgctgtcgaagccgttatgaccggcggcgagcttcccggacgaccgggacaacggatcgtgagcccgacccagcgctgcggaacgcacatccgtgcgttcgtaaccggcatcgacgaggccgtccgccgaggtatcgccggggccgccatttcggatgcccgtgcattgactgccttctcgtttcccacgctcgcgcagactcgatcgaacgattcggcacggcagcttctcgacgatttccatgctgagcgccagagcgcgatcgaacgtgcgggaatcgccaatgttttgcatcacgtaacggtcgcaagcgcaacgcgcaatcacgacttcgttccctctgtgatgcccttcgcgctctttcccctgccacccatccaggccgctctcctcatctgcgactacatcggcttcagcattaccgtcgcgccggagcgaatcgccgatcactttgagcgcctggggttcactgccgacattccgcttgtcacggccaacgacagccttgtcgccactgacacgatcatcaacgtgcgacggggctcccggggtatccggctgcacccaggtgccctctacgaactcctcatcgagtgcctcgacctcggatcgtgggctacggccattgctgaagttgtcgatgactcggacgctccgccccatcccgtgcttgctttcttgacgactcgtgtttggcgctgaggcccacgccagaggggtcgaccaaagcctttccccgacttgaccctcggtgactgtaagcagcgggctggccttcccccctccaggttgacacctgctataggaggaagggatgagccagacaccgaatccaccaccgggcgaggcccccgttcgtcgatgacgaggccgttacccgagccagttcctcaaaggacgccgcagcgttggtgctcgaccagtaccgcaccatcgctgacgtcgctcgcgaacttggcatcaacgagcagacccttgggaactgggtgcgtcaggaacgcatcgaccgaggtgagcgagaaggcctgacgagcgccgagcgcgaggagatgacccgcctgcgccgccaggtcaagcagctcaccatagaacgagacctggcgaaacgttgcctggcctttgcggatcctgcgagggcaaccagtgacccgctaccgctgggttgccaaccaggaggccgagggcgtcccagtagcggcggcgtgccgagtagcgatggtctcccgccaggcgtactacgcctggcgacgctggcgcgagcgcggccctgaccacgagcacctggtgctcacgagcgagcttcgcgccatctgggaggcgagcgacggcacctacggcagcccccgcatcacccacgagctgcgacgacgtggttactgcgtcaaccacaagcgggtggaacgcctgatgcgcgagctcgagatagccgcctgcccacgccggcgcttcgtagccacgacgaggcggggagaggacgcagcgctcctggacctcgtccgtcaggacttcgctcttggtgagccgaagcgcaggtatgtgagcgacatcaccgacgtccgaagcgacgaggggttctgctacctcgccacggtggcagatcttggctcgaggcgcatcgtgggctggtcgctccagcgtcacatgcccgatgacctggtggtcgaggcgatctgcggagctcttcggacccggggcagcctggcaggggcgctcttccacagcgatcgcggtagccagtacctctcccggaaggttcgccagctctgcgcaatgctcgggcttcgccagtcggtgggcagggtcgcgacctgctacgacaacgccgtggccgaggccttcttcgggagcctgaagcgcgagctggtggctcgctaccgcttcgcgaacctcgccccgaggctcgctctgccatcgctacctggatccaccgctacaacacggtccgcctgcactcgagcctcgggtacgtgccgcccgtcgagtacgagctctcctgggcctgccgggaggtggccgtggcctacattcagactgtcaagcaaatggggggaagcccatgacctctcctggctgacggctggagggaaatcgcggacgccgaattcgtggctgcgttcacgaacccttccgtccccatgaagctttgcacccagaccattgtcgaagagcgcaacctctgggtcgagaccagcgacatgctcgctctgggccggctgctcgcagagagcggccaggttgccatctcattgtcggggcatgctcgacgggcgcctcctgggcggatctccacggtggcaagcgctccgtcccacacgatggcaagctggccttggtgagcgtcggcatctcgggacagctcagtcagcctgagcacctcgccagcttgcgcttactcctggccgggtcgaggtcccacggttcgcagacacctcggtggtgccgacgatctcttacgatcccaccagcgcggcgtcgccagcgatcggggaggtgccggccagctccacgaacagacgctcggatcggcggccaatggtcgggaaggggcgcggccacgacaagcaccctcgttgggtggggctggccacgtcctcggtccacctcactccacgaagagtgcctcggcgttgagctcgcggaggatgccttcgaggtcgtcggcagtgggacggaaagggaagtcgcggaacggctcgctggctcggtaggacccgtagggccgggtgcacccaggggagccgtcctcgcctgggcagccgttggtcatgaaagccagcccctcgttggcgacgcgcaagagggtgtcgcgctgaaccgctcgcaccgcgacgaggctccctgcgtcgtcgaacgagaagtcctcgaccccgaaaccgtcgtgctcgatgaggtgtttggcgagctggatccgacgccaacgggtaatcgaggtcttcggcacggcccccatccgggagtcgggctcgggattgaagcagaagagatacggaaggatctgtcggtcgaggagccggacgaagagctcgatcagatcacggtctcgttccccgaggcctaccaccgtgtgacagttcactttccatggaccgaagagctctcgggcatcgtcgacgacctgccaatacttggcccaggacagtccagcgcctccagcggggacatcggttcgcagcgagcggaagagttgttcggtcacggcgtcgaggccgatgccgatcatgtccacccccagcctgcgaaagcgctcgagcttgcgacggttcagtgtcggtggggcaacgaggatggagaggggggtgcggacgcgcgctcggatgcgctcggtgatctcgcacgtgtcctcgaaggcgtagggagaggtcaccatggagatgcacagacgggtcaggcgtcgctcgagcatcgccatgcgctccacaaggtcgtctgtgcgcacgaggggccactccactctgatgaacgacttgtcctcgtagtcgccggggcgggtccgcgcgaggccgcagtagccgcagtcgctccggcagccgtccccgtaattgagcaagaggttgatcccgccgaaggcgaagtctctgctgaagcgaccggagcggaacccgagtgcgatcgccgaggcggccgagatccgcacccactccgggctctcgtgctcacccagcgtccgtcgtcggcgcagggcgaggggcgtcgaggtggtcatgaatgtctcctttctgggagtaggcaggatccgagtcggtggggggcggcgagcgggctgaggctcgcgtggaaggcttccgtgatgcgtcgaggcggagcgaggtggccaagcacgtcgcacgctcgatccgcgaggtagctcgggtcggcgggctcgaaacgcagcgcccgggtgagcgtgatcagccgggcatcaacttcgagaaagtccccggagacctgcacggagctcaccactccaccccgaacgtcgaggtgcagttcgacggtcccgatggccgttcgcagggtcacccgagtcgcgctcggctcgtgagccgagctaccgtggatccagtcccgatcggcgtaggtcgagatctcgaggtcacgtgccagcatgagctcctcggcgcgcggcgcgctctggacccatcgtgaccgaccaaggcccatcgcgaccgcgtcggccaccacggtgacgaggtccgcgccgcaccaggcctccccacggagctcgctgacggtgacgacggagcgtgcgagtagcttggcgcgcttgtcggcaagcttggcggcgggtgggcgtaggacctcgaggaggaggcgatggtcgaggtcggcgaggatcgaagcgtggcagagggtgcccccacgcgcaggtcgatacatccccagaccggcgatcttgcgcccatccacgagcaggtcgttcttgccctcgagggtcgcccgcaggccgatggtttcgagtgcgccgatgaggagccgggcgaacgccgtcagaacttcccgaggggtcgcacgccgctcgggcagggccaatgccacgccaagctgggcatctcccatgaggatggtgccaccgccagtaggtctgcgcccaaggtcgagccccaggcgctcgacggtgacgaggtcgacctcggccgcagcgcgctggtggcgaccgacgaggaccgtatggttacggtacgtgtagcagcgcaggaccggctcgtcgacggcgcactggacgagcgcatcgtcgagggcgagaccctcggcggcaccgacgccgtggtcgaggatgacgcgaagcgagctcacgacacgcgcaccgtggtgaggtcgtcgtcgacgcctgcccagctcatcgagcaacaccactcgtggagcaccggggtgagcccctgctcgcgggcgtaggcgatggtgccctcggcagggtacgcgatgcctgcgaagccgaggtcgacggccgctcggtcgagggcgaccttcgtggtgcccatgggtcgggcgcaccccaggttcgtgcgcagcgagggcaccagcgttcgtgcagcccggaagacctcgaccgtcgcctcgagggatggcggcgggaggtgtcccatcggcgttcccacgagcggtgtgagcaccacaaggatgagggtgtctacccggtgcctcgcgatgagctcaagggcgcgatactccccgaggatgcgaccgtagtgcaggccgatgaccacatgcgggatcactcggaggccggtgtcgtccaagagaccgagggctcgatcgaagtcgtcgacgctcagatcgaggtgatagacctcacgtatggtggcgtcggcgccgatgatgtcgagcatgacggcatccacccccgcgtcggcgagttgggcagcgaggggaggcgtgacgactccggtgtgcaccacgacccgcatgtcgagctcgtctcggatgcgtggcacccaggggaggtgacgcgcgagcggcacgaagccccgcttggtggagccacccgatacgaggatgccctgagatcccgcggccttgagcctacgtgccacatcgaagaggttcgagcccagaccgaccgacaccatcccgtcgaggaccttggacccgcagtgatcacaattgagcgcgcacgccgagccggtcacggacaccggcaggaaccgtctcgggttcgtcgggcgccactccttcgtgctccaatgcttgaggccaggagcgtagaactcgatggtgcgcggttccgacgctgcgtcgtctactgtgcccacggcaggatccactaccacgccagcaccccggccgcacgaaacgcctcgacgcgcttggtgaagtcctcaagcgcctcgtcgggggtgacgaggtgatcgagcgcgcccggctcggttgccatctcgacgagccacgcctcgtagcatcccgcgtagagctgcgtgacgtcgcgaacgaggtggtcattcgtcctcaagatcgttccggcgagaggtgccgcgagtgccccgacgtacttctcggcctcgagtgagccgatggggtcaccctccaccacccggcacgggggctcgaccagtgtcagctgcgccagggtgccgttcacctcgagtcccagcgcgtcgagaccgacgcgcacgatatcgtcgccgaccggcaacgcccagaggttcgtatcgtggtggtagaagcggtcgctacgaacctcaaagccgcggtaaacgtgtgacgtcatcaactcctcctcttcggtatgtccgatcgtcctcgtctccgaggctggcgccgacggaggcgaggagcatggcgagagaacggtcgcgctcgatccttcgccgcaggagcgctggatcggtcacggccgagccctcctcgtggcgcaggcgcgtgaggcgtccttcctccaccaggagcacgcaacgccgaccctcgtgttccaggtcgtggagccacacccccgctcgaatcttgacgctacgtcgtgccgagttgggggctccacggacccagccatcattgtcctcgtcgacgagcgatcgatagcgagcgatgaggtcttggtcgagttcgaggatcccgggccgggggtcaccgaggatctcggccagttcttgcaccagactggcaacgaaatcttcggggtcgaccacgagcgcccgagatggaccgacgtgacggcgcatcgccgcgacggcctcctcacgtgcaatcctcgacagggagaggatgccggcggctgcctctggatcgaaggcttcgagcaggtttccgacgacgaccagactcgcggcgatctcaccggacccatgaccacagaccttgcgaccctgacagctgatctctccgtggccatcgagcacggtctccagcccgagacgcctccaacttcgggcgactcgctcgaggatccacgcagcgaacttcgggcctcgaacggccgctacgacgtggtctcggggcaggatgacctggaaaaagcgttggcgctggtcgagccagaccgggcccccaccaacccggcggcgtacgacggggaccctgcgcgcctggatctcgccccagtcgagctcctctctatgccggtggtagccgagggagacgtacgcggagcgcggtcgtgcgacgagcagcgtcggccgttcacagcgatgggcgaaggcgtgccagatggcatgggagtccactggttcgaggtcgccgagatcgaggacgtcgaggcagcttcgacgcacgaacgctcgggtccgactcccgtcagcgacgggtctacgaaccccgtccgacacgttccccccttcggacgcgacgtcaccacccctcggtgacgaccatgtgagtcatcaagtgcgcatatgcgcatgcgactcccgtagcgtacttgaggcgccacagcgggtgcaaggattttcacgaatcaaggggggtgtaccggtgccaaatcgagccgttgaggatcgttgggcggtcgtgacgggtgcctcgtccgtcatcggattagaggtcgcacggtcattgagcgagatcgggtactcgctcatcctccagggtgcgcgccacgccaacgcgctcgagctccttgcagacgagctggggtcgcgcgggcgtaggcccgtcgtggtacgcgcgaacctcgccagcgagcggggcgtcgaccacctcatggccaccatccgagagcgcacctcgcacctcgacgcgctgtgctggctcgctgcggctggggtcatgcgaccggtgagcgcactcagtctgcaccacctggagtggacgttccgcgtgacggcggggtcgttcgcggtcgtaactgcgggcttgcggccgcgagtgagcatcgccgtctcgtcgctcggctcccagcgcatcgcccccgagtacgccgccatcggcgccgcgaagtcggccctggaaacgctagtcaggtatctcgccgtagaactcgcgccagcctccagtgtcttcgggctgagggttggcctcatcgacacgccggccgcacgacgtctcagccgctacgaggagctcgaggcgctcctgcgaaggcgcgcgcccatggggaggctcgtgacaccagaggacgttgcggctgcggtcgtgaccatggtcacggagatgtcgagcatggcaagcgggtcgttcctcaccgttgacggcggagtcgggcttgtgctgtaagctcgtccgcgtcgtggcctgacgaccacccggatatgactgcgccctgccactgagagtgctccgagcgacaggcccgcgacctaggtcgagaacgccgaaccgatggggttcggatgcgccggggcggtatcgcgctggcgtcagctcgttcattggtgaaccgcgctctgcgtcccggcgcgagccaacggagcccgcttgactcgtgtgtcggatccacccaccgtgaccgcgcgtaggggcgaacacaaagtcatcctgttcgcggcgacggcgcccggccaaccagtgggggccacgctgtggcccatggcagtccgcccaggcgtcgccacgctcggtcgccgtcgcgcactgttatagtccgaacctcgcgggcagccacgatgaaggtgcacactcgagcgctggcgccgagaagcggtattctgtcaagttctggcgaggactgagatgcccgacactccgtcgagggtactgctacgattccccgcgtgcggaggctgcgaacgtcggttgggatcgtgcttcgagggttgcgatggcgcctcgcaacgaccgtgatgctggtggtcacgggaaccttggcggtcgcgacggtgatactcgcaccgctctacataccttcggccaaggatgcgctcgtcgtcagcgtcgtgcgtgcgacctcgctccagcaagatggtctgcagctcaatggcttcggcctcagcgacgattcgcgggctgcgctcgaacgcctgttcgcccgggccccacggctcgaccatcgaccgctgttcggttcgccgcttgcgacggcgttcatgaccgtatcgctgccctcactcaagatcccgtcacgaacgccagggggtgtggcgcagtccgtggtgcagaccacggcgctactcgagaggaccgcaatctgctcgcacctgaggttcgtcgcgggtacctgtccgcgacgcggatctcagggcgtcgcggtctcgacgagggacgcggctgcactgcatctgcacgtcggatccaacgtcaccttcgctgctggtgccatcgcgcccggaacccccggagccctgccatcggtgaaggctccggtcgtgggcatctatgacccgccgaccaccctcagcgcctactggtggggcacgcagtatttcgatttcagctccacgccgaccggcaacgtctatgacccctttgtcgtcgcccctggttacttcgacgggattgcgattcccggtccaccggtcgtcctccgcggtcacggcacggcaacgagtccggcattcgtcgtcggctcgcagtatcgctacctggtcgcactctcgtcgagcgggtcgcccggaggggtcttcttcgcagcgaactcgttgctgggccgcaccttgcaggccccgctcgcagcaccgcagcgcatcacgaacacgaccgctccgggtctcttgcggtcgatatcgggctacctcgactcggtgaacaagcatgcagcgctgaacgtcgtgggttcccaaggcttcgggccattgcccgtcgccgcgtcgtcgctgccgggaaccctcaccaaggcgctcgctcaccagcacagcttctcgacgatctccatcgtcgtcgtggtcgagatgctggcgatcggcgaactggtgctcagcgctgtgatcgcacggtcgatcttggcgcgcgatcccgagctgcgtctcgcacagttgcggggcctcggaacgaggcgtatcgttcagagggcgatcgcagagccactcgtcgccatcgtcctcacgattccgctcggcacggcggttggggtcggcgtcatgcatctcgtcgcgagtcgcgtcttgcccagcggcgtcaccgtcactcttacgacgacagccgtgttgacggcggtcggcacggccgtcgtcggcctgctcaccacggcggtcatcatcatgattgcggttcgacgcggcgtcgtcgaggctccgcgtgccacacagcggcgccgcgtcgtgttccgagtggcgctcgacgtggcactgctcgcgatcgccgcgacgggaaccttcgaactcgtcacggcgatctccgcctccagcggcattgcacctctcgcggccggcgcccccgcgctcttggcgctcggactctctgtcatcgctgcatggctcctcaccatcacagctcggctggtcgctcgtctcacgcgctccctgaaacgcccctcggtctacgtcgccacgcgtcagttacgccagcgcgccagtgcgctgcaccgtgccctggtcgttgggcttgccatcggactcgtcacgttcggcatcggcctcgacgacgtgggaaactcgctggcgcgaaccggtgctgcggtcacgaacggcgctaccgaggtggccgaggtgaccctgccaccatccttgacgatcgccgaagccgtcgatcgcgccgatccttcgggccacgaggcgatggcggcgcagcgagtgtcaactcctgccggtacgacactggcgatccaagcgcggcgtgcgccggggatcttgacgtggtccccgacgctgggcctgcacccggcgctcgcgcaggtggtccagggacttgacccacggtccgctggcggctttcctgtccgcggtcgtcgcgtcgctgtgacggtggagatctccctcacgaaggcccaggcagcacagctggagcgatcctcagcaggcaccgtcacgcccgcaacgctcggcgtatccactgtcaccatggagatcaccacaccgacccccgcgggtctcatcgagtccgtcggtgtgctgtcgggggccgggaaggcggtgacggtgagcgcgaatgtcccgaccgcgtgccgcagcggaggttgtgacctcgtgggtatcagcttctccttggcccagacgttcaccaacttcgagatctccatccttggagtgagcgggattgcgccgtcgcctggcggtccggtactcgcagcgagttcctggcgcgcgagtggggcactccatcgcgcatcacgacctgcgagctggaccgttgccccgtcccaaggtgccctcgacctggtaccacgctcgctaccgccgaccatcccggccatcacgaccgacctaccaccgggacaagccacggctcagatcgtgggcctcgacagctcgaccatcaccgcgacgcccatcgcccaggagcatgccctgccggtcctcggcgcgagcggcgccatcgtcgacctgcggctcgccgagcagtacctccaggcaaccgaccatgcgcaatcgctcgtcttcctcggcccgcgggacccatccgcggtcctccgctcactcgcggccgaaggggcccacgtcgggccaatcacgacggtcgcccagatcgtcaccgccgcacgcaccagtccgacggcgctcgcccaagacctcgtcctcccggcgggcatcgcggcggcggtcctggtcgcagccggcctgctcttcgagaccgtgaccgacgggcgcgcccgaatcgccgagctcgcggcgcttcgggtactcggcatgcgccggagccagctcgtcaccgcgctcgtgctcgagggcatcgctgtcgttgtgctcggtgccgtggtcggcgtcgtcgcaggtgtcgtcggcgcgcacttcgtcttgccacatgtgctaccgccgccaaccacgctcgccgcatccttcgtcattccctactctcttccaacggccccccttgcacgagctgcgctgctcgtcgtgatcctggggggagcagccgtgctcgcaagcgccgtgcgcgtggtcgcccgggcctcgttcgaacagctgcgagctggtgagcgatgactgatcagcttggcggactccccctccggctcgagggcgtggtgcacctctaccccatccccggaggagacgtcgttgcactgcgcggcgtcgacctacgcatccaagcgggcgagatcgtcggactgctcggaccatctggcatgggcaagtcgacgctgcttcgcctccttgcggccctctaccctccttctgccggtcgcatctggattggtgataccgacatcgcccaactcggaccccgagggcgtcgcaagctgcgcggccggaccgtgtccctcgtcctgcagggtccggcggtcaacctcttgccctatgcgaccgttgagcagaacctcgctttcgcggcacgcgatcgcgcctctcgacaccgcgtcggtggcctgttggaactcttcgggcttggacccctccgtcatcgcgtcgtggccacgctctcaggaggccagcagcaacgtgccgccatcgcgacggcgctcgtgcccgggccgcgtgtgctgcttgccgacgagccaaccagccagctcgatcacgaggcgcgcgacgacgtcgtgcgagccctgttcgatgtgcaacgcaacctcggggcgacggtggtgatggtgacgcacgacccggtcgtcgcgagagagctgccgaggctgctcacgatacgcgatggccgtgtcggcgcagagggtcgctcaggcgaggagttcgctgtcctcggcgaggacggtacgatccagcttccccctcacgttcgcgcgatgattccgcctcactcgctcctgcgcgtccgcgtgatcgacgagggattcttgctcgagccggctgaccatgtgtccgaccaaggagatggcctgtgagcgagcccttcgagctcgtcctcgagccgatcgtggtgcgacgggggcgaggatccatcctcgagcttcccgaacttgcgctcgcatccggtgagctcacggcgatcatcggaccgtcggggtctgggaagaccacgctcctccacgtcctcgcacgcattctcgaacccgacgaggggcgcgtcctctggcgcgatgcacacggcgatcaccgactgcgccgccgccagagcgtcctcgtaccgcaagcattcggactggttgctgcgctcaccgtcgcagagaacatcgcgctggcgctcaagctccgcggtgaacgcgcctcggatcgttccccgctggtacgagacgcgctcgcctcggtcgggctcgacgggctggcgaaccgactggtcggtgagttgtcgggcggccagcagcagcgtgttgcggtcgcccgagcattggccgtcgacagccctatcctgatcgccgacgagccgaccagcgagctcgaccccgacaaccgtgcgctcgtgctcgatctccttctcgagcgagcgcgcagcggtccactcgtcgtcctggcttcccatgatccgctcgtcgccgagcgtgcccaccgaacactggaactcgccgagggtcgactcgtcgacgatcgctggacccccgagagccaacgcaacggaagccctgagcagccgtgatgtgtcaggccgctggcgtcgccggctcgacttcgggatcggctgctcggcggccccgcccacgcgacagtgacaacaacgcggcaatggcgatgaacaccatcgaggtgtagaaggcggcgtgcagaccgtgcgtgaagacgtctgccaagtgtccgctgagcttggtggtgccgacgaagatcgcgaatgcgagccctcgcgggatggaacgtgccgcagaaaggatggcgacggagaaggagaagaccatcccgatgttcgagaacgtccggagcatgcccgaggcgatgccgaacacttcggggggagcagctttcatgacggccgagttgttcgcggggaagaagctcgagccgccgatgccgttgatgatgctcgcgacgacgacgagcgccagcgtgacatcgttgctgagctgtgcgtagacgaacagcgcgatcacctgcacggcgaggccgacggtcgcagggatgactgggccgacacggtccgcgagtcgccccgcaaacggaccgacgacaccgcccaggagatagcccggtacgagcagcaaggaagcgtcgagagcgctcaggccccgcggtccttgcaggtacatgatcacgaggaagagaactgcgtagttcccgagggcctgaaacgtcgctgccaggagcgacggtgtcatcgtcgggatgcgaaagatgcgcaggttcaccatcggctcgggatggcgtagctcgatcaggacgaagacgccgaggatgacgagtccgccgacgaagaacgcgacgatgtgggagtcgagcggccgcgtcgcgagttgcgtcactgcccagagcagcccgaagatcccggcgccgagcgtgagcatgcccccgatgtcgaaacggtggtgccgtgaggtcgcttcgttgtggagcacacgcgtcgcgagggccacggcgacgatgccgatcgggacgttgatccagaagatccaccgccacgagacataggtgacgatgaccccgcccaacacgatcccgaggaccgcacccaggctccaccccactgcgttgaagccataggcccgaccccggcgatgaggcgggaagatgtcagcgatgacggcaccggagttggccgacacgagtgcgcccccgacaccctggagcactcggaatccgatgatcgctgcttcgttccaagacagcgcgcacaaggcggaaccgacgacgaagaccacgaaccctgcttcgtacatgcgcacacgtccgaagaggtcgccgagcttaccgacctgggtggcgagcagcgtgatcgtcaagaggtacccgatcacgacccaaatcaccgaactcagggccacgtgcagcgcacgctggatctccggcaaggcgagcaccacgatggtggtgtccaccgcagcgatgagcacgccggccatgatgaccgccaaggcgagctgcgggtgatcggtcacggacgagtggtaggacgcatcatcagtgcgagtagccatggctctccccggtcgaaggctcgtcgaagcttgctagttccaaccttatcgacgagtcgggtgttcccgtctcagaatctgcgatgcgtcgaggacgggggcgagcggtaggcttcgtagctgctgtggcgggtagttcaattggcagaacgcctgactttggatcaggaggctccaggttcgagccctggcccgccagccatcgccgttcctctcgacgcgctctgcgtggagctgtccggccttcgaacggcctttgggtcgccgacgttccccacgtgagactgagcgcctcgggccgaccgctgtggtagcaaggcgcacccgacgaatcatgagcatggctcgatcacccgctgccgcgacggcgaccgaacccgactccgccggcacgaacgcatcgggaacgtgagcagccgaatccatgtgaccacgcgccgccagaaccccgacgttgccatcgttgccgcttgacccagcgcttgcaggagtcgaccgttcttcctcgcattcgccaggtcgtgcagagcgtcccttcggctggaagatcatcgggaatcgccaacggcctgcgcaccgctgatcccgccacgaacacccgagccgtgcgtcaaccgagccgaggggccacggcatggtccatgtgtgaagccggggcgctccgtgtcgccagtcgtgacgaacgtgtgccgatcgctgctctcggccactcgcgagccgcggaacgcgacgcggcgaagcgcacgcgctgggttggagcaacgtcgaccgcaacgctcgcacagtggccgtcacaagggccgcctcacgaagatgcgcgtcgagcctcgcgacgccgtcaccgaggtccaagcgaggacagctcgcagcatgcctcgcgtgctcgcatccaaaccgctcgtctggttcctcgaggagcaccgggcacaccagcgccgggagatcgaacgccctcgccccctcagcggtcgagctggggcctgctcccggttcccctctgccttcggtcggccccttgcgcttggtgcgccgaaccagcacttcggatgcctgtctgtgacttctctggccatcatctcctcgagccaaggagccttacggcctcgcctcctcgtctcgcgcgtgtcgttcgcgcctctctgcggccgtcctccgctcgaaggcatcggcctcgggcagggcaagagcagttcgggtgatcaccgacactgcgtccgcagccccgaccacccagcgggacctaggctcgaccatcgtggtcgctggcgcacgtcatccggttcgttggttcctcgccgaacgcggcttgctggcggctgcggtgggcatgcttccggtcggcctgtccttctcgctcctcgacatctacgctcgcgcgagcgcgctcgggatcgtgctcgcactacagggcgtcggcctcgtcgtcagcttgatcgtcctcggtggcgtcggcgacctcatcgcacctcgtcgcctcctcgtcctcgccgatgcgctctacgcagcctcggctgcggcgttggccctgctcgcgcagacccacagccacgcactcgtcgcctatggggccgcctccatcgtcaccggtgcctccgcgggtctcgtcaactcggctctgcaggctctcctggctgcggtggtgtcgccacaggatcgacagcgcgtgaacggtctacggagtctgttgcgcaatctcgtccaggtcgcagctcctgcgttcgcaggactcgtgagcgcgatcgcatccccaaccgtcgtgctctggctcgccgcgatcgtcgccgccctcggcacgctcgctgctcgcgcgctccccgatacaggcgcgggagcacaccacgacgctggcctgctcgccgaactgcgcagcggttggcgagcgtactgggcctacgggtggctcgtcgctgtcgacggcgccttcgcactgtggcacctcgtcgtctacggaccgctcttcgtgctcggccctgtcgtcgcgcgtgcccatgatcacggtgcgctgggctggggcctcatgctggccggcgtcagcgttggtggcgtcctggggggcgcgctcgtcgtgcgcctgaggcctcgtcgcccactctccttcgccctcatcgcattctcggttacgtcggtgtggctcggtgcgctctggttcgaggcgcccctacccgtcctcgtcgtcgccgccgcgatcgccggggtcggcttcgagcttctcatggggctgtgggacaccgtcttccagggcacgatcccccggagtgtgctcggcaagctcgcagcctacgactacctcgcctccgtcggaaccctgccgctcggctacgccttggcagcgccgctggccgcgatcgtgggcgcacgcggtgtcttcggacttggtgtcgtgatcacggtcgcgatcacgctgggcaccctcgctgtgccgagcgttcgtcatctcccctcgccggcacttcccatcgacgagtgagcgccgacgactcctcggccgcgggttgagtccccgcgccgcatcgtcgcgggctccgctggcagctaccgtacaacgcacctgatccaaggagtgtcccatgaccgatagcgtcagccaactcgccgatgaccagcccacgacacgcctccagcgtgtgctgaatctcgtcccgcgagcgctgtcatcgagaccccacatcatcttcctcgcggtgctcggtgtctacctcgtgctcctccccctcgcccacgtgcacgtgtcggcgttcgcggaactcgtcggcgggaactacacgaacgttacgagcgatctcggggcctgcatcgccgccggcggtacgatccacatcatgcgctcgcaccggcagcaccgcagcgagctcgccgagctacgccgactggtcgaggacctgtcgcgcacgctcgggtcggggtccgagtaaatccgtcgccgctcgcaccacgatccgtcgacgctcgcggccggctgcgcggtgcctcgagacggcacgtcacaccagctcggacggccatccgtcctatcctggaggcgtggcacgcgcacagcccccgggcgcagctgagccacgtcgaccccgccgacgtggttggcaccgtcgcacctttgaaccggagcgcggatggggatcgctgggcgacgagggacgcgccgtcctgcgtgcggcgcagcggcgcatcgcacgcctcgtgtcctcggactcgctggccgagctgccaccagagcccgaggaggaggtggcctatcgcctcctcaccgccgcccttcgggcaggcgccgtcctcctcgcggctggggccgccacgctcgatgtcgagcagaccgtcctcacctttgccaacgccctcggcctcgcagggtgcgaggtcgacgtcacgttcacgtcactcaccggctcgtaccgtcgtggtgcaaccttgaagcccatcaccacgctcgtcgtggtgcgcgatcggacgctcaacttcgccaagttggccgcgatgacccagctgcgtgcggccgtcctcgcgggcgaggttcccccggtcgatgtcgagcagcgactcgaggcgatcgagcggctcaccgtgcgccgcggtcgcttcgtcgtggccggctgggcgggcatggcggctgcgttcacgatcctgctcggcggacagctcctcgccggtgcgcttggcttcgtggcgaccgccttgatctacgtcctcaaccgcggtctcgcccggcgcggcgtcccagacttcttcttgagcgccatcggggcgacgctcgcgaccaccacggctctgctcgcgatcgtggcgcacgcgccgaccgtgcctgccctcgtcgtcgctggcggcatcatggccctcgtgcccggcgtgaagctcgtctcgagcgtccaggacgccctaagcggtttcccgttgtcagggaccgcccgtggcgtcgaggtcctcgtcatcgccaccggcatcgtgaccggcgtcagcctcgtgatctacgtggcacgactcgcgggtctgcacctcgccatcggccccatcccgctcgcctccttgctctatgtgccggtccagatcgcggccgcggcggtcgcggcagccctctatggcatcgcgacatcggtgccgcgttcgttcctcccttgggcggcagtcaccggagcgctcggatgggggattgtcctcgtgctcgaacacaacggcgtctcgctcgtcgtgtcgacggcgctggccgcggtctgtgtcggcctcctcggccaggcgctcgcctccatccacaccacccatccctacctcttcgtcgtccccggcatcatgccgctcgtgcccgggctcaccgtcttcgagggcatgctcgcactcgtcgaggggcacggcggtgccgcgggtctgctcctgcagggcctcgccatcggcctcgcgatcgcggcgggggtcagtctcggttacctcatcttgcgctcgcctgtgagccgaccgactcggcttcgctaggcggtcgcgacctgtcggccgccgcggtgcacctccccggtgcggcctcgcgaacgtgggcggtctcgtgtcgtggtgccacgcccgccgtcatcatgcaggcgctgcatgacgagcccagcagaccggctagggttgaccggctcagctaccttgcgtcgttcctttggagctccgatgtctccgcgtcccgtccgtcgtcgtcacctcgctggggtcgtcctcgcaggcattcccttcaacgtggctcagggggccgcgttcccctactgggtgctgtatctccacagcgacctgcacttccccaccgccttggcgggtctcgtgatcggcaccgagggtctcgcctcgctcggaggcgcgctggtcggcggggccttccaggatcacttcgggcctcgacgaacggcgcaactgggcgcagtgatcgaagccgtggccgcagcgtcgcttgtcgttgctcgtagcccgcttgcggtcgcgggctgcttcgtcctcttcggtatgtcgaccttgcgctatccggcccgatcgagcgcgctcctcgccgcactgccggacgatctctcggcgaccaccttctttagctgggacttcatgggcgcgaacaccggcttcgggctcgggatcgtggtcggggcgctgctcatcggtgccggtgacgcgacggtgatgcggggcttgttcgccgccctcgcggtgacgagtgccctcctcgccgtgacctacgagctcatcccgaaccagagaatggctcgcgaacacctcgagcacgcgtcgtatcgcgcagccatgcgttcgtcgctgttctggtacgtcggcgcgtggggcctgctgctctcgctcgcgagctactcgtcgttcgacgctggcgtgccggccctgatcggcatcgagctccacgcgtcgccgcacctgatcgcgctcggctttctcacgaatcccgtgctcatcgtcgcgttccagcaacccgtgagacgcctggtccaccgactccggtggcgccgcgcaaccatggcgaccgcagcgatcttcggcgcgtcgtggttcatcttgttcggggccctgtggctgcggaccgagttcgagctcgccgtcctcgtcgtcagcttcgccgcgaccttctcgctcgccgagatgctgatggctccccttcgaacccagctcatcgccgcgctcgcacctgagcatctccgcggtcgcttctacgggatgagccacttcgcccgcggtgtcgccggtctcgtcgggccgagcgtcgcaggggccatgatcggtgcaggcctcggcttctggtggctgccgctcgtcgcgagctcgggtgccggtgccgcctgggtcagccgaaagatctttcggacagctcccgccgagctgtccgagcgcacctgacgcaaccggttcgacggctcagacggcgctcgcgtcgactcctgccccaaaggccggacagtgcggcgccagcggacaggagcgacactggtagccgggtacggcatcggcccagagaccgtcggggacggaatcacgacgcagtgtctcgcgaagctcgcggagacggcgagcccgtcggacgacggtcccgatcgcgcccacgccctcgtcgagcagcgcctcatcgacgaggcgacgccgagagcgaccggcttcgatgtcgacgaggcccacccagtcgagatcgacaccaccgatcgtcgcgaccaccgcctcgaacgcgagcgcggtgtcttcgtagccgtagggtcgatgatcgaggacgaagacgcccgcccgctcgcccttcgcatcgaggagctggaggtcgatgaggctccgcagctggacggcgccgaagcgcacggtgcgccgacgcggctcgagcgcaccggcgtgctcggcctcgagcacgccgatcgtctccgctgcgaaggtgatcacttcctgctgaacgaggagtcgctccccgcgtgtgatcgccttcgtcgcatggccgctcacccagtcccaggcccagtggtcgcggatcgaggagcggagcgcgcgatagagcgcgtgcggggtcggtgcctgctcacgctcgtcgtaccagcgcacgacgagctccatcgcgagggtacggcgcacgaccgcgacggacggctcgaacggggcatcgatcaccgaggagccgaggtcgcacgcttcgcggaggtctcggctcgtgaggcggaccggcgcgccgccgccacgcagctcacggacgatcgcctcgacacgtcgcccgaggtctgctcgctcccctcgtgtgcggctcacggcgccgccgcctctgcgtaggtggcacagtcctcgcggaacggacactgggtacagcgcggacctgcgcgctcgatcggcgcaccagcgaggccacgcgcggcggcccgaagcgcatcggcgaccaggcgtgcgccatcgcgcacgacgcgctcgctcatcacgagctgtcgcgcatcggcgaccgcttcgccagggccgaggaggatgatgctcgctggaggtggcccgtagcgcaggccagccagcagcgcgtagaagcggagctcgctctcgtgctcctcgctgagggcgagcgacgacttgatctcgacgaggtggtggggtctcccgctcgcggccccacccaccacgagatcgaagcgcccggtgagcagcacgtggtcggtgaggtccgcccgtgcgcgcacctcggttcgtggccaccacgcctcctcgatgccaagacgctcgacgagtcgcgcgcgccgggtgacgacgtctgccatctgctccgcatcgagctcgaccgtcccaccgtcggcagtgacggcttcgagccacagcgcgacgtcgtcgccggcatggtactcggcgccgtaggcgaaccacgagcgcaccccggcctcgaagaccgtgccgaggtccatggcgcggttgcgcggcgtggcgatctcacggcgcagctcggccgtcccgtagcgctcacaggccacgagtgaggccacgatgcgcttggtcaagcgccaggtctgctcggtggggagttggctggccagctcggcgagctcgtgacggacctcggcgatgacgtcacccgcgaccgggtcgcctgggcgccagagcgcctcgacgagcgctgcctcgctctcgagccagacgatgtccgtggcgctcacgaggccgactccgaactctccagcgaagccggcacgtcgaggggtttgagacgacccgcaagcaacgcgtcgcagaccgcgagcgtgccctcgacgaacgagcgaccgagcgctccggcgacctccgagtcgacacgcgaggcactccagccggtgagcgccagccgacgggcgaccacgagcggccacacacgtgccaaccaccgctcctcgatcctcgcccgacgaccgtagcccctgatccacgccgcagcacgctcctcgcagtgcggggcgtcctcgaggaagctcagcgctccggccagatctgccatcgggtgtgcgaagccagcgtcgtcgaagtcgatcggcaccaacgccgagctctgggtgcgcacgacgttggcggcgcgcagatccgagtggatgaggagcatctcgtccaccgcatcgagcatgctggcgacacgttcggcggctcggtccatgagacgccgctcggacgagctcgcgcaggcaagctggtagctcccccagtgggcatgcggccccaccagcgcgccagcatcccagcgccaccgacgaaaccacggtggcgggcgccaccgacgcgcgtggttctggagttgggcagcaacctcaccaaggcgctcgaaacttgccggatcgtcgctgtcgcctgctcccacttcgcccgccgtccagctcaccacgaccaccggtccgtctctggtgtcgacgagacccggggggccatggagctgggcgatgggccgcggggcggcgacacctgccgcatccagcgctgcgagccaggcgagttcgctcgccagttcggtgaccgtgcgatagccaggacgcgggacccggagcgcggccaccggaacaccgtcgcaagaggcctggaacaccacgttctcggagacggcgacgggcgtcaccgtcgccccgtcgagcagcggcaccacgcggcacgcggcttcggcagcctgaacggcccgctccaggagatcggccatgaccgaacgctacccgctcgctgagcgccctacactgcatcgtgccgatgcaggtcctccgtccgcagctcgccgtgctcgtggccgccgtcgccagcctcgctgcctgcggtagcgccgtcccctcgccgaaggctcaccgcctcctcccggcgacccatccgctcgcacctcggccggtcctcgtcgctccctctgccgtctcgaccgaccccggaccaggtgccctcccacagacacccgcgcttccgtctgcgacgacccagagcttcaagaccagtgtcgctgacctgtgggctgcgatcgtcaccgataatccggccctcgccatgcccgccttctttccgctcccggcctacctgcaggtcaagtcgctcaccgacgacgcgcacgactgggcggttcgcctcgtcgcgcacttcgtgctcgacatcgaggcagcgcacgcggtcgtgacgtctcatggcggcaccccgacgctggtgggcctcgaggtgcccacgacgaacgcgaactgggtgccgccgggcacctgctacaaccgactcggctactggcacgtacccggctcccgcctcgtctaccaggtcggcacgacgacctactcgatcggtgtgctctcgctgatctcctggcgcggcacgtggtacgtggtgcacctcggcgcgatcaaccgcccgagcgacgaaggtgccgtcgacgcgcccgccgtcggggtcggttccttcgggcccccgggcggttgctgagcggcggtcgagtaccgttccaagggctcggcaccggctccggtgccgaggcacccacgatcgacgggaggggaacgagcatgctcatggtggcgagtgcgaatggccgggccggcatcgatgccgtatttcctcggctcctcgaaggagcgctgaccccgttggacgccgtcgaagaggcggcctgggtcaccgaggacgatccggccgatcactcagtcggtaccgggggcctccccaacatcttcggtgccgtcgagctcgatgcgtccatcatggacgggaccaccctcaaggccggtgcggtcgcggcgttgcgaggctttcgtcaccccatcagcgtggcccgagccgtgatggaacgatccccccatgtcctgctcgttggtgagggtgccgcagcgttcgcacgcgcggtcggagccgaggccgccgtgctcgagaccgctgaggcgctcgcttcttggagaacggcgatcgcctccctgcacgccgaggagctcgcctcgacgctcgcgatggcacgagcactcacccgcgatcccgagcgggccgtcggtacggtcaactacctggcactcgacgaccgaggccgcatggccagtgccgtgtcgacgagcggatgggccttcaagtggccagggcgagccggtgacagccccgtcatcggcgccggcaactactgcgatgcccgtgtcggcgcggcggcatgcacaggctttggcgagctctcgctccggactcagctcgccagccgctgcgttggcttcctcgaggccggggccacctgcgaggaggctgctgtgcgtgcgatcgagctggtgaaccgcctgcaggtcgatcccgccgagcgcatcatgcacatcgtggtcctcgatcgagatgggaaccacgcggcggcgtcgacgcgagcgggaacgacgtatgcctggcgtgatgggtcacaaccacactgccagctctccccgagaacgcacgtcccccccgagggctcatccgtcgtaggctaagcagcacacgatccgacgggaggtagtcgtggctcctgaggaacgcaggacactgccgggctccgccatgcctcgtccggcgggcgcccaggtgctcggccagatccccgacgacgaacgtgtcgaggtgaccgtcgtactccaaccgcgcgcccccctccctgagccagggccgacccccatgtcgcgagcggagcttgccgatctgcgcagtccacccgagggagcgctcgaagcgatcgctcgctacgtcgccggtcagggcctcgaggtcatcgcagccgacgcacctcgacgccgcatcgtgctcgcgggaagcgcagcacggatcgcggctctctttggtatcagcttcgtgcgactccagctcgagggccgacggtatcggacctacgaaggggagatctcgcttccggccgagctcgcccccctcgtggtcgcggtcctcggtctcgacacccgccccttcgcgcgctcccatcggcgtccggcggtggcgccgaacgcacccacgaccgctccgaccgtcgcgcgcgcctacgacttcccgaccgcctacgacgggcgcggtacgacgatcgggttcatcgagctcggaggcggcttccaagagagcgacctcgtgcgctactgcgaggggctcggcctctcgacgccccaggtcagcgtcgtcggcgtcgacggcgcccgcaacgccccgaccggcgaccccaacgggcccgacgcggaggtgatgctcgatctcgaggtcgccaccggggtggccaacggcgccgacctcgtgctctacatggcggcgaacaccgacgcggcgttctacagcgcgatcgccaccgcgcttcgcgacgccacacacgctcccgtcgcgatctcgatctcctggggcgcaccggaggagtcctacccagccaccacgatcgcggccttcgagagcgtgctcgaggaggcggtccatgtcggcgtgacggtcctcgtcgcggccggcgaccaaggctccacggacggcgtcgacgacggacgcgcacacgtggactaccccgcggcgagcccctacgtgctcgcgtgcggtggtacgcgcctcgacctcgacggcaccacgatcgtcgccgagacggtctggaacgacctgccgaacggcggcgcgaccggcggagggatctctgcgctcttcccggtcccgtcgtggcaagcaggcatcgcaatgccaccgagcgccaatcccggtgccggaccaggacgcggcgtccccgacgtcgcgggcaacgccgatcccgacacgggctatcggatcgttgtcgatggggtcgcaaccgtcgtcgggggcacgagtgccgtcgcaccactctgggctggcctcgtggcacgctgtcaccaagccggcgctcgtggcggcttctggaacccgctcctctacgcagcccggggatcgtcggcgttccacgagatcaccgtggggtcgaacggagcctacgacgcagggcccatctggaatgcgtgttgcggcctcggctcaccgaacggcaccgccatcctccaaacgctcagagcgtgaccccgacgaacgcaaccctctgggccacgtccgatccgacgcagcccagggcgtgccgtgtgagtgtcccgcgtcgaggcgtacccggctcacaccaccgcaagttgacgcgtgatcgcgacgtcacgctcgagcgtcgcgtgcacggggcaacggcgatcgacctcgttggcgagctgctcgtagcgttctggcgtgctcgggccacgaagctcgacgtgaacgaccacgtcgctcacacagggccgagccgcaccgtcgagcgtcgcgggatccagcgatccctcgacacggaccgtgaccgaatcgagtggaacgttctgcgcctcggccacgtgctggtaggtcaacacctggcacgaggcgagcgcgccaaggaggaactccaccggacttgccagcgtgccatcggatgcgacctcgaagcggcgaccccgtgcgagctcgatctcggcacggccggcggcgctcgtcgtcgccgtcgctccaaagcgcacgacgggtcgtggaccggacgatgacggatttgatgctgaacgtgtcatacgcatagcttactatcccgatcggctttatcaggtataggtcgactggttatcaccgcaccggttacggaggttgcatgcagcaggtcatcaccgggtggacgaccgacgacgagggcgactgggtcgcactcctcgcgtgtggccatcgacgccatgtacgccatcgccctccactcttcccagcgccctgggtcctcgacgagatcggacgctccgaccacgtcggtcagccgatcgactgtggccgctgccgccaagggatcttgccgccgctcaccgacgagacggcaaccctgacctggatcgacgctcgggcgaccgacgtcgagtgggtcatggggggacggacgaatcactgggagctcgtcgtcgtagccgaggggcgagtgcacctggagctcaccttcgctgacggcgacacgacgacgtggtggctcgagggcggcatgcagcgggccctcccggtcggctgcgcgtaccgcctccgaacggcgacccacgcgtcggtccttctcgcacgcttcgaccagtcctgactcgaccgacgaccgcagtgacgctcgagcccgcgagcgcaccgctccctcgccgagacgcccgctcaccccagcaccggcgacggacccaccacgatcaagccgagcccgatgagcgtcacgaagaccaccccgagcacccgctgtagcacgcgcatcgcaacctccgaatccgggccagacacagtcccaacgcctcgacacagccccaacgcacgacgagccgggatcccgaaggatcccggctcgtcacgaaagcccggtcggcggcgccctactctcccagggggtctccccccaagtaccatcggcgctggtgggcttaacggccgtgttcggaatgggaacgggtgtttccccaccgccatggccaccgcccggacgatctgcggcgtcgagcgctccagagcgagcacgaggagctccaagtcctcggccgattagtaccggtcggctgaacacgttgccgtgcgtacacctccggcctatcaacgtggtcgtctaccacgggccttaccaggttgaccctgtgggaaacctcatcttgagacgagcttcgcgcttatatgctttcagcgcttatcccttccgtaggtcgctaaccagccgtgcccttggcaggacaactggcacacgagcgctacgtccgtcccggtcctctcgtactagggacagcctctctcaagtttcctacggctgcatcggatagggaccgaactgtctcacgacgttctaaacccagctcgcgtaccgctttaatgggcgaacagcccaacccttgggaccgacttcagccccaggatgcgacgagccgacatcgaggtgccaaaccttgccgtcgatatggactcttgggcaagatgagcctgttatccccggggtaccttttatccgttgagcgacggcgcttccacatgcgaccgccggatcactatgccctgctttcgcacctgctcgacatgtgggtctcgcagtcaagctcccttgtgccattgcactcgacgactgattgccaaccagtctgagggaacctttgggcgcctccgttactctttaggaggcgaccgccccagtcaaactgcccacctgacgcggtcccggacccggattcacgggtcgcggttagagctccagcaccgacagggtggtatttcaaggacgcctccagggaagctagcgctcccctttcgcaggctcccacctatcctacacagtcggaaccaaagctcaacatcaagctacagtaaaggtccacggggtctttccgtcctgatgcagctaacgagcatctttactcgtacttcaatttcgccgggtctgtggttgagacagtggggaagtcgttacgccattcgtgcgggtcggaacttacccgacaaggaatttcgctaccttagcaccgttatagttacggcggccgtttaccggggcttaggttcagagcttcgcccttgcgggctaacccctccccgtaaccttccggcaccgggcaggcgtcacagcgtatacatcgtcttggcgacttggcacgctgctgtgtttttagtaaacagtcgcttccccctggtttgtgacaccccctcgggctccgggcgcgaggcccttcaccctaccgaggtcttccttatcccgaagttacggaagtaatttgccgagttccttaaccacagttctcccgctcgccttggtattctctacctgcctacctgtgtcggtttggggtacgggcgcctcgatcactcgctagaagcttttctcggcagcatgggatcagtgacttcgcccgaagtgggctcggagtcgcgtctcaggcttcgtgaggtccggatttgcctggccctcgccctacacgctttccccaggaacgaccaacgcctgggatcacctaccctcctgcgtccctccatcgctcaaacgcgatcggggcggtaccggaatatgaaccggttgtgcatcgactacgccttgcggcctcgccttagctcccgactcaccctgggtggacgagccttgcccaggaaccctgaggcattcggcggaggggattctcacccctcgttcgctactcatgccagcattctcactcgagcgcgctccagctcggctcacgcctcaccttcacggcacgctcgacgctcccctaccgcccggtgacgtacgtcaccggacccgcagcttcggtgaccggcttagccccgttacattatccgcgcggaaccactcgaccagtgagctattacgcactctttgaagggtggctgcttctaagccaacctcctggctgtctgggcggttccacatcgttttccacttagccggtactttgggaccttagctggcggtctgggctgtttccctctcgaccacgaagctcatcccccgtggtctcactgccaggctctggagcatcggcattcggagtttggttgggatcagtaaggctgtgggcccccatagcccatccagtgctctacctccgatgctgaacacctgacgctgcacctcaatgcatttcggggagaaccagctatcaccgagtttgattggcctttcacccctatccacaggtcatcccccctgttttcaaccagggtgggttcggccctccacgggatcttacccccgcttcagcctgcccatggatagatcactcggcttcgggtctaccgcaggcaactctcgtcgccctgttcagactcgctttcgcttcggctcccccacgcatgggttaacctcgctacctacggtaactcgctggctcattcttcaaaaggcacgccatcgccctcacgggctctgactgcttgtagaccaacggtttcaggatctgtttcactcccctctcggggtgcttttcacctttccctcacggtactagttcgctatcggtcgcctgggagtacttagccttacgaggtggtcctcgcagattcacacgggctttcccggatcccgcgctacttgggtggcgacggggaggcagctcgcttcgcctacggggctgtcaccccctgtggcgcgacgttccagtcgcttcggctcacgcgctgcttggtaactccctggaggggctggcgcaccctcctcgtcgctcccgctacccccggacggcaacgccgccaggcttgacaccgcccgggtttgggctgatccccgttcgctcgccgctactaggggagtcgcggttgctttcctctcctgggggtactgagatgtttcaattccccccgttccctcctcctgccctatgtgttcaggcaggggtgacgtggcattccccacgccgggtttccccattcggacatccatggatcaacgcttggtcgacagctccccatggcttatcgcagtcgcccacgtccttcatcggctccaggcgccaaggcattcaccgttggcccttcgtaccttggagttgtgatactcgtgctcgctctggagttctcaagctgccgcgcagcaggtgcttcgcgaagagggagccagtgcttcgactgggtgcggccactcgttgtggccactccttagaaaggaggtgatccagccgcaccttccggtacggctaccttgttacgacttcaccccaatcgccgaccccaccttcgacggctccctcccttgcgggttgggccaccggcttcgggtgttgccgactttcgtggtgtgacgggcggtgtgtacaaggcccgggaacgtattcaccccggcgtgctgatccgggattactagcgactccgacttcacgcagtcgagttgcagactgcgatccgaactgagaccggttttttgggattggctccccctcgcgggttggcgaccctttgtaccggccattgtagcatgcgtgcagccctggacgtaaggggcatgatgacttgacgtcgtccccaccttcctccgaattaactccggcagtcccctacgagtccccggcatgacccgctggcaacatagggcaagggttgcgctcgttgcgggacttaacccaacatctcacgacacgagctgacgacagccatgcaccacctgtgaagggccccgaaggacaccgcatctctgcggcttttccctccatgtcaagcccaggtgaggttcttcgcgttgcatcgaattaagccgcatgctccgccgcttgtgcgggcccccgtcaattcctttgagttttagccttgcggccgtactccccaggcggggcacttaatgcgttagcgtcggcacggagcccgtcgaatgaggccccacacctagtgcccaacgtttagggcgtggactaccagggtatctaatcctgttcgctccccacgctttcgctcctcagcgtcagtaccggcccagatcgctgccttcgccattggtgttcctcctgatatctgcgcatttcaccgctacaccaggaattccacgatcctctaccggactcaagccatggcagtatcggatggcgacaccaggttgagcctggtgatttcacatccgacttgccaagccgcctacgagctctttacgcccagtaaatccggacaacgctcgccccctacgtcttaccgcggctgctggcacgtagttagccggggcttcttctgcaggtaccgtcagtttcgtccctgctgaaaggagtttacaacccgaaggccttcgtcctccacgcggcgttgctgcgtcaggctttcgcccattgcgcaatattccccactgctgcctcccgtaggagtctgggccgtgtctcagtcccagtgtggctgatcgtcctctcagaccagctacccgtcgtcgccttggtgggccgttaccccaccaacaagctgataggccgcgaggccgtcccgtcgcgcccgaaggctttgctccctcgaccatgcggtcaggggagcacatgcggtattagcaccggtttcccggtgttatcccccacgtcggggtgggttcctcacgtgttacgcacccgttcgccactcggtggcaagccaccgcgtacgacttgcatgtgttaggcacgccgccagcgttcgtcctgagccaggatcaaactctccattggagatcgttccgagggtggagtccaccctcgctcgcctcgccccgggacacgtgggtctcgggtgagggagagtcgatcatggttggtgggtttggtcccaccgtttgtgttgtcggggtgacaccgagcttgtgctcgggtcgcccgcactggcttgtcttccctcttcgcgatgtcaacctgcgcccctgtcggggctctgccacgagggcacccgaaggtgctcgttgtggatggtgggttgccccacccccagcggtgctcttggagcacgtgggattcatcagtgtagcggggtcggaacgggtcgtgcacggttgggggacatcttctgtcgagatgggacgtcccgcgtcaagtaccatcggcccatgcctgtctatcgactcggttcccgcagcccccgcatccatcccgacgcattcgttcatcccgatgcggtcgtgatcggcgacgtcgagatcgacgaggaggcatccatctggccgcacgccgtcctgcgcggcgactacggccacatccatatcggcgcccgcacgtcgatccaagacggcaccgtcgtgcacgccacggccgacctcgcgacacgcatcggggcggcctgcgtcgtcggacaccttgcccacctcgagggctgcaccgtcgaggatcacgtcctcatcgggtctgggtcggtggtcttgcaccgcgccgtcatccactcccacgcgctcgtcggcgcccatgcgacggtgaccaacgacaccgaggttccatcccacgccctcgcactcggaacacccgcggcgatccaccccgatcgcgtgcccgccggcaccttcgacgatgcggtgcagcgctacgtcgagaacgcgcgccgctaccgcacggatctcatccgcatcgagtagcggtcgattcgcgcgacgagccgaccgcccacctcggtcaccgtgacgggcatgccgaagaccgcggcgagcgcatcggcgtcctggaggatcgcacgagtaccaaagcgggtgatccccgctccgacgaggagcacgtggctcacctgggcggggagctcctcgacatggtgggtcacgatgaacgccgcgcgcggtcgtggcgaccgctcgagcagctcttcgagcgcccacagggcctcctcgcgaccgatgagatcgagatgcgaggttggctcatcgagcacgatgatctcagggcgccccgcaaaggctctggcgaggaggactcgctgacgctgaccagcagacagatcctcgatggctcgatcacccacgttcgccaggcccaccctcgccaacagccggtccgcttcgacgagttcctcgtcggagagctcgaaccacgcacgacgaaggccagcatgaggaccgagcgcgaccgcatcgcgggcgctcgtcgtcggcaccagctgagtcgtgagctcgtccgcgaagtacccgacccgtgcgcggaagctgcgcacgtcaccgtggcgcaggtcgcagtcgaggactcgaagctctcccgagcgcgggcgcaaccggcccgcgatggccgcggcgatggtcgacttgccggcaccgttcggacccacgaccgcgaccaccgcgccgtcggggacgtcgagcgtcagcccttcgagcaccgtcttcgtaccacgggcgatcgagagattcgtcgcgctgatcaccgtcgcgttcgccatggaacgccaccctacgcgacctagatggcgattagcagcacagcgaccatcgctagcaccatgccgacgatctggcgcgggctcgggctgacacgatcgatgacgagaccgagcacgagcgtcacgaccggatagacggcagtcacggccacgatgggtgctgccgttccaagcggcgcggctcgcagagcgagaaagtagagcaagtaaccggcgacacccgcgaccccggccgcgatcgcaagtggccccatgtagggccgcaagaacgcgatcgatggtaaggcaatgacggcctcgacgagcacgacaccgagccagagcgacagtgcggaagccgaatgacccgcccgagcggagaagtacccccacaccccccacgcaagcgcgctcccaaccgcaagcagcaccccgaggagaacggatcgcaccgctccagcctacgtctcgcgaactgccggcgattcctcaagttcgcgtcgaccgcacccgatacgatcgcagggagggtcatgggacacgactcgagttcgatcatcctgcgagggcgcgaccagatcacgcacgacgcgctcgcacaacagcttcggctcctcaggacccacgcgggcgcgatgggtgtcgccgtcgtgcgggtcggagacgatgggcgcgtcgtcatcgaggcgctcgacatggaccgagccctcctgcgtgagggtgaggagatcgtcgtcaccgacccaaaggtgctgcctgagcgcgcagacgcaccgagtctgcgaccggggcgcatcgaaagcgacctcttgacgttctcgccactgcatggtctcgtcctcgtccccttcgagagtccacaggaccagtcgctcgcactccttgtgttcgctgcgcgcccgctcctcgtgaccgacgacgcactggtgcttgcagcccgcaccatcgagaccttcctgatcgccgcgagccgctttaccgaggaactgcgctacctgaagggcaccctcacacagtcggagttctactccgaccgagaccccctcacccacgcgctcaatcgtcgtggtttcatcggcctgctgcatcgcctcgaagccgactggccgcaccggcgaatggcctacgcgatcatcgtggccgacctcgatcatctcaagcaagtgaacgaccaccaagggcatgccgccggtgacgcgctgatccagcgcttcgtcgagaccctccgctccaacctgcgtgagccggagaacgtcgggcgtctggggggagatgagtttgcggtcgtcgccaagctcaggacacccgccgagacgcagatcctcctgaaccgcttgcgcaccgcactcgacgccgcggggatcgctgcctccctcggagcggcgagccgcgacgtcccgatgccgctcgaggaactcctcgtcctcgccgaccgagcgatgtacgacgacaagttccgtcgccacgaagccatcgagggcatcgaggccacggcaccatcgctcttcgaaccaaccctctagcgatcgctgcctgtcgttcgccaccggtcccgatgccgatcggaacgcggggctcatacgcgcctcgctgacaccacagcaaagccacacatgagcaagggggcgcgctgcgcccccttgccttcgatcatgtccctagcccgggccctgacggatgcggccaagttgaccgctgcgggcaccgacgtgcaggcgctgatgagtgcgagacgccgcactcagcggagtggctcaggcgtccgcgctgtcgtcgtcgcccgtgccgtcaccggttccctcctcgccctgaggcgggccgatgtagttgccctcgtcgtcgtagtactcggcaaaggcctctcggtactcgggtgcgagctccccgccctcgagcgcctgacggatcgacaggctgatgcgccgacgaccggggtcgagatcgatgatcttgacccacagctcctcgccgaccgagaccacctgctccgggagatcgacgtggtggagggccatctccgagatgtgcacaagaccttcgatcccgggcgcaacttgcacgaagcacccgaacggcacgatcttggtgacccgtccgtagaccagctccccgatcttgtgagccgaagcgaactcctgccacgggtcccgctgcgtcgccttgagcgacagtgagatgcgctcgtgctcctggtcgacctcgagcaccaggacctgcacctcatcgccgaccgagacgaccgacgatgggtgatcgacatgattccacgagagttccgacacgtgcacgagcccgtccataccgccaaggtcgacgaagacgccgaagtgcacgatcgacgagacgacgcccttgcgcacctcgcccgggcgaatcgaggtcaagaagcgctcgcgctgatcgcgctgattctcctcaaggtaggcccgccgactcagcacgacgttgttgcggccccgatcgagttcgatgatcttggcctcgatgtcttggcccacgaacggtgcgagatcacgcacccgtcgcaggtccacatgggacgcgggcagaaagcctcgcagtccgatgtcgacgatgaggccacccttgacgacctcgatgacctcgccgcggaccacgccgtcgcgagccttgatcgcctcgatctccttccaggccttctcgaactgggcccgcttcttcgacaggaccaatcgcccctcgcggtcttccttctggaggaccaaggcgtcgatccggtcgccaacgctgaccacgtcggcggggctcacgtccttacggatcgagagctctcggagcgggatgaccccctccgacttgtagccaatgtccaggaggacctcatccttgtccaccttgacgaccagtccgctgacgatgtcaccctcgtcgaactcgacgaggctcttggcaatcgcctcctcgagtccctgctcgccaaggtcgtcgaggacgatcgcgtccgaggccgcgggagccccatgctcggatcccagctcgcgttcgctcgcggactccgacgccatctcttcagtcatgctcgatccgatatccttctgcttcttccaacgccaccagcgcggacgtgccacgccatggccgaggatagtcggccgaatgccggccgctgcggctcatgcgtcagctttggcacgaccccaacttcggccgacgccgctctgtactcgcagcggcacccgtagtgcaaaggcgtgctcgagcacgtcctcgacgagggcacggacgtcgtgcgcgcgctccgcgacagcctcgaccacgacttcgtcgtggacttggagcacgagtgcgccatcggtagggctcagcgcagcgtgcaagcgcaccagggcgatcttgaagatgtcggccgcaagaccctgtgtccccgcgttcatcgcctgccgctcggcgccttggcgaacggtgcgattgggtgagtcgaggtcggggagatagcggcgccgtccgagcagcgtcgtagtgaaaccctgcgctctcgccgcatcgacggaagcatcgcggtagtgccgcagccccggaaaggccgcgaagaaatctgccagtatcccctcggcctccgcgggagggacaccaagacgttgggcgaggccgtaggcctccatgccataggacagaccataggtcaccatcttggctaccgaccgctgctgcggcgtgacgcgctctgctggtacgccgaagacacgcgcagccacgagggtgtggacatcgccatcgcccgagaggatccgtaccagctcctcgtcgcccgacaggtgtgcgaggacccggagctcgatctgtgagtagtcggccgccacgagcacgtgaccctccgtcgccacgaaggcgtcgcggaaccgcttgccctcgtcggtacggaccgggatgttctggaggttcggtcgctcggaagagatccggcccgtgcgtgcgacggcctggttgaaggtggcgtggatgcggccgtcggcaccgatctcactgcgcagaccttcgtagaacgtcgacagcagcttgtcgagctcgcgaaagcgaaggatcgccgcgacgatgggatgagcgtcgcgcaagctctcgagcacacgggcgtccgtcgagtaccccgtcttcgtcttccggcctgccggcaacccaagccgctcgaacaggaccaccgcgagctggcgcggtgagttcgggttcagctcaccaccggcgtagtgccggacctccgcgagagcacgatcgcgctcggtggcgagctccgtaccgatcgccgccaggacgtcgcggtcgatcgctaccccatggatctccatgtccgtcaggactcgcgtgagcgggatctccacgtcggtcgcgagacgccacagatcgtcctccgtcaggcgccgctccaacgcttcgcgaatcggatggacgacctcgacccactgcctcgctccgagcggcgccgcttccgcttcgaggggcccccggtcgtcgaggtgtctcccgagccagcgccgcgccagttggtcgagaccgtgagcaacgtccgcagagtcgaccagccacccgagcacctcgagatcgacgagcgcgcgtggctcgagcggcaccgcatgctccatcacgagcgagcgcacgatctccttcgggcctgctcccacgaggacgcacgacccgagggcctcccacagatgcgtgggggcatcctccggagagcccgcccaaaccacgccctcgacgccgagcgcgagctcgaccacgcggctacgtccggggtctccagcgaacgtagccgccaccgccaccgtggcacctggtgcgagccgctcgacgacggcggcggcgctgacgtcggtgaggtgcgcaaccggcgactcgaccggcggtggttcgtcgccggcggtcggccgaccctcgaacgcccgcaccagggcctgaaacggacgccgcagctcgaaggtccccaccatgagcgtctcggcccgccgcgggtcccacggaccgagtcgcagcgcatcgagggaaggtagctccgcgacgtctcgacgcagctgcgtcagcaggcgtgcctcgaggagctgtgagcgcgcctgctccagcgcctcgcgttgccgcgccgagagggcatcgaggtgagccaagatcccttcgatcgactcgaaccgatcgagcagggcggcggcggtcttcggcccaatccctggcacgcccgggaggttgtcggagctatcccctcgcagggaggccagatcgccgtagcgggctggtggaaccccgtaggtctcgaggaccttggcctcatcgaaggcctcgagattggagacccccttgcgcgtgaggagcaccacaatgagcgggtcctcgaccagctgcaagaggtcccgatcgccggtcacgatgcgggtggcgatcccggcgtcgcgggcgcgcgtggcgagggttgcgatgacgtcatcggcttcgaacccgctcgcctcgacagcggggacgccgatcgcctcgagcaacccacgagccgcatcgagctgctgtcgcaggtcatctggggtcggtgccctcgtccccttgtagctctcgaggatggcgtcgcgaaaggtcgggccctccgcgtccaacgcgaccgcgaggtgcgtgggccgggtttgggcgacgacgttggcgagcatgctcgcgaacccgaacagggcgttggtcgcgaccccgctctccgtgcgcatcatcggctcccgcagggcgtagaaagcacgaaagaggagtgagtagccgtcgagcaggaggaggagctggcggtcagtcggttgtggagctgggactgagctcaccgttgatcacctgctcggcgatggaccgcacccgcgtgcgctggttcatcgcggtcttctgcaagaaccgaaatgcctgcgcctcggtgaagccatcacgctccatcagcaccgccttggcacggtcgaggagcacgcgcgtctcgagacgctccgcgatccgttcgtgctcgtcacgcaatctggccagctcagcctcgatgatctgtcgctcgtcgaaccgagccctggcgagctcgagcgcagcgacgagctctcctgcctggaagggcttgaccagatacgccatgaccccagcgtctcgcgcctcctcgacaagggcacgctgtgagaaggcggtcaagatgaccaccgcgaccgggacggagccttgcacgcgtcgcgccacatcgagcccgtcgagtcccggcatcttgatgtcgagcacggcgagatccggcttgagcgcaccgatcgcctcgagcgcctcgtcgccccgcccgaggtcggcgacgacctcgtagccctcgagctccaacatctcgcgcaggtcgcgccgaacgatcgcctcgtcctctgcgatgatcacgcgtgccgacatgcacccctcgctgctcgactcgcgcccacgctagccgcagcccggttccggtgctctcgccctagcctccagatcgtgatcaccgccctttccctctgggtcgccggcacgaacgcgtggatcgcgtctgccgacggccgagagtgcgtcatcgtcgatgcgcctccagagccatggcacatcgtcgagcggctcgacgcactcggcctccgcgtcagcgcgatcattgcaacgcatggtcatctcgaccacatcgggggcatgcacgatctccaacgcgcccgtaaggaagatgggctggtcgaggtgtggcgttccccagcggatgcgcactacttcgtggaccccctcgggaacgccccgctgctcgcagacgccgtcgacagatcccgtgtcaccgtcgccacgccagaaatgatccgcgatctcgacgacggcaccgtggtgcgtggggcaggtatcgagctgcgtgcaatctggacccccggacacacgccgggatcgacctgcctcctcgcgaccatcggcgacgaaggcaccgtgctcttcagcggcgatcacctcttcgcgggctcgatcggacgcacggatctccccggtggctcactcgagcacctgctcgcctcgatgcgcgatcgtatcctgccgctccccgacgacctggtagtcctgcctggccacggaccaacaaccacgatcggcagagagcgagcaacgaacccgtatctccaagacctgcgctgaccacaggcagcgcaatgaacgtctcggcggattggaacccggggctcgccgaggcgatggcgccgtgcccggggcgggactcgaacccgcacgcctgttggggcagaggcttttgaggcccccgtgtctaccattccaccacccgggcttggccgcagcctaccgtggctcccccaccgagccaagccgcgcgcacgtcacggtgaccggccccaagaccggatccaccctcacggtgggacccgacgtcctcacgctaccgctcgcaggtccccccgggcaccgatcatctcgagtgcggagaacgtccgactcctcgtcgaggtgcagaggatgtgccgctggctctcgacgtcgagcccccggacctcggcggggccgaggtagccggcggatccacaggcccacgttgtgttggtgcggtgcgagtcgtgcccgaggagcactccggcctccgacacagagccgaacagctccccatcgagcacctcctcgcggacctgggcgcacagtgactcgcacaccccgttaccgccacagcgagcccggatcggtgaaccacgaggtcactccgagttcgctcgcccagcttgccacggaacccgcgacgaactccggggcgttgtcgacccgaagaaagccttgggctcctcgctcggcgacgaggccatcgagggtggcgacacgtcttcggcgtcgatcgagtgccccaccacgcaaggccagctcctccctggtggaggcgtccaccacgcatcgcaccgtgagcgccctcccgtcgtcggtcgcgtcgaaccggctccagtgcccagatcgcgttcgcctggatgggcaggtgagacaccgtttgtcaaccccccacgcagccggcgactcctcgcatggcgcgggaggactcaggcggcagcccgaggcgatggtccgggggcacgtccaagggcacggttccggttcgccacgtgacgcccctcgtcgtagggcacgccctggcgagggttcgccagggcgaaggtacgcaagacctcggtgatggtcgcatccaggctggactcgggcttcgtcggcacccgacgctgggtggagcgaggctggcctgtcacccggcacgctcgtcgctcggagacctgagaaccgctggcggagccggcgcacggctccccgccggcggtccggggtcagacgtttccctcggccagctcctcagagctgtcgatgtcgagggagaactctgccaccaacttcttcaagcgccggttctcggctcagagctccttgagcctcttcacgtctggccccttcatgccgccggaggtctgcttccagccgctaccaggtggtcttggtgatgtgcaaaggcccgggcgacctcggcgaccgtggcgcccttggtgagcagctgtccctctcggccagcctccggaggatctgctccggcctgtggggcttcgggcccttcatgtggtctccctcccgcatgtccagtctggtcggggttctcacagagcgggtggtctcgttgcaggggggccagccaagttggggtacaggtcatcgatggcacccagttgcatatcaccaaatcctctcccactggcgtcaaatagatggactcgaggagacgagagcacgtgtgagagaggatgtcaaccgatcatcggtaagtcgggtggctggtagcatgtccctgtcgtggtcgcgtaggctgcagcccgttcagtcgccgccgtgtgtcggcgatccaagccgacccggcgcgaagatgccggccggatcgaacaggcgcttgatgcccgcgtcgatgcgcaactcggtcgcgctcgcgtgggtccggaactcctcaagcttggcgaccccgatgccgtgctcgcccgacaccgcccccccacggcgaacgccctcggcaaccacttcttccacgacacgccgtgcgctggccacatcgtcggcgaacaccgacaggtggacgttcccatcgccgacgtggcccgttgcggcgaggcgcaccccataggtggaggcgacggccgcgaccgcatcgaagtagtctccgagcctggctggcggaacgaccacgtcgacgatgtcgcgggcaccgagagccctcaccgtccacagggccgcttctcgggcgcgcagcacggcccggccttcggtcttgccgagaacccatacgccatcggcgccagccccctcgagtacggctcccgccagctcgaccgctcgtgcaacgtcgtccgcgtcgacacgctccaccgcaacgacgaggatcgcgccgtcggcgagcgcccagccgggtagcccgagggtcacgcccgcaaagtgagccatcgcctcgagcgcgctcggttcgaggtactcgatcacgcttggtggcggctcgatcgactgcagagcctgcaccgccccgagcgcaccacgcatggtcggggcatgagcaacgaacaccgcctcctcggcacgcggcgcgagccgcaatatcgctcgctccacgatgccgagcgtgccttcggatccgatgacgagctgcaggaggtcgtaacccgacgagcgcttgtagagggagcctccgagcgtcaagacgcgaccgccacccgtgaccactgtggcaccgagaacgttctgcctggtcgtaccgaagcgcaccgctcgcattccgccggcgttcgtcgcgaccgtcccgccgatcgaagcggcgttctcgccaggcgacacggtgtagcgcaagccgtgatcggcgagcacgtgatcgagttcggcgaggctcgtgccggcacggacgacggcgacgcgggacaccgtgtcgacgtcgtccaccccgctgagccgctcggtactgacacagacctcggttggccgacagaccgctccgccggccagccccgtccccgcccctcgcacgacgagcgggacctggcgacgctcggcccagcggacgagctcgacgagctcgtccgtgtccgctgggcgcacgagcgccatcggccggctcggcgcgaccgtcaaggactcgtcgtgccagtagcgctcctcgatcatctcgccgacggcgagatgatcgggtcccacgatcgaaccgagctcctcgaatgcacgctgcacggatcgaccttaggcagtggggctccggagggcaaggcttgccccggtttcgccatgcccgacacccacgcagcctcgagtctgtaacccaatccgacgcgagagcatctaactgatgaaggctggagaaggggcaggtacctacgcagtgacggagcggcgcagacgcacaccgagcagggcacctcacgcagggtagctcgtcagtgtcatcggctctggtggcgcgacacgaggcactcgccctagggcgtggctacgagggagaggtcgtgcgcacgggatggggcgtcaggcgccacgatggatcgaggtccgtcggacgcgcacgagcgcagcggcaggtagtcagcaggtagtacggagagagggaaagggagtacagccatggtggtgtttctgttccccggtcagggctcacagcagcccggtatgggggcagcctggcgcgaccatccctcgttcgaactcgtcgacgaggccagcgacgtgctcggtcgcgacatggcctggctgctcctcgaggcggatgccgagacgctccagatcacgcggaacacccaggtggcgacgctcctcatgagcgcgatcgcgctcgacgccatcgagcgcctcggcatcgcaccgcagctcgctgcaggccactccctcggtgagtatgccgccctcgtggccgcgggcgggatctcacttgaggcagggctgctcctcgttcaagagcgcggcgacgcgatggcccaagccgccgaggcatccccgggcgcgatgatcgccctcctcggcgcgacgcttgaccaggcgcttcagctcgtcgatgcgatcggaccggatctgtggctcgccaaccacaactccgacacccagatcgtgctctccggcacgaccgacgcggtcgcgagtgcggaggagcttgcacgcgagtacgggatccggcgggtcacgcggctcaaggtcggtggcgccttccattcgccctacatgctcgaggccaaggatcgcctgcgcaaggccatcgcccagacgaagttctacgacctcgaggttccggtgatcgctaacgtcgatgcgcgcgagcacgtccttgcgagcgaatggcccacgctcctcgccgagcagctcaccagcccggtgcgttgggccgagacgatgagcgccatcgccgccgctcggccggccctcatcgtcgaggtcggccccggcggagtgctcgccaacctcgccaagcgcgccatcgccgacattccaacgatcgcggtggccaccccagatgacctcgaaaccctggtggaacggctcgccggcgacggaccggtcgccgaatgggcgacctcccaccagggcgagcgcctctacggctctgagcgccttatcgtcgcgccggtcacgggcgtgttccagccagcccggccggctccggagcccggcgcgcccgtccgagtcggtaccgaagtagggacgatcggcgacactccggttcgatcggccttcgccggtacgctaaaggagatgctggccgtcccgggcgagcgcgtcaccgctggccagccggtcgcctggctgtcggagacgagcgcttccgaccacgcaccggccgccatcgcaacccccctccacgaaagcaggtaagtcacactatgggagcacggatcatcggggtcggccaggccgtcccggatcgggtcgtcaccaacgccgatttcgaggcctatctcgacacctctgacacctggatcaccgaacgcaccggcatccgcgagcgccgcttcggcggcaccacctcgagcctggccatcgaggcggggcgacgcgcgatcgccgacgccgggttgacccccggcgacatcgacttcctcgtcctgtcgacgacgacgcccgatcagacggtcccggccacatctgccgaggtatcccaccagctcggaacccgcggtggcgccatggacctcaatgctgcctgcgcgggctacgtctatgccctcgtggtcgcacgtggcatgatcgcctctggggcacaccgggtgctcgtcatcggatccgacaccctctcgcgcatcaccgaccagaacgaccgctcgacggccgtcctcttcgcagacggtgctggtgcggtcgtcatggagcgtgccgacgaggacgacctcctcggctgggacctcggtgtcgacggggcggcgcgccccatcttgtactgcgaccacggcggctacatgtacatggagggacgcgaggtgttcaagcgcgccgttcgcgtcatggttgagtcgtcggagaccgcgatgaagcaagctggcgtgaacgccgacgacatcgcgctgctcgtaccccaccaggcaaacctgcgcatcatccaagccgccaacgaacgcctcggcatctcgctcgaccgtacggccgtcgtgctcgatcgctacggcaacacctcgtccggctcgatcccgctggccttggccgacgccgtcgcccaagggcgcctccatcccggtgatcacgtcctcttcacgggctttggtgccggcatgacctgggcaagtgcggtctggcggtgggccagatgacccacgtcctcgtcaccggcgccgcaagcggcatcggcctcgcgaccgtacgcaccctccaagcgagtgggtttaccatctcggccggcgtccaccaccgccccatgcccgacgacgtgctcgcagcgggcaacgtgacccccgtcgagctcgacgtcacgaactccgagagcgtcctcaaggcggtggcagcggccgaggcggccaacgggaccatcgaggcactcatcgccaacgccggcctcaccgacgatcagctcctgcttcgcatggatgaggcgtcgtgggccgcgacgatcgacctcaacctcacgtccgcattccgactcgccaaggccgtcgtcccgcgcatgctcaaagcccgtcgcggacgcatcgtcttcgtctcgtccgttgttgccctgctcggttcgccaggccagacgagctacgcagcagcgaaggccgggctcgtcggcttcgcgcgttcactcgcgcgcgaagtcggatctcgcggcatcaccgtcaacgtggtgatgccgggcatgatcgacaccgatctgctgcgcgcgaccggagagcaacgactcgcgtccatcctctcccaggtgccgctcggtcgcaccggtcggccggaggaagcggcgtcggttctcgcctttttggtctcggacgccgcgagctacgtgaccggatccgtcatccccgtcgacgggggtctcggaatgggcatctagcgcactcgcgcagcgcgagcggagagcctgtcggccgctcacgcgcccgtcgtgacaggcagtacggccgcaaggccatggaccagtaccacacaggaggaaccacaatggaccgcaccgaggcattcgagaagttcaaggtcaccacggtcaaggtgctcggcgtcgagccggaccaggtcgtgatggacgccagcttcgcgaacgatctcgacgccgactcgctggatctcgtcgagctgatcatggcgctcgaagacgagttctccgtctccgtgcccgagtccgagctcgagggcgtcgataccgtgggcaaggcgttcgagctggtctacgggaagctctcgtgagagttgaggcatccgagcccgaacggttcgcgtctcggcgcgtcgccgtcacgggcatcggcgtcgtgagcgctgtgggcatcggcaaggaggccttctgggagggcctccttgcaccagcacgcacgggtgtgcggcgcatcgaaggatgggatccgtctgcctggctcgggccgaaggagatccgccgccacgatcgctacaaccagttcggcgtcgccgcagcgcagatggcatgggacgacgccggagcgccatcggtcgatccggcgcgcgccggtgtgatcatggggaccggcgtcggcgggctcgagagcctcgagaaccagatcgtcatggcggagaagcgcggctacgaccgcatcacgccgttcctcgtcccgctcttcatggccaactccaacgccgcgtcgatctcgatgcgcttcggtctcaacggtccttgcgagaccatctcgacggcgtgcgcggccgggaaccacgccatcgccaacgctgcgcacctggtcgcgatggggcgcctcgacgtggccctcgcgggcggtgccgaggcagcgatcacgccctcggcgacagctggcttcaccaacatgaccgcactgtcgaaggaggggatctctcgaccgttcgatcgtgaccgagacgggttcgtgatggccgaaggtgccgcggtgctcgtgctcgaggatgccgagcatgctcgagcacgtggcgcgcacatctacgcctacatcgaggggacggcctcgaccgccgacgcccaccacatcaccgcacccgcccctggcggcgtcggtgcgcgcagcgccatcgagctcgccctcgccgatgccggcatcacccctcgtgacgttggccacgtcaacgcccatggcacctcaacaccgctcaacgaccttgccgaggctggtgcgcttcgtgccgtctttggtgacgccgtaccgccggtgaccagcatgaagggggcgctcggccacgcgctcggcgccgccgccgcgctggaggcggtcggggtcatgctcaccttcgagcaccagctgatccccccgacgcaggggacggtcgccctcgatccggagatcgacatcgacgtggtcctcaaagatcctcgcccgctgccgccggggcgcatcatctcgaatgcgttcggcttcggcggtcacaatgcggtgatcgtcttcggcccgccttcgacggactgaacctcgcgctcgccgcgcagcacacgcagcgagacaacacgaagggtcgcccgaaacgcctcgggcgaccctttgctgtgccacctggctgtagtccggctgcgcgcttgacgcatggtcgcccgatcggtcatcgtcatagcaacgaaccacggggccgagccccgacccttagcgagggtcgcaagcatccgccaaccctcacgtccgctctccgctcccggcgccccggcgttcgcccctgtagcggacgctcggggatgcgagactcagcgctcgcgagaggcgtgttcgccgaggatgatctcggcgccacgctcggcgatcgcgatggtcggtgcgttggtgtggccgcgaacgatctctggcatcaccgatgcatcgacgacgcggagcgccccgacgcccctcacccgcagcatcgggtcgaccaccgagcgctcgtcacgtcccatacgtgcggtggaggtcgggtgatagatggtgtgggccacgctctcgagcgcgagtaccgctcgttcgtgggggtcgagccgctccccatggtccggcatcaaaagacgtccggtcgtgtgcgcccggagcgccctcgaggtccgcagcacctcgagccgctccagccctgcgatcatgcggttcctgtcgtgtccgtcggggtcggacagataggcggggtcgatacgtgggcccacgagcggatcggggctcgccagcgtgacgctgccgcggctctcgggcgtgagtaggatcaccccgagcgtcagtccatcgaccgtgatgggcacgagaccctcgccgagataggcgaccggcgcgaagaggacctcgagatcgggtgccgcaaggcccggatcggatcgccagaacccgtaggcctcggcgatgttcgaggtcagcatgcccctccggcccacgaagtagcgcaccacttcggcagcgctggtcgctgagcgcagcgtcggttcggtcgtctcgaggaccataccggccacgaggtgatcgcggaggttccggcccacctcgggggcgtggtacaccacccgaatcccaagccgtcgcagtgcaccctcgtcaccgatgcccgagagcatgaggagctggggcgtgttgaccgctccggcagcgaggatgacctcggcgcgcgcgcccagcgcacgccgctcacggccgacgagatactccacgccaacggcgcgccccccctccacgatcacccgcgtcacacgagcctgcgtgcgcacgacgaggttggggcgatggcgcaccggccgcaggtacgcatcggcaacgctcgcacggcgtcccgacgcctgcgtgaccaccgtctcggtgaagccttccgggctcgggaggttcggggcctcgacgaccccgccggtctcgcggatcgcgtcgaggaacgcgcgcgtcacgggccgtggatcgcgctgagcctcgacgggaacgaccgcacgccgcatcgccgccatcatcgggtcgaagccccacgcaggaccggcgagctcggcccagcggtcgtagtcggctcgcatcccgacgacccacatcatcgcgttgatcgacgaggagcccccgaggcccttgccacgcggccagtagatggagcgtccttggaggttcggttgcgcaacggtgcgataggcccagtcgtagcgcgatcgaaacagtcgcgcgaacccggcggggatatggatgagtggcgatcgatcgcgcggacccgcctcgagcaccacgacgcgatgccgaccatcggcactcaagcggttggcgagcaccgcaccggccgatcccgccccgacgatcacgtagtcggcgtgctcgtccaccaccgccccttacgactcgctggccccgctgcgactgcgtcgaccgggtcggcgaccacgctcgtgggcctccatccgccgccgaatgagctcgcgccgttctcgcagctcgcgataggtcagctgctccgtcgtctcgtcgacgccgaggctcgccttcacgcccgacagatcgatcagctccggcgagaccgccacgccgatctcggacgtgatgcgcgcaccgtacttcgtcatgaagtaggcagccagacgagcgatctcggcgaagaggtcgatgtcgggggcgagcgtggcgagcgacgcgtccacgaagagcatgttcttcacgaagagcatcagctccttgggcatgcgagcacccgagccgagcagcgccttcgtgatctcctggagctcagcgacgagctgctcgggctcgagttccgtgggatcgacagccggctggtccagcccgagatcgtcgatcacctgctcgggatcggtcccaggcgggagcgcaccgagatcgatcagcgcctgcacctgcgtcgtgagatcgttcatcgagcccgccatcaacagccgcaagaaagcgaggcgcttcggctcgctcaggcggccggtgatcccgaagtcgagcagcgccaccgtgccgtctggctgcacgaacaagttgccaccgtgcaggtcgccatggaacacgccgtggagcatcgcgccctcgaggaagctgacgagcgccgcacgcaccacctcggtcgtgtcgatccccgcgtcgtgcatcccgcgggcgtcgtcccaccggtagccgtcgaggcgctccatcacgagcacccgccgcgtcacgaactccgggtggggcctcgggacgacgatggcgcgctgctcggtcgcggcgagcacggcagcgatgtcgagcatgttggcggcctcgatgcgaaagtcgagctcctcgacgatcgtctcggcaaacagctcgacgagtgccggcgggttggccagtgccgccaccgggatcctgccgacgaggtgcggcgtgatccacgccatcgcggcgaggtcccggcgcaccagctcggcgacgcgcgatcgctggaccttgaccgccaccggcgtgccatcgcggagggtcgcgtagtagacctgggcaatcgacgccgcagccaccggagatggatcgaaggatgcgaacagctcttcgagcggcgcatcgagctcctcctcgatggtcgagcggacgacggcgaagggctcggccggcacgcgatcgcgcagctgcttgaactcctcgaccagctccaccgggaagatcccctcccccgatgagatgatctggccgagcttgatgtaggtggggccgagcgtctcgaaggctcgtcggagccgcctcgagaggccccggcgcgacgcggcacgaccccgagggcgatcgaacaaccgccatgccccgagggcgacgccaagggacaggcccgtcccaaggacacggcgcgccggcggcacccgccgcggcgccgtcaacctggggatctgcgcctgtgccctcgcccgcagcgcgggcacaccctcggcccacaggagccgacctgcctccacgcgccatggaccatgttcggtgaaggaccactgctgttcgtcagaggccacgatggcgagcctaccgggccctctcgcgcaccgaccggttctaggggcggcgctcctcatggcctccgaactcccggcgcagcgccgagagcacccgattggcgaacgcgtcctcgccccgagaggcgtagcgcgcaaagagcgcggatgcgatcaccggcgcgggcaccgtctcgtcgatggcggcgagcacggtccagcgaccctcgcccgaatcggcgacacgaccctcgagctgttcaaggtgggggtcgtccgccaaggcccgcgcggcgagatcgagaagccaggatccgaccacgctccctcgacgccagagctctgcgatcttggccacgtcgagttcgtagcggtaggcgtcgggctcacgcatgggggccgtctcggcgtccgcggcgagcgcgaccgaacccgcgttggcatgctcgaggatggagaagccctcggcgaacgccgccatgaggccgtactcgatgccgttgtgcaccatcttgacgaagtgtccagcaccgtgcgggccgcagaggagatagccctgctcctcaggacccaccgcgacgtcggctcgcgtgcgcggcgccgcgtccacaccgggcgcgagggccgcgaacgccggctccaggcgtgcgaacacgtcggggtcaccaccgatcatcaagcagtagccacgctcgcggccccatacaccccctgacgtgccgacgtcgagatgatggatgccccgagcagccagggtcgctgcatgggtcacgtcgtcgcgatagaacccgttgcccccgtcgacgacgacgtcgtccggggcgaggagggagccgagctcgtcgacgagctggctcgtcagcgcggcgggcaccatgagccacaccacgcgcggtgcctcgagtgcatgcacgagttcgtcgagggagccatgcacgctgaccccgagggcgctcgcggaggcgcgtgcggcctcggcggggtcgaatccgtgcacctcgatgcccccgcgctcacggagccgagccgccatgttggcacccattcgacccaagcccaccatgccgatctgcatctcacggcctcctctcgcctcgcctacgctactggttgacgtcctcgatgctccatcgcacgatcccccgcttcgtgcaacgcacgcacgaactcgccgagctccgccggtggtgccccctcgagcaccctgcgcacgatcgccgaacccaccaccgcgccgtcggcaccggcctcgacgaccgcagccgcgtgctccgggctcgagaccccgatcccgacgagcaccgccaactcagcacgcccggcgagccgcccggcgatctcggtcgccgtctcggcgagctggtcgcgctcaccggtgacgcccatcaacccgaccgcgtagacgaagccctccgcagcgcgcacgatgcgctccatgcgcgccgggggcgtcgatggcgcgacgagctgcacggtctcgagaccgacctcgcgcgccgcccgccaccacggctccgcctcctcgatcgacagatccgggatgatgacgcccgcaacgccggcctcggccaggcgtccagcggcacgttcgagcccctggtgatagagcaggttgtagtaggtcatgaccacgagcggcacgccaacgaccaggttccggagcgcagcgatcgtaccggcgaccgtcgtgcctcgctggagcgcgacctcgctggctcgctggatggtcggcccgtccatggaggggtcggagaacggtatgccgatctcgatcgcgtccgcaccaccctctgcgagcgcgacgacgtcgtcttcccagccgtcgcgcgcgccagcgcacacgtacgggacgatcacggaccgtccacgctcgaccctggagcgaaggtgggcaccgaggccgctcaccgccgacccccgaggtacgcagcgaccgtctccgcgtccttgtcgccccgtcctgacagagtcaccacgatgcggtcaccgggctgtgtgcgcgccgatccctcacgcagcacccacgcgagagcgtgggccgattcgagggccggaacgatgccctccgtccgcgacaacgccaccagcgcatcgacgacctcgtcgtcgccgaccggttcgtaactcacgcggcccgtgctcgcccagtaggcgtgttccggaccgaccccggggtagtcgagaccggccgagatggactcggcctcgcgcacctgaccgtcctcgtcctggaggagcatggagtgcatgccgtgcaccacccctggccccccgcgtccgatggcggcaccaccggccggctcgaccccgacgagccgtgccgacgtctcgacgaagcccgtgaaggtcccggccgcgttggaaccaccgccgacgcaggcgacgacgagctcggggacgccaccggcctgggcagcgaactgctcgcgcgcctcgtcgccgatgacacgctggaactcgcgcaccatccaagggtacggatgcggacccatgaccgaaccgatgcagtagtgcgtgtccccgagttcggcaacccaggcgcgcatcgcctcgttcaccgcgtccttgagcgtgcgacttcccgccgtgacctccacgacctccgcaccgagcagtcgcatccgaaagacgttgagcgcctggcgctcggcgtcgaccgctcccatgtacaccctcgcctcgagcccgaggaacgccgctgccgtcgccgtcgcgacaccgtgctggccggctcccgtctcggcgatgagtcgccgcttgcccaaccgccgcgccagcagcgcctgaccgagcacgttgttgatcttgtgcgagccggtgtgggcgaggtcctcccgcttcagccagacctcgcgcccgacgagctccgagaagcgctctgcccgatagagcagggtgggccggccggcatacgtcgccaacagacgcgcgtattcgtcccggaatgcgacgtcggcccacgcagctcgaaatccgctctcgagctcgagcaccgccggcatcaacgactccgggacgaagcggcctccgaagtcgccgaagcgaccagtcgcgtccggcgcgttcgtccccttaggctcgatcatggtcatcggtctctccttccaatgctgcagcggcccctcgcgcagcctcgatgaactgtcgcaggcggatcgggtccttgtggccaggtcgagcctcgacaccgctcgagacgtcgacgccgaacggcatcaccgtctcgatggcctgcctgacgttgtcgggtcgcagcccgccggcgaggatgagtcgccgcatcggcgagatcccgtcgacgagcgaccagtcgaacaccgtgcccgagccggggctcgcggcgtcgacgagcagcgcccacgccggttgctcgatcgcgcgatcgaactccggcgatccggccgcaacggcgcggatcacccacggcgtgcgctctgcgagccaggcgagcccgtcgttcgagatctgaccgtggacctggacgccaccgagtccggtctcggcgaggacctgcgccatgcgctcgggcagttcgtcgcgaaacacgccgaaggtccgtacgccagaaggcaactgcgggaggatctgggcgatccgcacgggcgacacctgcctcgggctcggcgcgagcacgaagccgagcgcgtcggcaccgagggcaacggccagcagggcgtcagactgattcgtgatgccgcagatcttgatgaacactcgcacctcgctcgacgagcgcccggacggtcgcgtaggggtcccgagcacgcatgcaggcctcaccgatcaggacaccgtcgaagcccacgagccccgcgagatcatcgggaccacgcacgcccgactcagcgagcctggccgcgcccggcgggagcgccgcgagcacgcgacgcgcccgatcggtgtccacgcgaaaactcgtcaggtcgcgttgattgacgccgacgacgtccgcggcggcaagctcagcaagctcgagctcgctgagctcgtggatctcgaggagcacctcgagcccgacgtcgtgggcgacaccagcgagagatgcgacctcctccggctggagcgccgccgcgatcagcaagaccgcgctcgctcccgcgcgacgggcccggagaagctccctcgcgtcgacgatgaagtccttgcgcacgatgggaagctcgacgtgctgcgcagctcgctcgaggtcagcgagggtgcccccgaagtgcggtgtgtccgtgagcacgctgaccgcgaccgccccagctcgctcgtaggccgagactcgcgtcgcaacgtcggtctctggctcgacgaaccagcccttcgacgggctgcggcgcttgaactcagcgacgacaccgaggccagccgatgccaggagcgccgagcgaaggctcgggcggggctcgatggcgtcgagtccggcgagcagactcgtgaacgactcgtcgtccaaggcggcacgccgacgatggtaggcgacgatgtcggtcaggtagtcggccatgggcccagcctaggtgccctgcggcccggctcgaggcaggccgcctcgcagctcagggcaccgtgtgataccggtccgttttgcttgcacaatgcaacagaaggtctcgacttcgctagaatgtggccagagcgcaccgcagtacgcgccagctacggaggtcgatcagcgtgacgaagtccaggggatccatcagggaacggagcttccgcctcaccgaacacccgcactacaagtggatcgccctctccaacacgacgctcggcatcttgatggccacgatcaactcgtccatcgtgctcatctccctcccggagatcttcaacgggatccatctcaacccgctcgcaccgtcgaacacgtcgtacttcctgtgggtcctcatgggctatctcctcgtcacggcggtgctggtcgtgagcttcggacgcctcggagacatgtacggccgcgcacggatgtacaacctcggctttgcgatcttcaccctgttctcgatcgcgctctcagcgacctatctccacgggaccgccggtgcgtggtggctcatcgtcatgcgcatcggccagggcatcggtggtgccctcctctttgcgaactcggctgccatcttgaccgacgccttccctccgaaccaacgtggcctcgccctcgggatcaacaacgtcgccggtatcgcgggctcgttcatcggcctcatcctcggtgggctcctcgccccggtctcctggcgtgccgtcttcctcgtctcggtcccggtcggcctcatcgggaccgtgtgggcctacctcatgctgcacgacctcggtcagcgggtgcgagcccacatcgactggctgggtaacgccgtgttcgcggtcggcctcatctcgatcctcgtcgggatcacctatggcctcgaaccctacggcggaagcgacatgggctggggcaacccgggcgtcatcgcggccatcctcggcggtcttgcaaccctcggcgtcttcgtctggatcgaacagcacgttccccaacccatgatcaacgtgcggctgttcaagatccgggcctacctcgccggcaacctggcgagcctgctcgcctcgctcggccgtggtgggatgatgttcatcctcatcatctggctccaggggatctggctccccgagcatggctactcctactcgcagacaccgctctgggccggcatctacctcgttcccctcaccatcggcttcctggtcgcaggaccggtctctggattcctgtcggatcacttcggcgcccgtccgttcgcgaccggcggcatgatcgtcgccgcgatctccttcatcgccctgctcaccttgcccgtcaacttctcgtatctcaccttcgccggtctcttgctgctcaacggactcgcaatgggcctgttcgcctcacccaaccgcgccggaatcatgaacagcctgccggtcaacgagcgcggcgtcggggcggggatggcagcgacgttccagaacgcggcgatggtgctgtccatcgggatcttcttcaccctcatgatcttcgggctcaaggcgagcctgcctcgccatctctacgacgggctcacccaacagcacgtgcccgcctccatcgcccacgcactcgccaccctgccacctgtcggcgtcctcttcgccgccttcttgggctacaacccgatggccaagctcctcgggcccaaggtcatcagtgccctcccgcactcgaacgcggcgtatctgaccggccggtccttcttcccgaacctcatcgcctcgccattcggtcacggcttgacggaggccttcaccttcgcagccatcgcgtgtgtggtggcggcggtcgcctcgtggctgcgcggtggcaagtacaccgcggccgacgtcgagccatcggactcggccgatccctccgtcgccgacgccgtctccgagccggtcgctgggggcgacgcctgagcgaagcgcctgctcgcctgcccctgctaggttgaccgccgtgggacgccatgtcctcgtcgtcgaagacgatccggcgatcgccgatctcctctgcgtgtactttgccaaggaggagggcgaggtccgtgtcgtctccaacggcgaggacgcgctcagcgcgttcgatgcctcggtgaccctggtgatcctcgacctcaacttgccggggcgcctcgatggcctcgaggtcgcgcgggcgattcgccaccgctcgaccgtcccgatcatcgtgctctctgcgcgcgacaacgaactcgatcgagtcaccggactcgaactcggtgcggacgactacgtcacaaaacccttctcaccgcgcgagctcctcgcgcgggtccgggcgatcgagcgtcgtgtcgaggcgaatccctcgtccgcagcggcgctctcgttcaacggcgtcgactgggacccacgggcgcgtcaggtcctccgtgacggggtgccggttgcgctcacgaaccgggagttcgacctcctcgggtacttctttgcccacccggcgacggcactcacccgccgtgagctgctcgacggggtgtgggggccggagtggtacggggacgaccgaaccgtcgacgtccacgtcctgcagctgcgcaagaagctcggcggcgccatcgccatctcgaccgtctggggtgtcggctaccggttcgaccccgaggagcactagcgtgcgacgacgccgtcgcccgacgatccgaacgacgctccgcgccgggctcgcgaccaccgccgtgacgaccgccctggcagccggcgtcggcacgctgctcatcttccgctccatcgctctgcacgagaacgagagcttcctcgcgcgccaagcgagcgtggcggccaacgtcgcaagccgcgccgagcacttcttcctcggtccccacggcgcccataccttcggcgcgcgcaggttggtgcgcctcgatccgtccggccatctcggcggccccgtcccggccgagctgcacggcgtcgtcctccatccgccacagctcgttcccggtcacgtctccttcgtggtgcgaggtgacaccgtctgggccctcgaccccgtcatcctcgtcgaccgccacgcccaacgcacctacgcggtcgtcctccatcgctcgctcccgtccgagctggtcccagccctcttcgtcgtggcgctgaccttgctggcggcgctcgtggccatcttgctcgccgacgcctacacccgccgcgtctcgtcggtggtggcggacctcgcggcgctcgccgaacgagtcagccgtggcgaccttgcccaggcaccgccgtccgagccgatcgcccagcgagaactcgacgatctgcgacaggcccttgcggagatgatcgcctcgctgcgcagtgcgagcgagcgtcagacatccttcctcctcgccatctcccacgacctgcgcacgccgctcacgagcatccggggcttcgccgaggccatcgaggacggcgaggtggttcagccggcccatgccgcaagcgtcatccaacgcgaggcgcagcgcatcgagcgcctcctggccgacctgatgagcctcgcacgcctcgaggccgatggcttccgcgtcaccgtgacccccctcgatctcggcgatctcgtcgagcaccttgccgagaccgctcgtctgcgcggccgcacccaagggctcgaggtgcacgcgtcgctcgcaccggatgcgcgctccgtgctcggcgacccggagcggctctcgcaggcgctcgccaacatcctcgacaacgccgtcaagttcgcgcgcagctcgatcgacgtgatcgtcacccggcgcttggagagcgtccgcatcgagatcaccgacgacggacccggcatcccgccgtccgtgcgcgaccagctcttcagccgccaggtcgcgccacgcccaggtcgcaacaacgagatcggctctgggctcggcctcttgatcgccgcacgcctcgtccaggccatgcatggtcgcctcggcgcgagctccccgatccgatccgacggcggaacacgcatcgtgctcgaactaccggccgccgtccacgaccgcgtaccctcgcaggtcggctgagccagaggccgacgcttcactcgcaatcgcggccaccagtgcatcggtgagcgttgtaggcgagcctgcgtcgccgcgaccgtggacgaccagatggagcgcggcaagtgcgcccgtgagcgctggcgtgatcggacaggcctcgactgcgcactcgtggccgcctcgatggcgccagtgccacgcgagcgcgcccggcagcgtcgtgtaggccgccccgacggcctcggcggcgacgccaggatcgacccaggcagcatcggcgcgtgccagttccgggcgaccgaggaagtagccctgtccgagctcgatgccgagcgcgcgcgccacctcgaactgggcacgtgtctcgatgccctcgagcacgaccgagcacccctggccctcgccaaggcgcgccacggcatcgagggtcacgatggcctgcaggggattctcaccgagggcagcgaccacgtcgctcgcgaccttcacgagatccaccgacaagctcgcgagccggacgatcccctgaccgctgctcccgacgtcgtcgagtgcccgacgcacgccaagcgctcccagcgcaacgagcgtggcctcgagcgatgagggtgctccggtcgagtcctccaggacctcgatcgtgagccgccacggcgcgaccgcgtagcgctcgaggacccggcggatggtgtcgaccgaactcgggttggcgagcaccgcggtcggtgcgttgaccccgatcgcgaggtcggggcgcaggcagttcgccgccaggccgactgcgtcatcgaggacccgctcgaagagctcgccgagctcggcagcggagagaaagggcaggaactccgccggcgaccagagtcgacctcggccatcgtcgagccgtgcgagcgcttcgagcccgatgacactcgcgtcgccgaggcgaacaatcggctggagtgcgagccgtacgcctccaccacgcagacgcgtgaggatctcacgccggccaagcgtcgagtgatacccacgacggagcaacgcgatacggtcgcagatcgcctcgacgagccgaccgagcaagggttctgtcgcatcgggtgcgacctcgaccgcgaccacgagcccccagacgctcgagtcctcgcgtcggcacacgatcgccccgtcgccgacgacctgctcgtccacgccgatgacgcgccgcgccagcggtcccgacggctcctccagcgcggcgacgagcgcggctcgctcgcgcccagcgcttcctcgaacgcgcaaccgacccgccccggtgacctcgacgagcgccgcgccatggactccggcgagcccgcccgcgacgtcgacctcctcgaggaccgacccgagcggtcgaccgtcgaggccgtcgagcgcctcggaccagcgggccctcagcacccgacggcgagcaccggcgacgttgagaccggtctcgagtcgcgccatggcgatgcgggtcgacggcggtacgtcagcgagctcggccacggcgccgccaccccatctcgccaccgccctcgctgccgccgccggaccgtcgacgagcgcgtcgagcacctcgtcggggagcgcgcctccgagcgcgacccgccacgaagggtcctccgcgagctccgccgtggcttcggggccccacggatccacgatggcactgcgggcgtcgctcgctcctgcacctcggacactccgggcgcgcttcgcctcgtacatcgtggcatcggccacgcggagcagccccgcgagatcgccggcgtcccgcggccaccaggaccatccgacgctcgccccgatcgtcaccgcaaggccggcctcgagctccacgggtcgccggagggcacggccgatgcgctgtgcgagatcgcgtgccgccgcctcgtccatcgcaagcgctgcgaggatgacgaactcgtcgccaccgaagcgtgccaccagtgccgacggcagccggcgcgcgacctcaccggccacacgcctcgccgcctcgatgaggacctgatcgccgacgacgtgaccaaaggagtcgttcacctccttgaagtcatccaggtcgatgagcatgcacacgaccgcacccacactcgcatcgctcgtcaggcgaacgagccgctcggtgagcgccatccggttcgcgaggccggtgagtggatcccgcctggcgatcgacctcgcctcggcttcggcacggcgcagtcgatccacgagtgcgaactctgcgacctcgcggtcgatggcgccacggatgcgaggctcgaacggcgcgagccaagcgcgacggcgtggatcgtcggcgacgacctcgagaccgtcgccgtcccttccctgcagcacccgcacgcccggcacgcggccgaggatgcccgccgccgcttccaggaaggctccgacgctctgggcaccctcggcggcaccagcgagctccgcgagcgcgcgctcgagcgcctcccgccaggcgagttcggcctggtagcgctcggagtctcgcacgaagcgctgcgtgacgagcgccgacgcacccaccagcacgacgatggcagccacgagtgcgctcatgggtccgctcgcggcgtcgaggacgctcgttcgggcagtgaactccacctcgaccggcccgagcgcactcgcaacctgtacgtgcatcgtggccgcagtggcacgatcgaacacgcgcacgcccccgatcgcaaggctcaccgccctgacgccggtctgtgccggggctgcgacctgcaacgttcccggcgcgacaagggcctcgacgaggtagtcgacctgcgcacttcggcgtgcatggatcgcaacggcgatctcgaacccgttggacacacgaaccaacctcgtccccgacgcgccgacggcgacaggatcgaccgcacgcccggcccgccaccagatggatcctccgtgcggggccacgaccgcgatcccctcgatggctgattgacgggcgacgaaggcctcgagcaccggcaccatggtcgccggcaacgacgcgagcgtcggacgaggcccgatgagcaccgtcccgacggtgtcgagatcggcgacgacgaggtcggctcgcaccgcgacgcgccgagcccacgcccgtgcaacggcgttcgcaagcgctcgctccgacgacacactggacgcgtccacacgccgcaaccacgaggccccgacggtgagcgcgaggaggagcggcatccagatggcggcgaggacgacgagacgccaccgtccccgcagccgccatgtcataccgagagtgatcgaccaaccaggtcgcagagttgaggcgcctagcctgggagcatggacgccacgacggtcgccacagcctcggggccgagcgacgcctcggggcccagcgacgcgttcaccgcacccttcgttcgggtccaggtcaccggtcgggatgcggctcgctacctccagggtcagctgtcccaggacgtctcgaccctgaaggcggacggccagggggcgatcagcgtgctcctcggcgtcgatggccacctcgtgacctggctcagggtacgtcgcctcgccgacgatgccttctggctcgtcgtcgccgaggcgcatggcgaacgcgtccgccaacgcctcgagcacttccgcatccgcacccaggccaccatcgagctcctccctggccacctccacgttcggcctccagagggcctcgagcctctctggcccctcgaccaggacgcaccgttcgtcgacgcgcccgccgacctcgcccgcttccacgccgaacgcctcgtggccggcgccttcgatcctgcgagcgatctcgtcgacggtctgctcgcccacggagtacccacactcgtcgagcgtgcagtgagcttcaccaagggctgctacaccggtcaagagctcgtcgcacgcacgtcctcgcgaggagcgccggccccgatcggcctcgtcgcactcgagctggccgagccgatcgccgtcgctcccggtacggcgctcgtcgtcggcggtgtcgacgccggagcgatcacgagtgccgcggtggtcggcgaccgtggctacgccgtcgcctaccggcgccggcgcgcgcgcgagcacacgcacttcgacgtcggcggcgtcggtgcgacggtgcgatcgtccgcaccctagcgaggctcacacgaaccgctcagagccgcagacctctgcccgtgacgctgcctcgcacagtggcgagggtcgatcgcgcgctcaccgctgaccacagctcgccccaggggacctcgtgtgacgacggcgttcagacctcgatgaggcgatcggcgacggcgactgcccgggccaccgccgctgccttcgccacgcactcggtcgcctcccgttccgggtccgagcctgcgacgatgccggccccagcctgcaggagcacccgaccgttctcgagccagacggcggtacgaatcgcgatcgcgaagtccatcaccgcgctctcggggtcggtgccatcgcgaccgacgtagccgacgacgccgccgtagaccacgcgtcgcttggactcgagctcgtcgatcagctgcatcgcgcgcaccttcggggcacctgacagcgtgcccgccgggagggtcgccgcgagcgcgtcgatcgggccgacgccgtcggtcagctgaccatggacgctcgaggtgagatggatcacgcgcgcgaagcgctcgggcaccatgaactcatcgaccacgacgctcccgaagcgtgccacacggccgacgtcattgcgggcgagatcgaccagcatcaggtgttcggccctttccttcgggtcggcgagcagctcctcgatgagagcctcgtcgctcgccccacccgaaccccgcggccgggaaccggcgatcggtcgcgtccagacgacgccgtcgcgcaccgtcgcgagggcctcgggcgaggagccaacgatcgcacccccggcgtccgtgatgagatacatgtacggcgacgggttggtgaggcgcagcgctcgatagagcgcgagagggttcgcccgggtcgtgagctcgaagcgatgcgacagcaccacctggaacacctcgccctcgtcgatcgcctgcttcgcgagccggacggcgtgcgcgaacggctcccgaaacccttgatcgagcagcgccaccccctcgctgggatcgtcaccaagtggccaggcacgcaccggtcgcccgacggccgactcgaggtcggcctcgagacgactgagcgccgccctcgccgctgccgcggccccgacgggatcgtcctccacgagcagcgccgacgagagcgtgagcgactgcgcccagtgatcgatcacggcgaggtcacccgcgaggaggagccgcgcctccggcaggccgacgtcgtccgggtgcgaactcggcacgctcggctcgcgctctcggaccgcctcgtagccgacgtggccgacgaacgctgccgagaacggtccggccatcgggcacccgtcgtcgacggcgtcgacctcgagcccctccgaccaccgacgcagcccatcgagaatgcccggtgcctcgtcgaggaccgagccgtcggcagcctcgagtcgggcgtggccgacctcgccgatgacgcgcgccaagggccgacgcccgacgaccgagtaacgcgaccagcgaccctgctggtcgaccgactcgaggatgaagcccgcctcgccgggcgccaccaaccgctcgaacacctcgatgggtgtgagtgcgtcggcgacgtagcgggcccggacctgaacgagacgcagcctcacgactgccccagcaccggatgcatgaagcaactccacgcgcccgtgtggcacgcaccgaccccacgctgacgcacgcgcacgaggagcgcgtcaccgtcgcagtcggtggtgacggagcgaacctcttgcacggcgcccgaggtctccccctttgcccagtaggtccgccgtgatcgcgagtagaaccacgtccgtccgtcacgaagggttcgtcggagcgcctccgcgtccatgtaggcgagcatcaggacctggtcgtcctcgtcgacgacgaccgccgggacgagtccatcgggaccgaaggcgacgacgtccacggagaccgcctcgcctggggcaaccccctcgatatcgctcacaggtacaaccccgtctcgtcgtcgagccgatcggaggccaccgcgtggagatcccgctcgcgcaagatcacgtaggtctccgagccgatctccacctcgtaacgatcctcgggcgcgaacagcacgagatcacccggacgcaccgagcgcaccgccggaccgaccgcgctcacctctgaccacacgagacgtttggcgatctgcgcggtcgcggggatcacgatgcccgagcgcgcgtggcgctccccctccgacggagggacgctgaccaggacacggtcggccaacatcgtgatcgcagccttcttgggctccaccgccacctcccgttgcaccacgctagccgccgatggggcgcacgacgagacccgccgcgtcgagcgcggccttgacctgagcgacgctgagttcgccgtagtggaacacgctggcggccagcaggcccgtgacgccggtccgcgcgccgtcgacgaagtgttcgacgatcccgacgccacccgacgcgatgacgggcaagctcgtgcacgacagcaccagctcgtagaggtcggtgtcgtagcccgcacgcgtgccgtcgcgatccatggaggtcacgaggagctcgccggcgccggcatccgaaacccgccggacccacgtctcgacgtcgagaccggtggggcgacgcccgccgtgggtacgcacttcccagtcgcccgcgcccgtacgagcagcgtcgatggccaccacggcacattgggacccgtagcgaccggcgaccgcctcgacgaggccgagatcggcgaccgccgccgaattcatcgacaccttatcggctccagcctcgagcaacgcggccacgtcgccgagcacacggacaccgccgcccacggtgaaagggatgaagactcgtgacgcgacacgctcgacgagatcaacgagcgtcgagcgctcctcgatcgaggcggtgatgtcaaggaacaccagctcgtcggcgccctcggcgacgtagcgctcggcgagctcgacaggatctcccgcgtcacgcagctcgacgaaactgacgcccttgacgaccctaccctcggcgacgtcgagacaggggatcaccctcacgctctgcatgcgctgagtgcctcgtcgaacccgagcgagccatcgaggagcgcagtcccgacgacggccccccacacggcccctcgtgcccctcggatcgccgcgagctttgccaggtcgtcagcggaggcgaccccgcctgaggcgatcacctcgaccggcacgacctcgcacagcccctgataggtaccgagatccggtccgctcgccatgccgtcgcgtccgacgtcggtcaggagctgggtccgtacgccgcgtgcgaacagtcgagcggacgcctcgaggagccgccgaccaccagagcgttcccatgcgctcacgacgacctcgagcgccccttcgtcgccacgccgatagtcgagcgccgcgaccagatgctccggatcgagctcgtcgagcgtctcctcgacgagtgccgtcccgagcaccacgcgcgacgcgcccgtctccagcagttcggcgatgtccctggccgtacgcacgccgccaccgacctcgaccgacccgccggcctcgcgcacgagcgcgatcaggtcgccgaccatgtcggcgttacgacggtcgccgggcgtgcgggcacgatcgaggtccaccacgtggaaccaccgcgcgcctgcgtcgagggcgccctcgacgtagcggcgaggatcgccgaaacgccgcggcgcatcgaaccggccctgccgcagccggacagcctctccgtcgagcagatcgacggcgaccacgagttccacgcctaacactcctcctggacccatcgccacagcgcatcgaggaagcgcagacccttcgcccccgagcgctcggggtggaactgcacaccgagcagcgcatcgcgaccggcggcggcgacccaggtgccaccgaactcctcgaaggcaagcgccgcaggcgtcgtcgcgacggcgtaactgtggacgaagtacacccacgcaccctcgaggaccgccagtggccccgaggccccctccgccactcgcaaccggttccactgcatctccggcagacggggcgcagggctcatgcgctcgacccagccgggcaagagaccaagtcccacacgatcgggcgcctcgtcgccgccgtcgaagagcgcctgcatgcccacgcagacgcccaaggtcgccatgccgcgctcgcgacggcgcaccatcgcctcgtcgagaccggtcgccgcgagagcgtcgagcacgctgccgaggtgaccgacgccgggcacgacgagcagccgcgcctcgtcgaaatcggctcggtcgctcccccgcctgaccggatggccgagtgcccgccacgcccccacggcagccccgatgttgccgataccgatgtcggcaacaacgatggcagcgctcacaaggagcccttggtggagggaatctcgccgcccccgctgacggccgtcgcctgggcgagtgcccggccgagcgccttggccatcgcctcgatctggtggtgggtgttcgcgccccgaatcgaccggacgtgcagcgtcaagcggccgcctcgagccagaccccacaggaactcctcgacgtgctcgagcgcgacccccgggctgcccaggaggagcccacgctcgccctcgagggcgacccatgcgccgggcctcccggacaggtcgacgacgacctcgacgagcgtctcgtcgagcgggatggtggcagccccgaagcgctcgatgccgcgtcgctcaccgagtgccccatcgagcgcctgaccgagcgcgatgccgaggtcctcggtgaggtggtgggcgtccacctcgacgtcgccgcgtgctgcgacctcgaggccaatcctcccgtggcgcgcgatctgggtcaggacgtggtcgaagaagggcagccccgtcgacacgtcctcgcgtgggcccccgtcgagctcgagccgtacccggatgagcgtctcgcgagtctcgcgatcgatgatccccacacgcccactcacgcgagcacctccccgagtgcagcgaggaacgcatcgttctcgtccgcggtgccgatcgtgacccgaagcgtgttggagagcccgggccagcgcgacgcatcgcggatgaggatccctttcgccacgagtccctcccatacctcggtcgcaggccgacccggatcgaacaagatgaagttggtcgcactcggccacacgcgcgcagcgagcgtgccgagggcctggccgactcgctcgcgttctcgaacgacgagggctgcgcgtcgtgcgatctcgtccacatcggccagcgcagcgacggcgaccgcctgcgtcaccgcgttcacgtgatacggcaggcacgccgaccagagcacgtcggcgacctcgggcgcacagacggcataacccagccggagtcccgcaagcccggcggccttcgagagcgtacggatccgcaccacgtgatccccaagcagggtcgcagggccgagatcggcgaagtcggcgtaggcctcgtccacgagcaccagccgatcgtcgcaggccaggacgcggtccatcacctcgggcggctcgagcatccccgtcgggttgttcggctggcacacgatcacgagctccgagtcggcctccagactcgacggatcaatcgacccgtcggatcggcgcgcaccggcgaccaccgtggtgcgcgtcacacgggcgatctggcggtacatgccataggtcggctccgcgagccacaggcgtcgaccgggcccaccccaggccgcgagcacggtctcgagcacctcgttcgacccgttcgcgacgaagatcgaggtcggcgcgacaccgtggagcctgccgagcgcagcgcgcagcgcctcggcgcgccgatcgggatagcgcgccagatcgagcgcgaccgcctcctcgagcgccctcgcgacggcgggcggcggaccatacggcgactcgttggtgttgaggcgaaccctggcgggaacctgggccgagtggtagctcgcccccagcgcatcctcgagcgacggagccggcctcaccatccggcctcccgacggatgcggatcgagtccgcgtgcgcgacgagcccctctgcgtcggcgagcgcctcgacggcccagcccagccgactgagcgcctcgtcgtggacctcgacgacgtggaggcgacgctggaagtcttcgaggccgagcacgctcgcaaaacgcgccgtcccagccgtcggcaggacgtgtgaggggccggccacgtagtccccgaacgcggcactggctgctcgtccgacgaagaccacaccggcgtggcggacccgatcagcgtcccgaaccgcctggtcgtagagcagctcgaggtgctcaggcgcgatcgcgtcggccaccaggcgagcttgatcccggtcgcgcacgagcgcgagatagccgtgcgcctcgagcgtgctctcgagctgggcgcgcctgggactcgcctccacgtaggccgcgagctcttcgagcacctgctcggcccagcgggcgtcccaggtcacgagccaggccaggccatgggggccgtgctcggcctggaccgcgacgtcgatcgccgcgacgcgcggctcaagggagccgtccgcgaccacgaccacctccgaggggccggcgaaggcacccggcacaccgacgtcggccgcgacctcttgcttggccagcgagacgaagaggttgcccggacccacgatgacgtcgacacgctcgagcgactccgtgccataggcgagcgccgcgaccgcctgcgcgccaccggcgagcagcacggtgtcgaccccggccagatgacaggcggcgagcgtcgcgtcgtcgaggccaccgtcgggcaacggcggtgtggcgacgacgacatcgcgtacgcccgcaacccgagccaccgtcgcggtgtgcacgacgcttgagggatagcgagcctgtcccccgggcacgtagcagccggctcgctccaccgggacgatcctgcggcgcacctcgatgccgtcggccaccagcgacgacgccgccgggcgctcggcctcgtaggcctcgcgcacgcgatcgcgagcgacccgcaacgcctcggccagccgccgatcgaggcgctcgtaggcggcggccatcgcctcgcgaccgaggacgagcgctcgcggccgcacgccgtcgaagcgctccgtcagatccgccagggccccgtccccacccgtgcgcacactctggacgatctcacgcacgagtgcccgtggcccttccaccggcaacgccaccccgggaagatcgtcgcgccgcagggcgccagtcgtctcgcgaagatcgacaagggtcagcgatgccatgggactcctcggacagcagggcagctcagcggcgctagtctaccggcggcgaccgcgacgaggaacgtggcgaccgtaacggaggaacgctgtggccgaggctcacgagctcgcctcgatcgcgagcacctacgaggagctcgctcgacgcatcgaggccatcgagcgctcgctgctcgccgaccatcgagacgggccggcccagtcgctgcgggccgcgtgggcactgaaccgagccctcctgcgcgaactcgatgaggcgcgtcgccgtctcgagagctgatgcgggtcccagccctcgctacgttcgcggcaaccttcgcgtaacgtacccctggtagtcttcgctccatgacccacctcatcgaaacgtggggcgtgctcgcggtcttcgcgctctcggtcgcacagtcgctcggcgtacccacctcctctgagctcaccttcggcctcgtcggcctcctctgggccctcggacggatgaaccccgtggcgggcatcgccgccggtgtcatcggcgaactcatcggagcgatcgtcgcctggtggcttgccgccgctgcggtcgagtctcactggtgggcgcgcttcgaggcgcacccgctcgtggccgcctttcgtggtgtgctcacctccctccttcgccgccgcttcggcgtgctgatctcgcgcctcatccccctcgagcgcaacgtcgcagcctgggcggctggcgtcgccgaggtctcgctcggtgcgctcgccctccagagtgtcgtcggatcggcgatcttcgccaccgcgtttgccctggccggctacgaggccaaggacgcgatcaccaccatcgcgcaccgagccggccagatcggcgaggtcgtcgcggtcattctcgtcgtcggcgtcgtgctcgccatccgtcagatggcccatcgtcaactcgggcgcagccgcgcagctcgctccggccacgcggccacccaacccgacgccaccgcacccgacaccaccgccaccgaggatcgactcgtcctccagctgctgccgtcggagccactctcgtcggccgcctacctcgacgcgctcggccggatccatcagaccgaaccgccatctccggacgtctccgccgacgagggccgccgcgccccacggcgcgatctcccgacctcaggtagccgctagcgagcgcctccccgccccagacccacgccggacggctctcggtgccgaccggcacccacacgccaacggaccgacttgcgccacgtgcgggcgcgtcatcggcgctgcaggcacccgaggagtcgagcacgcccatcggtgagcgccatgtcccaggaccgtgcgtagcgacccgtggcaccgcggacctcccgttccgcacggcccctcgctgcagcagcgcccctagacgccctcggccggcgcgaagaacccgtcgcccaccgcctggagcttgatcaggttcgtcgttccacgcacaccgaacgggatgcccgccacgatgacgacgagttcgccgacctcggcgagacctcgctcgacagccgccgcgagcgcctcgtgcaccatcagctcggtcgacggcgtcctcgccacgacgtgcgggatgacaccccagctcagtgtcagcgaccgcgcagcgcgcggatcgggggtcgcgccgaggatcgccaccgctggacggaagcgcgccagcacccgagcactgtgtcccgactcggtgagggccaccaccgcacgcaccgggacggatcgagtcatccgcgtggcggcctctccgatcgcatcggcgacggagtgggccacaggcgagggcctcgtgagcagcgtgagcgcctggttgtccacctcgcgctcggtcgcacgcgcgatgcgatccatggtggcgatggcctcgaccggaaaggccccaacggccgtctcggccgacagcatcagtgcgtccgagccatcgagaatcgcgttggcgacgtcggatgcctcggccctcgtcggcgaccccgcctcgatcatcgactcgagcatctgggtcgcagtgatcaccggcttgccggcttcgttggccaggtggatgatctgcttctgcaggagtgggatccgctcgacgggcatctcgactccgagatcgccgcgggcgaccatcacggcgtccgaggcagcgacgatctcgccgatgcgctggatcgcctccttgcgctcgatcttcgcaacgagcatcacgcggctcgccgcgcccgcgcggtcgatctggcgtcgagcaacctcgaggtccgaggccgagcccacgaacgacagcgcgatgaagtcgacgcccgcctccagcccaaaggcgatgtcggcgaagtcgtcttcggtgagtgcgggcagctccagatacgaatccgggaagttcacgcccttgcggaccgacagtggccccccctggacgaccgtggcctccacccagccgtcctccgagcggtcgaccacgaggcggaccgcgccgtcagcgaaggcgatcgtcgcccctgggggcacggtatggaggatgccgagccgactgatgtgaatcgcggcgtggcgggcgctcccctcctcggcgatctggacgacctcgccgggctggagctgtgtcgcgtcgtcggccagcgactcgatccgaagcttcggtccggcgagatcgagcagcacgccgaccgtcttgccggtccgagcagcggcttgacgaacgagctcgatcgagcgggcatggtctgcggtgctgccgtgtgagcagttgatccgcgcgacatccatgccagcctcgatcatcgccgtcaaggtcccgaggttcgatgaagccggaccaatactcgcaacgatcttcgtgcgccggtgctcgcgcatgcgcctcctctctcgtcgaggtcaggctacgtgccggcgctgccgagctcgacgagtccgcgcgcgacgtgctcgagaaagcgccgaatcgtcgcgtcggcgacccgatagaggagcgtctggtcgatgagcagaccggtccgtccgagcggcggtcgatagctcccctcgagccagagctgacagagctcggggccaaccttcgaaaccccgagcaggccgtcgagccgcggaaagagccacggagcttgcgcgccctcccacgtcatcggaagctggagttcgtcgtcaccgaggcgccgtgggctcgcgatccgaaacgccaccggcgtgcgcaagagtccagcccgaagaccgagcaccgcgcgcagaccggcgtcatcggccgtcacctcgctcgcgagatcaccgagccactcggcactctggcgcgacagcagcggggcagcgacctcgaacggcaacggcagctcgacgaagtcgcggacgaagcgcaccgggaccgacccgtcgtgctctcgctcctcggcctccacgctgtcctccacgaactccatgccctccgtgcgtgaaccgcccgaggggctcacccacctctcgtctctaggctacgcgcgccacgcatctaggccaaggagtacgcctcacggtgtgacactggtccctagccggtggggtcggacgaccgtgctgcggccggcggaacggatgccaggaccatcgcagcgagcgcgagaagtccaccgaccaccaccggtaggcccagggatgcatacccgaaggccagcgacgcgagcgcggcgaacagcggttcggccgcatagatcacggagatctgcacgctgtcggcgtgagcgagcgcccaggcttggaccacgaaggcgagtgcgctcgcgagcaccccatcgtagacgatggccgtcaccgcgatcggcgtgaggtgcgtcggcacgagacccgcacccacgagcggtgccgcgaccacggtcgcggccgcgatcgtcgtcatctgcagtgccgctgtcaccatcgcatcaccgggagacccgagctcctcgagcacgacgatctgagccccgaagaagccggcgcacgcgagttcgaggccgatcccgacgaacgacgcatgccctcgtggggccgagagcaccacgagggcgagggccgcgaggacgataccgacgagctgacgagcgctcggacgtcgaccgagcgccatcacgaagatcggcacaaccaccaccgacaagcccgtcagaaaccccgcgatggtcggtgacacgtagcgttgaccctcgatctgagtgaggtagccgccaaagagcgcgaggccgctcgccaggccggcaacgacgctccgtcgatcgatgcgatggccccgtgcgagcgccagcacccacagcacgagcgccgcgacgctgaagcgtccgaaggtgagctcgaccgggccgagactcccgagtgcgcgctcgttcagcggaaaggtgactccccagatcgccgtgacccccacgacggcccacgaggcacggccccttgccggactcctcacatcgtctccggtagcatggcggcccaatggccctcgagcagcacagtcctcgcctcacccgaccactcgtcctcgccgagtcggtcgcctacctcctgatcggcctcgtcctcgtcgtcatgagcgccgagacgctgtggcaactcgcgcgcgccgtgttcgtcgacgtctcgctcaacggcgacgtcaccgcccagctcgtcggcgccctgaacgacgcgctcttcgtcatcattctgctcgagctgctctcgagtgtgatcagccaccttcgcaagggaggtctgcagcttcgccccttcctcgtgatcggcatcgtgtcatccgtacggcgtatcttggtcctcggcgcgcagctctcgatctcccgaacccatggcgcgcagacccgctcgagcctcgaggagcttgccctcgacgcaggggtcgtcttgatcctgaccgcggctctgtggctcagtcgagttcgtccgcagcgccgacgggctcgacgagtacgggcttcctggcagcgcccacctcgtcgagacgcctgaccggcgtcgtccggggcgcctcggcgagctcggccggcgtcgtccgcgcgatctcgacgagccgctcgaacgcctgcgcgagcgcctcgagcgtctccggagactcggtttcggtcggctcgatcatgagcgcctcgtcgacgatgagcggaaagtagacggtcggggcgtggaacccgaactcgagcagacccttggcgatgtcggaggcacgcacgccggcctcgctgcgaaactccttggcgctcgccacgaactcgtgcatgcacggctcgtcgaaagccgcgggcaacacgggctgaaggcgctgctggagccacctggcgttcaagacggcgacttcactcatgcgacggaggccatccgggccgtggtagcgcatgaaggcccaggcacgagcgagcaccagtgcgttgccgtggaacgcgtgcacgttgccgatggacgacggtggcgtccaccactcgagctgccccgttgcgccagggcgaggcagcggaccaggcaggaacgcctcgagggcgctcgtcaccgcgacgggacccgccccaggaccaccgccgccgtgcggggtggcgaaggtcttgtggaggttggagtgcacgatgtcgaaacccatgtctccgggtcgcgcgacaccgacgatcgcgttcagattggcgccgtcgtagtaggcgagcgcgccgacctcgtgcacgagccgcaagatctcggcgacgtcacgctcgaacagccccagcgtgttcgggttggtcaacatgatgccggcgacggagtcgtcgagcacgcgtcgcaggtcgtcgagcgagaccaagcctcgcgcatcggagcgaaccgtcacggcctcgtagccggccaaggtcaccgaggccggattcgtcccgtgcgccgagtcggggatgatgatccgtcgggggtctcgccccgaagcccggtggtaggcgcccatgatcagcagaccagtgagctcaccggcggcacccgccggtggctgcagggtcgccgccgccatgccggtgatctcgcaaatcgcagcctcgagctcggcgagcagttccaaccaaccctggacggcacgctcgggtgtgtcagggtgcaccccggcgagccctgggagggccgcgacctcgtcggcgaacttcgggttgtacttcatcgtgcacgaccccaacggataggcccccaggtcgaccgagtagttgcgagaggccagtctcgtgtagtgggcgacgaggtcacgctccgatacctcagggagcgcggccggctcgcgacggagccacggaccgagctcctcgagcgacgcctccgggatcgcactgtgacgcagcgtgtcggctcggcggccccggaccgacaactcgaacgccgtcggctcggcatcacgtccgacgagcggggcggacgctgcacgaccgcctgggcgcgcacctcgggtcgacacctagcggacctcctttgcgatccgatcgacgaacgcgtcgatctcctctcgagtccgtgcctccgtcgcggtgagcacgagccaggtcggctcctcggggaccaggacaccggccagccaaccatcctcgaggagccgctcgcggaccggccgcgcctccacctcgagatcgacgacgaactcacgaacgaacggccggccgagcaccgagagtcccgcggcctcgagtcggtcagcgaggtagtgcgcggcgttgtagcacgagcgggcgagctcgaccatgccttgcttgccgcgccacgccaggtagacgcccgcccagatcgcgagcagcgtctggttcgtgcacacgttggacgtcgccctctcacgccggatatcctgctcgcgggtgcgcaacgtggtcacgaagccgcgccgaccctcgacgtcgaccgtctgaccgacgaggcggcccggcacgagccgcaccagctcgctccgggtggcaaacagcccgaggtagggcccgccgaacgagagcgggatgccgaggctctgtccctcggcgaccacgacgtcggcgccgaagctgcccggcggctcgagcaaggcgcacgcgacggggtcggcaacgaccaccaggagtgcctccatggcgtcggcgacccgacgcgcctcccgcaggtcctccacccgcccgagcgcgttcggatagccgatgacgagcgccgaagcctcggcgtcgaccgctgcgaggtcggtcgccagatcgtcacggagacccacgctgacgagctcgagtcctcgcccgcggcccaaggtggccagtgcgccccgatagcggggatgaatgccctgcgacacgacgatacggttccgcttggtggccccgaccgcgaggttgacggcctcgaccaccgcagcggcgccatcgtagagcgaggcgttggcgaggtccatgccgaagaggcgcgcaatcgaggtctggaactcgaacagcgcttggagcactccctgagagacctccggctggtacggggtgtaggccgtcacgaaggcactctggagcgcgagcgctcgcacggcactcggcacgtcgtggtcgtaggccccgccgccggcgaacaccacgaggtcgcgtcgagcgccagcgttccggcgcgagcgccgttccgcctcctcgagcacctcgacctcggccagggccgggggtagttccagcggtcgccccaagcggagcgacgcggggatcgatgcgtagagctcctcgagcgacgccaaccccacctcggccagcatgcgctcgatctgcgcctcggtgtgcggtacgaaactccccacgaccacctcctcaatgatcacgaacgcaggtcgacgaacgggacggctgcacgctcgaggtccaacgacccgcgagcacgaaccgcccggaacggccctgccgcggcctccgggtcgacgtaggcgaggccgatgccgacgcccgcgagcggcgagtacccacccgacgaaatcgagccgacggccgtcgaggcggcatcgacgaggacgtcgtgggcgcgtggaggctgtctcgtcagcgagcgaacgccgatcagaatcgggttgacacccgcggcctgctgggcgagcaacgcctcacgaccagggaagggccccttctcaaacgcgacgacccagccgaggcccgcgttcagcggcgtgaggccaggtccgagctcgttgccgtgcagcggcaggccagcctcgagccgcagcgagtcgcgcgcacccaacccgcaggcgacggcccctcgctcgagcagccgttccatcaacgccaccgcatcgtcaggggcgacctcgagctccacgcctgggccacctgtgtagcccgtgcccgcgacccgcacctcgatgtcgccgatgcggcctgtcacgatgcgattgcgcgccggcggctctgctccctcgaggagagggccgagcagggccgcagcaccaggcccctggagcgcgaggatgcatcgcgagcgagtgatgtcacgaccgccgagtgcggcggtcacgttctccgtattggccgcgttcggcatcacgtggaatcgctcgcgatcgacccaccacacgatgatgtcgtcgagcaccgatccatcgacgtcgagcaggtgcgtgtactgcgctcgctgcggaccgatcttgcgcagatcgttcgtcagcgtcgcttgaagccggtcgaacgcgtcgggtccctcgacgacgaccgtaccgagatgggagacgtcgaacactccgacgccggtgcgcaccgcgaggtgttcggcgatcgtcccgctggggtaggaaactggcatctcccaaccaccaaagagcgtgaatcgagccccaaggtcgcggtggaggtcatagagcgcggtgcgttcgggcaccccgccatgctaccgctgagcgcggacgtggcgctcagacgcccggccgagccgagacgatcggcagctcgatccgttcggcgtcttcggtcctcgagagccgcagtcgctcgcccatcgggtcgatctcgagccccacgtgggcatgatcggcgcaccacgcctggagcacctcgagcacgctcgtccccggatcctgcgcgacgatcgttgcgctcatcccgggcgtggcgaccggctcgtaggcgatcaacacggacccacccatgaccaacacgctgagcagcatcgcctcgggcacctcggcgaaggcgagccacgcctggtgcgccatgtactgctgggcccgccgacgtcggatgccctccatgaaccgccgatgccgccgccacccgatgaggaacgccgtgatcccgagcccgagcacgagcgacgggaacaccaccaacgccagcgtcgacccctgaggcacacttctagtgtacgacctcaccacgcgccgagcacgagcggccaggctcgatagcatgagcccatgcctcgctcgctgcggcgcgccgttcccactctgatcacgctcgcacgagcggcgttgttgatcccgttctggcgtctcgccgtcgacgagcaccgcacgggagccgccgccgtcgtcgccgtcaccatcggggcgaccgacttcctcgacggctacagcgctcgtcacctcgacgccgtcaccaccgtcggcaaggtgctcgatcccacgctcgaccgagtcgcactgctggtgagctggctcgtcgcactcgaggagcacctcttgccgacctggttgctgtggttgatcctgcttcgggaggtcgccgtcagcgccgtcacgctcacgtcgctcgtgcgcacgcatcgacgccaagacgtcgtcttcgtcggcaaggcgggtaccttcggcctcctcgctgccttcccgctggcgctgattgcgcgcgccacacgcctcgacatcttggccaagggagccaccctcatcgccaccgtcgccctcgcactcctcaccgttgccctgatgcgctacgccacccagctccgagacgacctcgataggctgtcgcgcgaagcaccacctgcttcgtaacgaggcacccccaccagagcgaacccgggaggcgcaccgtgcaggctgtcatcatcgccggaggcgagggaacccgccttcggcccctcacctcgaccactccgaagccgctgctcccggtcgcgaaccggcccatgatcgcccgcgtcgtcgacctcctcgtcgccaatggcattgacgacatcatcgtcaccgtggcctacctgggctcggccattcgcacctatctcggcgacggcaccgactggggagcgcgtatccgctacctccaggaggagtcgccgctcgggaccgcaggcgcggtccgcaacgccagacacctcctcgaggacaccttcatcgtgctctctggcgacgtcgtgacgaccgtggatctcgaggccgcgcgacgcttccaccacgaacggggcgccagtgcgaccatggtcctcaccaccgtccccgatcccaccgagttcggcgtcgtcgcgaccgaagacagcggagcggtcaccaggctcatcgagaagccgtcgtggggcgaggtcttcacggacacggtgaacaccggcgtctacatcctcgaaccgtccgtcctcgatcgcatccccgccaaccgtgcggtggacttctccgaggaggtgttcccgcagatcctcgacgaccgcggagcgctgtttggctacgtggccgacggctattgggccgacgtcggcaccttctcgggatttcaccagacccaccacgacgtgctcgacgggcgtgccggcatcgctccctcgggcttcgaactggctcccggcgtctacgtcggtgaccgctcgacgatcgacccctcggcactcttggaggcgccgtgcatcgtcggcaacgacgttcgcatcggccccgggtcgaggctcggcccctacaccgtggttggccacggcgtgcgggtggggtccgacgtccatcttgacggcaccatcgtcttcgaccacgcatggatcgccgacggggcacgtctcggccgcgcgatcgtcggccgcggcgtcgacatccgccgccgggtcaacgtacacgatggcgcagtgctcgccgacggcgtcctcgtcggacgcgacgcggtggtgcgagccgacattcgggtgtatccgggcaaaacggtcgatccgctcgccacggtcgccaactccatcgtctgggagagtggcgcgagtcggacggtgttcgggccgctcggcatctccggcctcgccaacgtcgacatcaacccagagatggcgacacggatcgcgatggcgctcgcatcgcagctcccccccaacggcgcagtcctcgcggcacgcgacacctcacgggccgcacgcatcatcaagcgcgcgatgatggtcgggttcaacgccgtcgggctcgacgtctgggacctcgaggcaacgaccaccccggtcctccgtcacgccgtggccgccaccgatgcggtcgccggggtacgagtcgccctcgacgccgacgatccccaagccctgaccatcgagctcctcggggccgaaggcgccgacctcgtcgcgaccgagcgacgcaaggtggagcgcgcgctcgagcgcgaggagtttcgcagggtctccgcgagcgagatcggcgatctcgtcatggtctcccacgcgaccgaccgatggaaggcagcggtgaccgccctgctcgacatcgagcggattcgggagcgcgccttcaagctggtcctcgactactcgtacggcgtcgtggcgtcgagccttccgcaagcgatcgcgtcgttccacgcggacgttctcgccacccacgcctacccctcgaccgcacgcctcatacgacttcgactggaggagcagatcgccgaactcggccgtctggttcgaggcgccaaggccgacctcggtgcgatcgtgaacgccggcggcgaacggctgctgctcaccgatgcgcgcggtcgcgtcgtcccgatcgccggtatcgccaccatcctcgccgagcacctggtcgcgaccgggaaggtccggcggctcgtggcgagcgcggccgtcgcgagttcggtcgccgacaccgctcgcgccctcggcatcgagttcgcatggtgcgggctctcgcgagctgatctcgccgccgccgtcgccgatgcaccaggaacgctcgccatcggccacagcggcctcgtgttctactccggatgcgcgagctcgtcggacgcagccgtcaccctcggactcatcttggaggccctcgccaccaccggaaccgatctcgcccatgtcatcgaccgcacgcccgccgagacgacggtggccgaggcggtacccgtcccgtacgcggtcctcggtgcgacgatgcgggggctgcgcaccttcgccgaggagcaggggccggtcgagctcgtcgcgaccgatggccttcgagcgcagttccaggaccgattctggctcctctcgcccgacccccaagaaccggtcgtgaccgtcatcgtgggtgcggccgaccccgaggtggccaaggacgatctcgcggtcctgcgcaccgctgtcgcggcgcgtcgcgacgaagcaacgcaaggtcgcaagggctcgaattccaacggcagcctgcccccctcgacctccgcgcgcgggtaacctaaggcgtcatggagttccctgacgacctgcgctacaccgcagaccacgaatggcttcgcacgatggacgacgagaccacccaggtcggcgtgaccgactacgcccaagacgcgctcggcgacgtcgtctacgtcggcctgcccgaggtcggacgatccgtgcgcgcaggagaaccgatcgcggaggtcgagtccacgaagtcggtctcggacgtcttcagcccgctcagtggcgacgtcgtcgcggtgaacgaggcgctgcgcgaggcgcctgagctcatcaaccgtgacccctacggcgaaggctggatcgtgacgatccgtcccacggggtcgacggacgagaccgctggcctcatggacgcagcgagctatcgcgacctcgtgcacaaggcgtgagcgaaggggatgtggtgagcgaggggggtgcctcctgtcccgtgtgtggcgcgccactaccggcagggtcacacttctgtccacgatgtggtgccgccatcaccgatgacgatcgaggtgacgtcaccgggacactggcgatcgacgcgatcgagcatctcgccgaggaggcgccgtcgggtccgaccacgacgacgcccgtgctgctgcttcgatcgggcccgcaggccggttcgtggttcgcactcgacagggacgtcgtgacggtgggacgccatcccgattccgatgtgttcctcaacgacgtcaccgtctctcgacgccacgccgaaattcgtcgcgagggtgacgcctacgtcctctacgacgccggatccctgaacgggacctacgtcaatcacgaacggcacgagcgtgcgccactgcatcatggtgccgaaattcagatcggtcgctttcgcttcaccttcttcgtaccggagaccgcgtgaactcctctcaacacctccgcatcgttcccgaacccgaatactcgatcaaggacgtcctcgcgctcttgcaagaggagttcccagaggtcacgatctccaagatccggttcctcgagagccagggcctcatcagtccggaacgcacgccatcgggctaccgacgcttctacgatcacgacatcgcccggctgcgccatgtcctgcggctccagaagtccacctacatgccgctgaagaagatcaaggagcacctcgacgccggcacccaaccgtccgacctcttctccgaggacgccgtcgccggccaaggcaacgccgagacgagcgccgtcacgccgaacgagtcggagcccgaggccggttcgagcgcagaggcatcacgatccgacgcccctggcctcctcgacgagcacgacgccctcgctcgtgcgggtgcgaacgcctcgacgcttcgcgcggccctggatcatgggatgatcgtcggcatcacgaagggccgtgagcgctacctcacgctcgaagaggtcgagatccttgcactgctcgccagcctcgagcgccatgggctcgaaccccgtcacctccgcttcgttcgctcgttcgccgaacgcgaagtcggcctcatcgagcaggtgctcgcaccggtgctctcgatgagccatcgtcaccccgagcgcgcgcgcaccgcgatcgccgagctcgccgagctcctcggtgccctgaccaccgcgctcacgacccgcgacctcgagcggctcgatccgcatgcgcggcgaacactctgagtccagctcgagaccttggcgagcgtccgcgcggcgctgagttcggcgctcgggcccccgcctgaagcacgcgctcactgctcccgacgctcgcctccgtccgcgttcgggtcacgcgccgcgccgtactcctcaccatcgacgacgtcaccgcctcccctccacgcgcggaaggccagggccagcgccgatccgaagacgatctcgccgatgcccacggcgaccccgaaggcgacacggacgagaccggcaagccctgcgaccacgacgccaaccgcgaccatgatgccgattcgacgcatcgcactactcctaccgttaccgttgctactcgcgccgatcagggtcgcgacgtgcggcccttgccacacggtgtcctctgcctccccgatcgcctcagtccgaaaagtcctccggccgtaggtgttcgatgaagtcgcggaactctccgaggagttcgtcctcgtcccccgaggacgtaggctcggcatcgtccaacactgcaccctcggcgtccatcaccgcctcatccacgaagatcgggctcgacgttcggagcgccagtgcgaccgcgtccgacggacgcgccgagatctcgcgctcgatcccgccttgggcgagcaccacggaggcgtagtaggttcccgcccgcagctcggtcacctcggcccggacgacctcagcgtcgagctcttcgatgacgagacgcagcagatcgtgcgtgagcggccgcggcgggtccacctgcgacagggcaaggtgaatcgcgttcgcctcgggaacaccgatgaagatcggcacgacccgatgcgggtcgcgtcgctcctggaggagcaggactggtgcgttggaccgaaggtcgactcgaacgccagcgacttcgacttccaccattgattccatgctaccaagcggccagcatggtcgccgaggcgcggccagcgcgaggcggcaggattacccgagacggttcagcgcggacagaccgaccgcactggccgccgactcgaggtgctgcgtgatccaggcgaagtcgttggccaccatcactacgccgaacacggcgaggacgcccgccgccaccagcgtcacggtccgcaggtgcttgcgcagcgcccgtgtcgcggtcaccgcgcgcgagaacgcgagtccgaacaggagaaacggcacgcccagcccgagcgagtaggccccgagcaacagcgctccctgcaggagctggccctgggtcgccgccacggcgaacaccgacgcaaggatggggccgatgcacggtgtccaaccgaacgcgaacgccatcccggcgaccggcgccgcaaagcgaccgaatcgctcgagcctcggatgccaacgcttctcggcgaacaggatcgggaatcgcccgaggaccgagagcacgaggagtacggccatggcgaggagcacgacgccgctcgcccgctcgagcaacgcatgatgacggacgagggtctgtccgagcgcggaagcggtcaagcccatggcgatgaagaccacggcgaacccgaggacgaactgggcggtgcgccccgccacccgccgggcgaccgccacccctcccgcttcgagctcgcgcgtcggtgccccggagacgaccgagagataggcgggcaccaacggcaggacgcacggtgaggcgaacgacagcacgccaccgccgaacgcgaccacgtagccgactccgagtgccacgtcatgcagtctaccgatcgccggctcgtggtggcggatcgcatatactttgctaaacacaactattttccgggaatcaccgatagcccggtgaggttgtcaacatgcaccgacaatgtgctcgtagccatcatctgaccaaggagcttgatctcagcatgacgcaaggttcgcaccgacaccgctcaggacttgcgatcgccgtcatcgccggcgcacagctcatgatcgtgctcgatctcacgatcgtcaacgtggcgttgccgacgatccaacacgctctccacttctcgccgactggcctctcgtggatcgtgaacgcctatacgttggtcttcggcgggctcctgctcctcggcgggcgctccggcgacctcttcggccgacgtcgcatgttcatggtgggggttgccctcttcgcgatcgcgagcgtgttctccggactggcgacctcgcaggcctggctgatcaccggccgtgccctgcagggcatcggcgccgcgatcgcctcaccgaccgccctcgccctgatctctgcgaccttcaccgaggcacgtgagcgcggacgggccttcgcgatctattccgcggtgtcggcgggtggagcagcgatcgggctgctcgctggcggtctgcttacccaatacgcatcatggcagtgggtcttctacgtcaacgctccgatcgccgcgctcttgctcgttgccgcgccgcgggtgctcgcagagaccgaacgtcaccacggcagcgtggacgtgcctggagccctgacgggtaccggcggcctcgcgctcgtggtctacggcctcatccatgcctccaccacctcttggtccaatgtgacgacgattgcggtcctcgctggcggggtcgttgcgctcggcgcgttcatcgtcatcgaacgtgtccgacgtgagccactcatcgacttccagatcctcgccaagcgtgaacggggcggcgctgtcgcgatgatcctgttcgtcgcggcctcgatgttctccgtcttcttcttcgtgtcccagttcatgcaagacgtcgtcggctactcgccggtgcgaaccggtctcgcgttcttgccgatgacgctcggcatcatgatcacggcccagctcgtgtcccgcaacctgcaccgcgtcggcccgaagccgttcatggtcggtgggagcgtgctcatcgccgtcgccatgggcctgctgtcccagatgcgagcctcgtggggctatctcgacctcctcggcccgctcgtcatcctcgccatcggcgccgggagctccttcgtctctctcttccccaccgcgacccacggcgtcgaaccgcgtcgcgtcggcatggcctcggccctcgtgaccgtcggacagcaggtcggtggcacgctcggcttgtccatcctcgtcaccgtcaccgtggccgcggccaagcggcatgcggcagccctcgctccgcgcctcgccagcggccacctcacaccccaggcactcacgatcctcgccgaggtgcatggctgggcggccggcttcgcggtcgcgacaggattcggcgtgatcgggctgctcatcggtttgatcgtggtcccgcaccttggaccaactgcgaccgaaggagcggcggaagggtcggcggtcgccgcgtaggccggacgcaggcgaacacgccagcgctcttggcacagtcgcatcgcaccctctacgctggagggtgcgatgcctaccgttccagcgttctcgcccatcgggctgctgaccgagtggtcgctcggaccattcgcgatcgtcgtcgtgatcgccgccggcgctctgttcgcgtggtacgtcgatgcggcgatccgcgttcgcgccaagggtcgtagctggccaggtcaccgcatcgtcacgttcggtctcggcctcctctccatcgtctacgcgctggcaggaccgatctccgtgtgggtcatgcgctacttcccggcgcacatcgtccagcacctcgtcctgatgatcgtcgccccgtcgctgctcgcgatggccgcaccggtcacgctggcgctccagacggcacgtggcaccgcccgtcgactcgtcaccggcttcatccactcccgcttcctccacgtcatcacgttccctctcgtcgtcgtcatcgcgtactacatcgtcatgtggtggttctttacgacgagcgcgatcgggttcgccatgacgcacatgtgggtgatggacctgctcaacctactgttcttcgccggaggcgtgctcttttggtggccgctcgtcggcaaggaccccatcgtgcactggcgaatgggctggggtgcgaagctcgtgtcgctcgccttcggcatccccttcgagacgttcctcggcctcaccatcgccggttcacggacctcgctcgctcccatgtacagcctgaccgactggacgaccggcggcgacgtgctgtggggcttgagcgagatgctcacgaccctcgcgatcggcgtcatcatctggaactgggtcgcctccgaggagcgccagacgcgccgtatgtccaggtcccgcgaggcggtgccactctcgagccgccaagacggcctgccgaaggagtactactgggcgcgccaggtcatcgagcgcatgcctgcaggctcacccatgtacgaagaggcgcgctccgtgctcgagcggatcgaccgcgaacgccccccggagacggctcgctgacgactcgcagcggtgtgtgcgctgagcacgccctcgtcgcatcgccggggtctcgccagtctgagccgcagcggccgcgtgatcaggtcggtgcggaaaacgtgaggaacgccgagatccaccagtgttcgaagggcgagaacacgagctgcaagacactcggaaacaggaccgcaacgagcaccacgacggcgagcagccccattcggaagcggagaaagccataccaggctgatgccggcagcacacgctcgaggatggagccaccatcgaggggcgggagtgggatgagattgaacacgccgagcagcagattgacgaggccagcctcgacgaggagctggtcgacgaggctcgatccgatcgaggacgcctgcgcggcggacgccgtctgaatgtcgtgggcgatcactgcatgcgccacgatcccgagcgcgaccgccagcacgaggttggtggcggggccgacgaggccgacgatgagggcgccgttacgaggatggcgcaagcggcgaacgtcgatcggcacaggcttcgcccacccgatcggcggtaagccggcgatgatcaagatcacgggcacgagcacggaaccgaccggatcgaggtggcgcagagggttccagctgagacgaccgctgcgcttggcagtatcgtccccgagggcaagcgccgcccagccgtgcgagagttcgtgcagcacgacggaggggatcagcaccgcgagatagagcagcgatgtcagattgatgacgccacgccacagggcgagccccaccaaggctgcgccgaccacggcgagtagccatcgctcacgagtcatcagcggctcccggcccgagcacgcggatgcgcgcgttggtagacggcatccacgtgaccctccgacaccttggtgtagagctccgtggtggcgagggatgcgtgaccaaggatctcctggaccacgcgcaggtcggccccggcctcgaccatgtggaccgcgagcgaatggcgcaggacgtggggcgagacccgatcgccgagaccgacccgcgacgcacgttgcttcagcaccagccagaccccctggcgcgtgatgggtgcgccccggaggttgacgaagagcatccgatgcttgggagcgagctgcggtcgccatcgaaccacccactgctcgagcgcatcgcgcgcaggggccgagatcgggacgaggcgttcgcgtcctcgcttgcccactacaggtacccatcgaccctgggcgatggtgtcgagcgtgaagccacagagctcgctcacccgaacgcccgatccatagagcacctcgaggatcgcacggtcacgagcgccggcgacatctgcggtcccgacggactcgatgagccgctcgacctcgtcgcgagcgagcgcacgtggcagcgcgaccgccgttccaggcgcatggatcccctccatcggatcgtccgctctcgcaccgacgcgttgggcgtaacggaacagtccccgtagcgcactcgcggcgcgctgaacgccgcgcggggagcgctcccggccggcggcgtccacccaggagcgcaacagagccgggctcgcatcgaggaggcgcgaccctctcgcctccagccaggtcgcgaccgcttcgagatcgctgcgatacgcgatggcggtcaactcggaccgatcggccgcaacgacgaggagggtgaggtactcgtcgacgaccgcctcactcgccgggtccaacgatctcgaactcctccatggccacggtcgcctccctcgcgacctgccgaccgagtccatgggccctcgccatgagcagcgccacgatgctcttcgcatcctcgaggacgcctgaggccaccagtgcgtcgaggtcgtcgagacggagcgccaccagctccatcgcgcgctcctcgaccgattgaggagcccgctcgccccgagagaggcccgtcgctccgaccacccaggttcgctcatcggtgaacccgggcgagttgtagaagctcccgagggcctccaccctcgccgcgaggagcccgcactcctccgcgagctcgcgccgagcggtgtcgagcaccgactcgcccgcgacgtcgcgcttgcctgcggggagctcgagcacatcgcggccgagggccgcacggaactggcgctgcgcgacgacacggccgttcccgccgagtgcgacgacgacgaccgcgcccgggtggcgcacgacggtacgacgctcgctggcgccgccgtccgcctggagccggagctcggtgacctcgaagaagccataggtcgcgcgaaggtcctcgccgacgatctcgatcgtcacgcccgatccttctggtggcggagcgcggcctcgacgagacccgcaaagagtgggtgcggacggttcggccgcgagaggaactccgggtgcgcctgcgtcccgatccagaaaggatggtcggggaactcgacgaactccaccagcctcccgtcggggctccgcccgctcacgaccagaccggcctcttcgagccgatggacgtagcgctggttgacctcgaagcgatggcgatggcgttcgtagaccacctcggccccgtagaggtccgcgacccgcgtcccgggcgtgaggcgcgccgcgtaggtaccgagtcgcatcgtcccgccgaggtcgatcacctcccgctggtcgtccatgagatcgatcactggatagggcgtctccgggtcgaactcgcgcgagtgcgccccgggcaagcccgcgagggagcgggccacatccaccaccatcacctgcagaccgaggcagatcccgagacagggcatccctcgttgcctcgtccaggcagcggtcgcgatcttgccttccacaccccgaggcccaaatccgcccggaatcacgacgccatcgacgtcctcgaggagttcgtcggccatcatcggcgtgacctcctcggcggagacccaccgcacgatcacgcgtgcgtccgaggcaagacccccgtgacgcagcgcctccaccaccgagaggtaggcatccgggtgatcgacgtacttgccgatcacggcgatggcgacgtcgcgcgacggcgcagcggcacgacgcaccaaggctcgccactcgtcgaggtcgggctcaccggccttgaggtgcaagatctccgtcaggtattggtcgaggccctcttcctgcaagagcagcggcacctcatagaggttgtcggtatcgagcgccgcgaccacgccgcgagccggcacgtcgcagaacatcgagatcttctggcgcacgctctcggagagcaccctgtccgagcgggcgacgatcacgtcgggctggatgccacgcgagcgcagctcggtgaccgagtgctgcgtgggcttcgtcttctcttcgccgttgggcccgagatgcgggaccaacgtgacgtgcacgaaggcgacgtcttctcgagggacctcgttgcgcagctgccggagcgcctcgagaaagggcaggatctcgatgtcaccgaccgtgccaccgatctccgtgatcacgacgtccacgtcgtcgccctcgagcgcgcgaatccgcgcacggatctcgtccgtgatgtgcgggatgacctggaccgtcttgcccaagtagtcaccgcgacgttcgcggtcgatgacggtccggtagatcgacccggtcgtcacggacgaggcccgtcgcagcgagacatcgacgaagcgctcgtagtgaccgaggtcgaggtcggtctcggcgccgtcggcggtgacgaacacctcgccatgctcgaacgggttcatcgtgcccgggtcgacgttgatgtagggatcgagcttctgcaacgtgacggcgagcccccgcgccttgagtagacgccccagtgaggcggcggtgatgcctttcccgagcgagctcgctacgccacccgtcacgaacacgtgcttggtcaccctgcctcctcgcgcggccgcctgcggggatcgcccttgagcagtctagagcatcactcccccgtcggcaggagccgacggtcccgactcgctcgatgcagattggagcagtgcccgtgcgtgctcgagggcgacgtcagcgtcggggtggcccgacagcagccgcgcgatctcgcgcacgcgcgcatcgtcgcggaccggttcgacccgcgtcctcgtgcggtcgtcgacgagctccttgtgcaccacgaagtgagtggttgcggctgcggcgatggaggcggtgtgcgtcaccacgatgacttgacgccgcgtcgcgagtcgttggaggcgcgccgccactccgagcgccgcacggccgccgagtccggtgtcgatctcgtcgagcacgatcgattctcgaccctccccgagcagttccgccatcgccagcacgatgcgcgagagctcgccacccgacgctccgcggcccagcggcgtcggctcgaggtcgggtgaggccgcgaaccagaaggccggtaccccttctgccccttcgaggcggatctcgaagcgagctcgctcgagccccagcgctccgagggcctccgtgacgtggcgacgcaggacctctgcggctgcgtctcgttcggcgcgcagcgcgctcgcggcctgctcgaggtggcgctctgcctcgaggcgttctgcctcgagctcttccatcagggcctcgctgccctcgatcagcgcgagcgctcggcgtcgctcctcacgcgcctcgatcacggcctcgagggtgggtccatagcggcgcttgaggtgggacagctgggcaagccgtgcctgggcggcctcgagcgcagccggatcggactcgagacgctcgaactgatcgcgcacctcctcagccacgtcggtcgcctcggcgaggaggctctccaggcgctccgccaaggccgggaacgcacgttgcaccgcgcgtgccgactgaccgaggcgatcggtgatgctgttcgtcccgaccaggtcgcgatggagggagaagagctctgcccgcagcgcatcggcgtctccgagccgatcgacgagctcggtgagctcgttgtcctcttcggggttggcgagctcggcgctctcgagttcggccagctcgaagccgaggcgctcgcgctcacgctcggcgtggtcatgatcgtcacgcgcgcgtcggagtgcggccgtcgcgtcggcgaggcgctccctcgcgcgatgccacgcgcggtcgtcgatgcccccgatgcgatcgaggatcgcacgctgttggtcgggttgggtcacgaacaccgcttggtgctgaccgacgacctggacggctcgcgcgacgaacgaagcgagctcgccaacggcgacgagctcgccatcaatgcgcgcacgggagcggccctcccgggtgacctcgcgctcgacgaccgcttcgtgaccgtcgacgtcgacgatggcgcggacgcgcgcccgctcgtcgctcgcacccacaaggtcgctgcgtgcccgctcgccgaggagaaggccgatcgcacccacgatgagggtcttgcccgcccctgtctctcccgtgagggcgacgagcccgccgggcagctcgagcgaggccgcctccacgacccccaagttgcgcacctcgagcaggctcagcatggcaggtcgagcacctcaaggccgaacttcgccttgagtacctcgtggaagggcggggccccgatctgggcgaggcgcacccgacgcgtcgccgcgtggacctcgaccgcttccccgggcacgagggacgaccacggaacaccatcgaccatgaccgaagccgtcgggccatcgagcagtcggatctcgacgggttcgtcgagtccgaggaccaaggaccgatcgaagagctgatgcggagcgatcggtgtgagcacgagcgcgtcgacgcgtggcgagagcacgggtcctcgcgcggagaacgcataggccgtcgagccggtgggcgtcgcgacgatgatcccatcggcggcgtagcgcagaaaggggcgacgatcgatagcgacgctcgcgcggatgaggtggcccgacgcctgacgctcgacgacgacttcgttgaagccgacggttcgctcgctcctcgaaccgacgcccgcctcgagcacgacccgctcctcgacgacgatcgacccatccacgagggctcggagcgcgggttcgagcgccgacggttcgacctcggcgagatagcccagttgaccgaggttcaccccgagcaccggcacgtcctctcgccacgccgccgccatcgcacgcagcatggtgccgtcacctcccatgctgacgaccgcatcgatcgccccacacgcgtgcgtcgggtcctcgagtatgcaggcactcccaccgagctcgctgagcaacgcccgagcctggcggaagagttcctgcgcacgcggctcctgcgggtggagcacgaacccaacgttcatccggctcagcctaaccaccaccgcttcgttcactcggggcacgcaaccacacgaactcctcgacgttgccctcggctccgggaaccgaactcggacaactcccgaggacaacgagccccatcgaacccatcgcgtcgcggactcgtccgagcgcctcgtcgcgctccggaccgagcgggatcacaccgcggtatcgactcgcgatctggcgccccacctcgaactggggtttgacgagcaccaccgcctctccgcccggcgcgagcagcgacgcaacctggtcgaggacgccgagcaccgagatgaacgacacgtccacgaccgccagcgtcggtgcttcggggaggggccacacgaacgcacggatgtcggtccgctcgtagacctcgacgcgcgggtcatgccggagcgactcggcgagctgtcctcgtccgacgtcgacacacacgacgcactcggcaccgcgctcgagcagcaccatcgtgaacccacctgtcgaggcacccacgtcgaggcagatccgccctgacgggtcgatgtcgaaggtgtcgagcgcaccctcgagcttggccgcgccgcgcggacgccacctcgaggccacgaccgagagcacgtcgctgggcgcaacgaggcgagccgccgacagagccggggcccgattgacgagcacacgcccctctgcgatcagacgcgccgcgtgcgaacgggagcgagcgagcccgccagcgacgagcgctcgatccaatcggacacgcctcaccgctccgagagcctatcgctgaggttctagcatcctcatcgtggcagccatcgatgcgctcgagacgcgcctgctcgagtatctgagcgcgccggctcgctcgtcacccgccctcgcacgggcactacggatctgtgaagatggcgctccgatcgcctacgccgcaaccttcgcctgggtcgcgtggcgcagcgcggatgatccgcccgttcgcagcgccctggtgcggaccacgcttgcgggctcggtcgcggtgctcggcgcaggggtcgtcgcacgcgcgcttccgcgctcacggcccagcctcaccctctgggcatcgcgcaggtcggcgagcgatagtcactcgttcccatccgaccatgccgcgggggcgagcgcgttcgcccttgcctcctctgggctccctcggggtgcgcgacgcgcactcgtcgccctctcggcaacgacgatcgtgagccgggtcctcctcgctcgccattggccgagcgacgtgctcgcggcactcgcgatcggcgccgccgcgtccaccgtcgccggggccctgccctcgccgatggtgaataccctcggcgagatcaccgtccggtggctcggcctgtccgctcgagcacgacggacgcccacagcatcccgaggcaggcgacaagagcaccgaccgcgtcgatgacccacgcgccgtggaagccgaccgcaccgacgagcgccccgaacccgagcggtccgacgacgctgccggcaaacgcgctggcttggacaatggccgtcgcctgtccgggatgttcaggccaccgttcgctcaccgcgaagttcaccagcccgttccagccccaaccgccggcgtagccgagcaggagccctccgagcaacagcgcacgcacaccggtcgcgagcgcggcatagcccaccacgccgacagcgagcaagacggcgaccgcccggatcggccgctgcagacgtcggtcggcgagtgcgcccatgcccaccctcgtggcgaggccggcagcgctgccggctgctgccgcataccccgcgatggcagcctggacgtggtcgtgaacgagcgatgccacgccgaacgcaccgagtgcattcgccgtccctgcaccgagcgccatcgcggcggcgacgatcagtagcgaccgcggggtgacgaagcgcgtccgcgcctcagccccctgagatccgtcgtaggaggcaaaacccttggctccgagcgcgatcgcaacagccaggatgctcgtcgcggcaaaggccgtgcgccagctcgaccggagcgccaccagcggcagtgccagtccagcgagcaaggttgcggtaggaatggccgcctgcttgatcccgaatgcccagccacgcctcccggggcgcacgacgcgcgcgagtacctcgttcacaccgggttgcaagatcccgttcgcggcccctgcgaccacgagtgcggctgcgagcaggatcggaccacgcaccgcgaaggcgatcacggcacttgccaccgcggatgcgccagcgcctgctcgcaccagccggaaggccgccgctcgatgcaagatccgcgccgccagggccgcccccacaatcccggcaacgaagaagctcgcgacgacggctccttcaaggctcggggtgaggtcgatggcgtggcgcagcaccggttcgagaccaccgatgaggaacactggcagcgtcgtcgccgtcgtggccgcgatcgagaacggcaagacgaggcccgttcggggcacaccagaactcatgagacgttcaggatttcctgagtgccccgtgagactcgaaagcatacctatgcacaccgccaccttacccgcaggccacctgcatacctatacctcgacttgcacacgacatccgaccgtgacgtgcgcgtcacgcagacgacgatgattgcgttccatacacgagaggaatagcctacgatacgcaatggccaaagagcagatcgctcctggcctgcctggccgacgccaccgaggctcgccagcatgacacgagtgtgggaggaagtggggaacccatgaagaagatcacagcacgccaccgcctcatcgcgggacttggcaccaccgctgccgcagccatgctgctcgcggcgtgtggctcctcgtcgagctcgacctcgtcctcaagcacgaccaaggtctcgggcggtacggcctacttcgccgaggccgccggcgcaaacccgaactacatcttccccttgaccgggggcccgtacttcagcgtcgacaacctcgcccagttccagatcctgatgtaccgaccgctctacttcttcggggtcggctcgacgccagagatcaactaccagctctccatcggcaacgcgcccgtctactccaacaacgacaccaccgtcacgatcaccctgaagcactacatgtggtcagacggcgagccggtgacctcgcgcgacgtcatcttctggatgaacctgctcaaggcgaacaaggccaactgggccgcctacgtgcctggcgccttccctgacaacgtcgcgtcgtactcggctccgaatgcatcgaccgtcgtcttccacctcaccggcaaggtcaacccgacgtggttcacctacaacgaactgagccagatcacgccgctccccatcgcctgggaccgcacctcgctcagccagccggcacccagcccgtcggccgccaacttgcccgatacgacgacctcgggggccaaggcggtctacaccttcttgaactctcaggccacgaacgccaacgcctgggcctcgagcccgatctggtcggtggtggacggcccgtggaagctgaagagctcgtcgacgaccgggcgcatggtgttcgtgccgaacccgtcctacaccgggccggtcaagccgtcgctgtcggagttcgtggagctgcccttcacctcagacaccgctgagttcaacacgctgcgcgccggcaacggggcgatcacctatggttacgtgccgacggtggacctcagccaggtgccttacctgaagagcatcggctatcgcatcgagccctggatcgacttcggcttcaactacttcgtcgagaacttcaacaacccgacctacggaccgctgttcaagcagacgtacttccgtcaggccttccagcacctcgtcgaccagccgcagtggatctcgaccttcctgaagggctacggcgtaccgagctactcgccggtgccgctcgcgccggcgaatcccttcgcggacgccacctcgaagaccaacccgttcccctactcgatctcggcagcgaagtcgctcctcaccagccacggctggaagatggtgaacggcgtcatgacgtgcgagagcccgggcacggccgccaccgactgcggtgcaggcatcgcgaagggcttcacgctcacgctgaacctgcagtacgcctcgggtaccacgttcatcacccaggagatggacgcgctccagtcggcagcagcgagcgcgggcatcaagatcaacctctcgcaggcacccttcaacacggtcatccacaacgccactcagtgctccggttcgagctgcacctggcagatggagaactggggtggcggctgggagtactccccggacaactacccgaccggcggtgagatcttcggcaccggtgctgggtcgaacttcggcaactggaacgatccgaccaccaactcgctgatcgccgagacccacacctcgtcgaatgcgcaggcggcgctcgatgcctaccaggactacatggccaaggtcctgccggtggtctatcagcccgccgccgattacgccatctccgcgatctcgaacaagctccagggggtcactcaaaacccgtacctgaacttgacgcccgagacgtggtacttcgtcaagtagcgatcctcagggctccgagccccgcttagcgggggctcggagcccattcgcctgacggaccacgcacgatgggggctccgcaatcgaggccgagcaggcccggcgcccccgcgaacgatccgacatggcccgctcctacgatcgatcgccagtactagttccacgaggagtccatgaccggctacatcatccgcaggctcgtccagtctgtcatcgtcgccatcggcgttttgctcatcatgttcatcctgcagagcctcctgcctgatcccgcgcgagccatcctcggggtcaaggcgacgccggtacagatcgcggccttcaacagggccaacgacctcaacaagcccttctacgtgcagttcgcgcactacctcgtcgatgtcgtgtggcatcacaacctcggcaccgcctatcagctcaacgagtccgtcggctccatcatcgctcgcgacgccccgaagtcactcgtgctcgtcggcgttgccctcgccatcgccgtgatcatcgcggtaccgatcggcgtctaccaggcggtccgtcgcaacacggtcggcgaccaggcggtcaccgcggtgtccttcctcctctactcccttcccaccttcttcctcggccagctgctcattctcttcctcgccgaagacttccacctcttccctgccgaggcgccccaaggggtcacgctgggccagatcctgtccgacccgattgcactcgtcctcccgatcgccaacctcgtgctcgtgaactacgccggctactcccgcttcatgcgttcctccgcgatcgaagccctcgcccaggacttcatccgcacagcgcgagccaagggtcttcccgagcgggtcgtcctcttccgccacatgctccgcaacgccctcatcccggtcgtgacgctgatcggcctttcgatcccggcgatcttcacggccggcctcatcaccgaggctctcttcaacttcccagggatcggatcggactacgtccaagcactcgtgagtcaggactatccgctcgcgctcggcatcacgttgctcgtcgcggtgctcaccgtgctcggtaacctggttgccgacattctctatgccgtcctcgatccacgagtccgttatcgctgagcacggacctaggaacggagcccaactcatgtccatcaccgacgacctcaaccccgatctcgaggctgacctcctcgctcccctccccaccgggctcgctggcgcgtcccccgaaggccccgaaggcggtgacgtctcgggtgcaggttccgcgtggcgcctcacgctccgagctttcttcgacaaccgcctttcctatgccggtcttgccatcctcatcgtgctggtactgttctccttcgtcggacccctcgtctatcactccgacctctacacagccacctacaacatcaaccttccgcccggtcccggtcaccccctcggaaccgattcgagcggacgcgacgtcctcgggcgcctcatggtcggtggccaagcctcgctcatcatcggcgtactctcggccgtcatctcgaccgtcatcggggtgatctggggtgcagtctcaggcttcttcggtggcctcatcgacaccttcttgatgcgcattgtcgacgtccttctcgccgtcccgacgatcttcatccttctgtacctcgccagtatcttccggcccacggtcctgctgctgtccatcaccatcgcgatcttgtcctggctcggcgctgccaggctcgtgcgaggggagaccttgagcctgcgctcgcgcgagttcgtgcgcgcggtccaggtcatgggcggctcacgctggcgcatcattcgccgccacatcatcccgaacaccatcagcgtcgtcgtcgtccaagccaccttccaagtcgccaacgccatcctcctgatggccaccctcggcttcttgggtttcgggctcgagcctccggcagccgactgggggtccatgctctcccaaggcgtcaactacatctacgacggttactggtggctgatctggccggccggcatccttattgtgctcgccgtcctctcgttcaacttcatcggcgatgcgctccgagacgccgtcgaggtccgcctccagcgccgctagggcgacctggctactgccgagcacgggacgatcattaccggtgtgtgacgccatcgcgtcccagacgaccatcgccattgcgttgcgatagcctctccctgagtcacgcttgaagcgagtcttcgtgggtcggagctcgagtccgcgccctcggtgcccatgaagtcgccttgtcgcgtcacaatcgcaaggaggtccccgtgcgccacatccggccgtcgcgacggcgtctcctcctccctcttcttgtgggtgcaaccggattcgccctcgctgcgtgtggaacgtccggtgcggccgagccgtcgagcgcctcaccacacggagtcgtgacgttcgcggaacaggtcggggctgctcccaactacatcttcccgttcaccgcgagccagtacttcacggtcgacaacacgtcccagttccagttcctcatgtaccggccgctgtacttcttcggcgtcgccggtcgaccggtcatcaacgctgagctctccctcgcggctcttccggtctactccaacaacgacaccaccgtcacgatcaccctgaagcactacatgtggtcagacggcgagccggtgacctcgcgcgacgtcatcttctggatgaacctgctcaaggcgaacaaggccaactgggccgcctacgtgcctggcgccttccctgacaacgtcgcgtcgtactcggctccgaatgcatcgaccgtcgtcttccacctcaccggcaaggtcaacccgacgtggttcacctacaacgaactgagccagatcacgccgctccccatcgcctgggaccgcacctcgctcagccagccggcacccagcccgtcggccgccaacttgcccgatacgacgacctcgggggccaaggcggtctacaccttcttgaactctcaggccacgaacgccaacgcctgggcctcgagcccgatctggtcggtggtggacggcccgtggaagctgaagagctcgtcgacgaccgggcgcatggtgttcgtgccgaacccgtcctacaccgggccggtcaagccgtcgctgtcggagttcgtggagctgcccttcacctcagacaccgctgagttcaacacgctgcgcgccggcaacggggcgatcacctacggttacgtgccgagcacagccctcagtcaactgggcgtggtgcgctcgatcggctaccgcatcgagccttgggtggagttcggcttcaactacttcgtcgagaacttcaacaacccgacctacggaccactgttcaagcagacctacttccgtcaagccttccagcatctcgtcgaccagccgcagtggatctcgaccttcctgaagggctacggcgtgccgagctactcgccggtgccgctcgcgccagcgaatccgtatgccgacgcagcatcgagacacaacctctacccttattcgatctcggcagcgaagtcgctcctcaccagccacgggtggacgatggtgaacggcgtcatgacgtgcgagcgcccgggcacggccgccaccgactgcggtgcaggcatcgcgaagggcttcacgctcacgctgagcctgcagtacgcctcgggtaccacgtccatcacccaggagatggacgcactccagtcggcagcagccagcgcgggtatcaagatcaacctctcccaggcgccgttcaatacggtgttcgccaacgccgccccgtgctcaggttcgagctgtacctggcagatcgagaactggggcgcgggctgggagtactcgccggacgactacccgaccggtggtgagctctacacaaccggagccggctccaacgtcgagggctggaacgatccgacgacgaacaggctcatcgccgcaactcacacctcgtcgaatccgcaggcagcgctcgatgcctaccagaactacatggcgagggtcctccccgtcgtctaccagcctctcgccgactaccaggtatcggcgatcgcgaacgaccttcacggcgtgagccagaatgccttcttgaacctgacgcccgaggcgtggcgccttggctgagctgggcgacgctgctcgcggacccctctcgccaaggacccgctgagcgcaatcctccagagccccgcgggtggccggatagcctggaggccactgtgacccaaccagaccctacgccagccatgccccgagcccagcgacgtcgagtatcgaagcgacttcggcgccgacgccgcctcgtcatctccctcgccaccgttctcgcgctcatcgtgctgatcggcgcgggcagttacctctacatccgctatcgcttcggccagatcggacacgtgtcggtcggcgggctcacggcgcagagctccggtcccgagaacatcctgctcgtcgggaacaattcacggtgcacgttgacgaagtactcatcgttctactcgaagggctcacagcacttcggcacctgcagcgaggttggtggtggtcgcagtgacgtgacgatggtcctacacgtcgatccagcgacgcaccgcgcctacctgctgtccatcccgcgagatctctggctgcccatgccgaacggcaacggactcgaactccgtgtcgacgatgcgctcaactccgccgagcgcccctatctccacctgcccttcggaccgaccttgctcgtcaagacgatcgagcaagacctcggcattcccatcaaccactacgtggagttgaacttctacaccttcgagcaagtcgtcaacacgctcggcggcgtcacactcgacttcccgaccaagctcgtcgaccactactccggcctcaacatcacgacgacgggctgccagcacctcaccggcacgcaagccctcgcgctcgttcgagcacgacacctgtactactacaacccctccaccgggacctgggactacgacggcacgggtgacctcggacgcatcgtgcgaacccacatcttccttcgagccctggccagtcaggtgaagagctcggcactctcgaacccgatcacggccaacgcgctcctcggctccctgctgccggcgctcaaggtcgacccgtcgttctccctctcggacatggtgagcctcgcgcttgccttccgacacgtcaaccctggctcgatcccgagcgcgacgttgcccgtgatcatcccctcccagagcacgttcaccgaccctgcgaacccgtccaactatcaggcgccgggctccatcgtcatgccgtgggcccagagcgacctatcggtcattcgccagttcctcggctctgaggcccccaacctcaacgccattcgtccagcctccgtcacggtcgcggtacgcgacgcaagtggtgttggcaacggtagccagctcgtcgctggactctcccagcttgggtttccaacgaccaacctcggtaccgcaacctacgccggcaccgactccgagaccgtcgtcgcctacaagcccggcatgctcgcccaaggcgagcgcgtgctcgccagcctgtctggccaggcagtccttgccgagggctcggcaaatcagcccgccgacgtggtcatcaccgctggatcgacgatcgccaccaccgcaacctcggcccagaccgcagccctgacgacaacctcggcaccgaccgccacgctcaccgccacctcgacgaccacaccaccggtgggaacgctcgtgacctcgacgcagagcctccagcaactcgcctcgtcgaacctgtggcaggccaacgcgagtgggtccgagttctggtgggatccacgtctgtgccccgcccacgcctagtctcgcaggggcgcgcctagtctcacagcgagatgcccgagaccccctcactccacatcgtcgaagtcgctccccgcgacgggctccaaaacgaggcgaccccggtcgtcacccgagacaagctcgaactcatcgaggcatgcgtcgccgccggtgtcgaccgtatcgaggtcgcaagcttcgcacatccctccctcgtaccgcagatggccgacgccgaagcggtgatcgagcagctctcagaggctgccctcgcccgcgcgatcgcgctcgtcctgaaccaacgcggtctcgagcgtgcactgcgtacccgcattcgagagatcaacgtggtcgtcgctgcctccgaaggcttcgccagggccaaccagcgcgccacgcgcaccgagctccttgcgacagcacgcaacgtcctcgccgatgctcgcgccgccgatctgcgtcgttccctcaccatctccgtcgcgttcggatgtcccttcgatggggaggtcgatccccacgaggtcgtacgcatcgtcgagacgattcgagaggccgacccagcgtgcgagatcgccctcggtgacacgatcggcgccgccgcgccgggagacgttgctcgaatgctcgagctgctcgcggacctcgtcgcaccgaacgagctgcgcctgcatttccacaacacccgcaacgctgggatcgccaacgcctgggaggccatgcgcctcggagtccggaccttcgatgcctccatgggaggcatcggcggttgccccttcgcgccacgcgcaaccgggaacatcgccaccgaggacctcgtgtggatggcgacgcgctctggctaccgaaccaacgtcgacctggagcgcgccatcaccatcgccccgctgacgacgcgcctgctcggccacgaggttgcgtcgatggtggcccgagccggcacattccccgccggcacctcctcgcagccgaacccgtccctctagcgcggcgctgctgcctcgcgaggtcgcaccgacagggggaagtggcacgccgcgtggtggacgcctccgaagtcgcgcatcgggggctcctcggtgcggcagatgtcctgcgcataggcgcagcgcgtgtggaaccgacacccaggtggaggggtcatcgccgacgggagttccccacgcaccagcgagcgctccttcgtacgctcgacctccggatccggctcgggaacggcctcgagcagcatgtgcgtataagggtgcttcgcgctctcgaagatgtcgtcgcccgagccaacctcgaccagcttgccgagatacatcacgccgatccgatcagccagatagcgcaccaccgacaggtcgtgcgagatcacgatgtaggtcaggttgtgctgagcctgcagatccttcatcaggttcagcacctgcgatcggatcgacacgtcgagcgctgacaccggctcgtccgcgacgatcagtcgcggcgacaacgcgagcgcccgcgcaaggccgatgcgctggcgctggcctccggagaactcatggggatagcgctccatggccgcaggggccagaccgacctcctggagcaggctcgcgatccgctcaacacgctcggccttggtgccgatcttgtggatgtcgaggggttcttcgaggatctccttgacgcgcatccgcggatcgagcgatgcgaagggatcttggaacatgagctgcagctcgcgccgcacctcgcgtacgtaaccacgctcgttgacgatggagcggcctgcgaaccggatgtcgcccgccgcgggctgctcgagccccacgaccatctgaccggtcgtggacttcccacacccggactcgccgacgagcccaaaggtctctccttcgtagacggtgaacgacacgtcgctcaccgccttcaccgtgccgatcttgcgctgcaccaccgcgcccttggtgacggggtactccttcgacacgtggtcgaactcgagcagcaccggccggtccgtgacggtgcgctgtccggtgcgacgctccaggctgatcgggacacgctccggtgctccaaccggatagaagcaggcaaacggatggagatagccctccggggtcgtgtacggcggcttctcgacgcggcagcgctcctgtgcgtagtgacaccgcggcgcgaaacggcatcccacgagatcgcccgtgaggtcgggcgggattcccgggatcgagtacaggcgctcgggtgcatcgcccgtcagcggtggaatggatgcgaggagcgcctcggtgtagggatggtaggtggaggcgaacagctcggcggcgtcagcatgctcgacgatctctccggcgtacatgacgatgacgtcgtcggcgcgacctgcgatcacgcccatgtcgtgcgtgataaggagcatcgccatgccgagcttcgccttgaggtcctcgagcagttcgaggatctgggcctggatggtgacgtccaaggcggtcgtcggctcgtcgaggatcacgagcttcggatcacagctcagcgcgatggcgatcatcaccctctggcgcagtccgcccgacagctggtgagggtaggattcgagccgctcgcgcggattgggcataccgacgagcgagaggacctcgagcgctcgctcgatggccttgtccttcgagtagccaaggtgccgacgaacgacgtcagtgatctggtcaccgatggtcatgcaggggttcaacgacgtcatcgggtcctggaacacgaccccgatcttgccgccccgcacgtcctggagctccctccgcgacagcccggcgaggttgacgccgtcgaagaggatctcgcccccggcgatgtagcctccctggggcagcaagccgaggatcgacatccccatcatcgtcttgcccgacccggactcgccaacgatgccgagcgtcttgccctgctcgagcgagaagctcacaccatcgaccgcacgcacctcgcccttgcggagcctgatgcgcgtcctcaggtcacgaacctcgaggagtgccatcgcgttcctccatgctccccacgccacctacacggtggctgcatagagcgccatgctacccgcgtcggcgcgggtccggtggcgcagcagcccgtgaatcgaggtgctagcatttcagctccgcggggtgtccccgcagagcttgtcggagtggcggaataggtagacgcgctaggttgagggcctagtgaccgcaaggtcgtgggggttcaagtcccccctccgacaccaagtcccccaccgacgcagctgagatctcgcgccggtcgatcgtgcaacgcgtggcgccctcgcacggaccaaggtgggcctcgatgcccagcacctgacgagacccagcgaaacgccaggtcaccacccctgagcggctccaggaccgccacgagttgctcgacgctcgcctagctcgcacgcggcgagcccttctctcggcgtcgctcgactcttgtccgcatggaggctcgccaccgaaggtgggccatcgctctcacccgacgtcgagcgcgcctctccagacaatcgccgaggtctcggcaaccctggagcgcctggacatcgagccctcgaccgctcgccgcatgcgctatctcgacacctccgcgcgtctccgccagctcggggcgcgggccgcccttcggatacccagccgctcggcgcgaagtgcccccacggaaggggaccttggtaccagactgaggcccgtctcgccgagtacggttggccacggaggtggagacatgctgctctcaacccacgccgcgcaggtggtcgccgagactcgacccacgccgaggctcgtgctctgggagacgactcaggcgtgtccgttggcctgcgtgcactgtcgcgccaacgccatcagcacgcccgatcccgacgagctcacgaccgccgaggggttcgccctcatcgacgatctcgcagctgttgccggcccacgtccggtcatcgtcttcaccggcggcgatcccctgagccgacccgatctcctcgacctgatcgcccacgccgcagctcgaggtctccacgtcgccgtctcgcccgccgtgagcgagcgcatcacgcctgccacgctgaccgcactctacgacgccggggcgcgcgcgatctcgatctccctcgacggactcggcaggaaccacgacgcaactcgccgcgttcccggtcacgcgctgcgcaccctcgaagcgctcaccatggcacgctcggtcggtcttcgtgtgcaggtcaataccacggtcatgcgcaccaccgtcaatgacctccccgcggtcgccgaggccatgctcgcgcgcaacatcacaacctgggaggtcttcttcctcgtgccgaccggccgcgcgagcaccgagctcgccctcaccgcccacgagcacgaggacgtcgcgcgcttcctctacgaaaccaccggctacggcttcatcgtccgcacggtcgaaggaccgttctaccgccgtgtcgccgacgccattgcaaccagcaacgacgcagccctcgcccccatcggcgagctcggcgagcggctgatcgccgagctccatcgccgcctcggcgatcctggccctcgtcgccgtccgtcaccgcacccggtgcgcgacggtgatggcgtcatcttcgtctcacgtaccggcgaggtctacgcctcaggctttctccccgttcgactcggatccgtccgcgagcgcagcctcctcgacatctacgcctcggacccgttgctcgacgccatccgccaggccgcactccccggccgctgtggccagtgcgactgggccaaggcctgcggcggctcccgtgctcgcgcctgggcgatcaccggcgatccgctcgccgacgaccccgcgtgcgcgctcgtgagcgcctgaggccccgaggcaggtcggtaccagtccggagccagcggctcgcgactgcccgtgggctcgcgcacgcctcagtcgacccgcaggccgccgctcggcgcgtcacaaaaccgatcgtgcacccagggcgagcgcagctctcaccggccccaccaccgaacagaactgcagcttccggctcgggctacgcggactgcgtggatccctcaagtccgcgctctcgccgccacgccgccgcgacggctgcgatggcctcgagcgcgtcgtagtgctggactgcgtcggcagtcgcgaccgcgccgagcggctccccgaggaacagacggcgcaccggcacctccagcttcttgccgttcaacgtcttcgggatcgccggcacagggacgatgcgatcgggcacgtgtcggggcgacagctcccgccgcagcgtggcacgcagccgatcgtcgagtccgtcgacgtctccggcgtgcacgaacacgatcagttccccgggtgtgtcgagcgatgaggtgtcgacgacgagcgcctcgacgacaccgtcgacaccttccgcgacgcgatagaactccgccgtccccatgcggaccccgccccggttcagcgtcgcgtcggagcgaccatggataatggccgaccgatcgtcgaagaaggtcacccagtcaccgtggcgccagatccccgggtagcgatcgaagtaggccgcacgcagccgctcgccgtcgtcgtcgccccagaacgcaaccggcatcgagggcaagggctggcgaatgacgagttcgcccatgaccccgatcacctcacgtccctcgtcgtcgaaggccgccgcatccaccccgagcgcgggtgcgctgatacgtccttcgagcgtcgggctcaccggcgacgaaccgaggaacgcggtgcacacgtccgtgccccccgatcccgacacgagctgcacgttccccggcacgtgctcgtagacccaacgaaaccccgcagcggtgagtggtgcgccggtcgaggccacgacccgcaaggagtcgagcgtggcttcgtcgcgaggtcgaacaccggcgacctcgcaagcacgcagatagggcgccgacacaccgaagtacgtgatgcggacctcgtcgacgagccgccagagacggccaggatccggatgctgcggagccccgtcgtaaaggacgatcgtgctccccacgagcagaccgcccatgaggtagttccacatcatccacccggtcgtcgtgaaccagaagaaccgagaaccctcgccgatgccggagttcaacgcgagcaccttcttgtgctcgaggacgatgccaccgtgggcctgcacgatcgccttcgggataccggtcgtgccggacgagtagaggatccacagagggtcgttgaagccaacgacgaccggggcgacggggtcattggcttcgagcgcatcgaaggccacgaccggcacctctgtcgctggtggctccccgtcgcagagcacgacggtggtcaccgacggcagcgactcgagcacctcctcgacgacggcccgtcgatcgagctggcgtccctgccacagtgacgacgtcacgcagacgaggatcgtcggttcgacctgacggaaccgatccacgatcgcccgcgggccaaagtccggagagcagcatgtccagaccgcacccaccgtggctgtggcgtgcagggcgatcgccgcctccagtcggttcggcaggatcgccgcgacgcgatcgcccaccccgacaccgtgagcgacgagccagcttgcgacgcgatcgacctcggcccagaacgaggaggctcgaagcgtccgtacctcgccgtcatcgcgaacctcgacgatctcggcagggtcgacgaagcgagcacgcgcctccgcgctgtagttgagccgtccctccggaaagaatcgtgcgctcggcatggcaccaaccagatcgaccgagccaagatcaccctcgagaccgcacacggcggcgacgtcgcgccagaacgccccgagatcggccaggctggccgtgtgcagagcgccgtaggtcgcaagcggcgatccgtggcgagcctccaggcgtgcccgcacggcaccgatcggaccatcccatgcgtcggccggcggcgaccacagcactcgtgcctcatcggccatcgcctacctccccggcctcctcgagggccgccgccgcccgctcgagcgctcgttgcgctctggccagcgctcgttgtcgagcccgttcctccgcagggtcctcgacgtcgagcaagcgcgcgacgaccagctcgtccaagcggtcggcgacggcgcgcagcgcctcgagcacctccccgacaccctcgtccacgtctccctcccgatcgctcgcagactaggtgacgacgatgagctgcccctcggtgaaacgctggcggagcaccttcttgtcgaacttgccgaccgaggtcttcggaatctcgtccacgaacgcgaaccgttccggcagccaccacttcgcaactcggctcgcgaggaacgctcgcagctcgtcggtcgtcaccgtcgcgccctcgcgcagcaccacgagcgcgagcgggcgctccacccacttctcgtcggggatgccgataacggcggcctcggcgacggcaggatgcgccatgagctggttctcgagctcgatggagctgatccactccccgcccgacttgatgacgtccttggtgcgatcggagatgcgcaggtagccctcggggtcgatggttcccatgtcccccgtgcgcagccatccgtcgtggaagcgctccgcatcgtcgaggtgatagtaaccagccgtgatccacgggccacgcacctcgatctcgccgagcgcgaccccgtcacgcgggagagcggtaccgtcctcgccgaccacacgaagttccacgccgggcacgggtttgcccgcggtcgcgaagtagtccgccaagcgatcgcggggcgtccccgcgggcggcaaggcgagcgtgcagatcggcgaggtctcggtcataccccatccagagatgagcgccacgccgtaacgctccaggtaggcctcgatgagcgcccgcggcgtcgcggatcctccagaggtgatcgatcgaaagctcgacagatctgccggatggtcctcgaggtagcgcaacaactcgttccagatcgtgggcacgccggaggccatcgtcgggcggaaccgctcgatcatctcgacgagcggcgcgggctggaggaagcgcgtcggcatgaccatgtccgcgccactgacccagcacgtgtagggtgcgccccacgccgccgcgtggaacatcggcacgatgatgatcgcggtgtccgcggccgggtggaggaggtccatggcgcgccgtccgtagagcggtcgtgacatctccgcatggaggtagatggaccggtgcgagtagacgacgcccttcggattgccggtggtgcccgaggtgtagcacatcatcgcggcggcggtctcgtcgagctccggccacggatagggatcgggcggctgggcctcgagcaacgcctcgtagtcgtggacggcgaggtcggggcgagcccgcttgatggcctcgagcacccccggatcgagcacaggtccgacgatcacgagatggcgaacgctggtggcctccgggagcaccgcctggagcatgccgagcacgaggttgtccgcgatgatcacgaggtcctcggcgtcggccaccacgaagcgcagctgatcggggaagagacgcaggttgagcgtgtggacgacggcccccatggacgggaccgcgaagtaggcctcgaggtgcgggtgatggttgaacgagaacgtcgcgacacgatcgccgacacccaccccgagaccggcgagggcgtgcgcgagacggtgcgtacgggccgcgacctcgccgaacgtgaacgatgccacccagccagggccgaggtaggtgtggacgtgcgcatcagggaactcggtcgcgccgtactcgaacatctgacgtacgccgagcgtcccatgctgcatggtcgagttcaccagcacctcctttgtcaccgaccatgctgccacaacccctcgaccatcgccacgcaacgcagggaccttcgtcccttggcgccgcgaacacgctcgctagactcccacgcgatggatcgagtggtggtggtcggcgccgggatcgccggcatgacgatcgccgtcgagcttgcgcgccgtggcgctcgggtccaggtgatcgccgatccctcgcgatcgccgacgacgcccgtcgcagcgggcatgctcgccccggccgccgagaccgacttcggcgaggacctgctcgtacggctcgagcaggacgcgcgcaccgcgtgggaagctcttgccgcaacgttggagcgcaacggcgacaccgacgtgctcttcgaggtccgtgggtccctggtcgcggcccagaccccaggtgacctcgatcaccttcggcgcatggtcgatctccagcgtcgcttcggcatgaccgcatccctcctcggcgcgcgtgacttggtcgacctcgagcctgcgctctcgagccacctcgctgggggcgcgctgctccccgacgacgcccaagtcgacaaccgccgagcgctcgcggcctacgacacctgggcagccaagctcggtatcgagcgcatcgaagccgcggttcgtgcggtgcatcccgacgccgtcgagcttgccgacacctcacgcctccaagccgacacggtcgtcgttgcagccggatcgtggctccgcgacctcgtcgaggtcgcactccagccggttcgcggcgtcaccattcggggcacgctccccgttggcctcgccccccgtcactgtctccgaggagagctccgcggccgcagggtttacatcgtcccacgcgcgtcacacgagatcgtcatcggggccacatcggacgaagcgcccctcaccgaccgcgacccccgagctcgcgatctgctcgatctcctcgacgacgcgcgcacgctcgcaccggccatgggcgagctcgcggtcaccgacgtgtcggtcggctttcgccccgcgacgcccgacaacctcccgatcgtggggcgcggagacgacggcgtctgggtccacggcggccactaccgtcacggcatcctcctcgcgccgttcacggcgactctgcttgcggacgccatcgtcggcgatggtgtcgatccgaggctcgcagccctctccccgactcggctcaggtcgcgcgcatgaccaccctcgtcatcaacggttccactcgaacggtcgaggcgaccaccctcgcagaactcgctcgcgagctcgagctcccgagccgtggcgtcgccatcgcacgcaacgaggagatcgcgccgcgcagcacctgggatgcggtcgcccttcgtgacggcgaccgcatcgaactcgtcaccgccgtacaaggaggagcgtcgtgacggtcaccatcggacggctcacgctcgcctcgcccctcatcctcggcaccggtggcgcacgtcgcctcgacgatatcgaggccgcagtcgtcgcatcaggcgccagcgtggccaccgtcgcgatccgccgctaccagccgggggcgagctcggtctacgacgtgctcgcccgccatcacgtcaccccactccccaacaccgccggggcgcactcggcgcacgaggccatcgtgctcgccgagctcgcacgcgaagccctgggtgtcgactgggtcaagctcgaagtcgtgatcgacgaccggaccttgctccccgacccgttggagctggtacgagccacggaggcgctgagcacgcggggcttcgacgtgctggcctacacgaacgacgacccggccacggcacgactcgtcgaacgcgccggcgcggtcgcggtcatgccgctcgcgagtccgatcggatccggtcttggcatccagaaccctcgcaacctcgaggccatcgtggccgacgctggtgtccccgtcgtcgtcgacgccggcatcggggctccctccgacgccgcgctcgcgctcgagctgggcgccgatgctgtcctcgtagcctcggcgatcatgcgcgccgaggaccctgcggtgatggcacgagccatcgcgctcgcagtcgaagcgggcgcactcgccaggcgggccggacgcataccggctcaacccctcgcggtcgcgtcctcgcccgtcgagggcctgcccaacgtctcgctctagagcgcgtcggccacgttcgcacaaaggagaccgtgatgacccctacccccgccgtggcactcaccatcgctggctccgactctggcggcggagccgggatccaagccgacctcgtgacctttgccgcgttcgaggtccacgggacgagcgccattaccgccgtcaccgcacagaacaccgtcggcgtctccgcggtcgtcaccatcgaccccgacgtcatcgaggcgcaagtccgatccgtgaccgacgacttcatggtgcgtgcaacgaagaccggcatgctcgccaccgcgccgatcgtcgagcgcgtcgccgcgctcgctgcctccggtatcctcggtcctctcgtcgtcgaccccgtgatggtctcgacgaccggcgcgaccctgctcgatgctgacgccgtgcaggctgtgcgtgacgccctcctcccgagtgccgcgctcgtcacacccaaccgtgccgaagcggaactgctcacgggcatagccatcacgagcatcgaggcccagcgtgctgctgcgcagcggctggtcgaactcggcgctcgcgccgcgctcgtcaagggcggccacctcgacggacccgatgcgatcgacatcttgttcgacggccgcaacgtcgtggaactgcgcgcaccacgagtatggacgcgcaacgaccacggcaccggctgcacgctctcggctgcgatctgcgcgtgcctcgcgcgcgggctcacgctcccccgcgccgtcgaggaggcgaaggcctacgtgactcgcggtctcgccgacggcgccgactggggcctcggaactggacgcgggcctttcagccatttcgccaagggccgcccagcggtcgtggcctgagaccactcacccgtaccactcacgccacggagctcgcaatcgactacgataacggagcattgctgccgctcaccgtgagaggtcgcgctcagtcatcaggagcgtccatggaacccaacgtcgccacctctggggcaccgcacgagcggaccgcaaccgcggtggtgcgtcggagcatcgccggcccgcctgatcgcgaactcgttgcggcgctggcggcgctcgcagacgcgatcgaggccatcgactcttccaccaacccggcgctcgtcgacgccgcgacccgcatcggtgctcgcctcgactacctcggtcatcggccgagcaccctcgtggccctcctcgccgcactggcggagagccttggtcgtcacaccacggccgacaccgcggtgatgcgagccctcgcgatcgcgacggatgccctcttcgcacgccgggagcgcgaactcgttcgtctctccatgctcgcaacccgcgatcccctgacggggctcccgaatcgtcgagcgttcgcagacgccctccagcgatcgtgggcacgcgcgaagcgtacgggtgagcgcgtcaccgtcatcgccctcgacctcgacgacttcaagcacgtcaacgacacgtacggacaccgccgtggggatgaggtcatggccgagttggcccaccgcctcgccaaggccgtccgcgccaccgacgtggtcgctcgcaccggcggggacgagttcggcctcgtcctcgaccccacgggtgaggaggccgcggtcgaaccggtgctggcacgcctcgagcgcgagctccagcgcccactcgcaaccctcgacggtggccgtctcctcgcctcggcgggcatcgcctcgagcgatgctctcaccatggaggccgatgcgctcctcgacgctgccgaccaggccctctacgtcgccaagcatgctcgcccggtcgagaacgaggtgctgcgcatctcctactggcaacgaacgggcacacccacgacagggcacaggctcgcccccccacacccctccgaaggcatctcggtcgtgtatcaacccatcatcgatctcgccacagggcggaccgttcgcgccgaagcgctcgcccggaccgacgcctcgtcggccgtgcactccgtggagtcgctgctccaggccgcgacgcgagccgagcacgcacgcttgcatcgccacatcgtggcactcgtcctcggtgacctcgccgccctgggacccgatgcacgggtcagcgtcaacgtggacgcgggcgtcctcgacgatcaggtgctcacgaccacgctgctccacggactcgaccagctcgcacctgggcaactgcgcatcgagatcaccgagcgcgacatcttgctcactgctcatggagacgtcgttcggcgcctccgcgagcacggtgcgaccatctcgctcgacgacttcgggaccggctttgcgagtctgtcgcgcctgctcaccatccccgtggacgagatcaagctcgaccgcagcgtcgccgctgatcggcagatgggatcggtggcgagcgccgtgctcgcgatcgcggtggcactcggacgcgctctcgacatcgacctcgtcgtcgagggtgccgacagcatcgagcgtgccgcgcagttccgcgcgatcggcgtgccgctcgcgcagggattcgcgatcggcgagccgaccgcgtcgctccgccaggcactcgacaccaccatcgatctcgacacgctcgatcgatccctcgtctcgcgggacgtcgccgatgcgcgggcgagcatgtgggagcaggcgatcgcatgcttgctcaccgccgagcccgatggcgacctcaccacctgtgtcatcgccgccgacctcgacgagcccagacggcgagcacacctggagcaccaccgcatcatcgcagagatcctgggccgcgcgggcgtcatcgacctgcgccgcggtgccgaacgcgtcccatcgccatcgtcagcgcggcgaggaccctcgtagcaccctaggagtgtgcgcgaggacggctgacgctctcgccgaccgtcgccgcccggttccgcagcgcctcagctcgtggtgggggtcgcgcgccgagcgagcgcgacggtcctcggagccacgaacccgatcacagcctcaccagcctcgctgaccgcaagcagcgcccgtgcaagatcggagcgcacctcgaccgtctcggttgcgacgacgtctgccaccacgcgcgaggcccccacccacgcttcgtcaaggtcggcgcgaagccgcgccggcgcctcgaggtcggcgaccaagcgctcgagctctgcgcgaaacaccgaggcggccgacgtgagtgcatcgcgattgggcaccaccatctctgcgacacgagccccatcgctccgcgctacgcgggttgcgtcccggagcgaccccgaaccgagccaccaggctgctgggtgtccgctgtcagcgaccagcacgcgacccatcgcagcggcgaggaggtggggcagatgagacaccacggccagcgtctcgtcgtgcgccgtggcatcgagtgcgaccaccgcacccgcgcccgcgtcgccgaagacgaactcgagcgcggtcgcgacatcgtcgtcggactcgctcccatgaaggacgaaggcccacgacgcaccgtcccagatcgatggatccgccgatgcggcgccatggccctctcgtccggccatgggatggacgctgagatggcgtaggccagccggtgcagcgtcgacgacggggcgcttcaccgaggcgacgtcgagcaccagacctcgcgccccccgctctccgagcgcgcagagcacatccccgaccaccggtgtcggcgtcgcgacgaccacgatctcggctgccgagacggcgtcccagccgaccgtcgccgaggtgcgttcgcgaacccaagcgaccgcctcgggatcctcgtcgatcaccgcgagtgggccacggcgaccgagccggagggcgagggaggcaccgatgtggccgagccccacgatcccaacgctcggacgcccgaactcagccatcgtgcgcgagaccatcggacggcggtgtcggcctcggcacgacgacctctggtccctgccagcggggataggaaccgagcagccgcacacgatggccgagccgggccagttcgccaagcgcatgctcgagcccagggtcagccgcatgaccccgtgtcccgatcaggaagtagtgctcgtcgccaagcccgaggggtcgcgagacgatcgaggtcagattcacgcccgctgcggcgagcacgctcgtgatctcggcgagcacaccgacgacatcggcgcgtggcacgacgacgagacgcgagcgatcgtcgccagtgggcgccgggagttcgtggccgatcagcacgtaacgggtgcgaacctccggaatgctcgtcacggagtcctcgagcgcgatcagctcagcctggtagccaacctccggcggggccagcgcaacaagcccaggacctgcgagcgcgacctcctgacaggcgtgacgcgtcgagagcgcctcgcgcacctccgccccggtcgcagcgatccacccagccgccaacgcaaggatggcaggatgggagatgacgacgtgggccgacgcccccgcgtcagcaccgaaggcccagatgggctcggccagcaccgcctcgccgaccacgagcacgcgtgcatcgacgagccgatcgagggtcgcggcgagttcgccctcgaggacggtctcgaccggtacgacgccaagcagtcccggggtcgcctcgacggtcgagacgacctcgtcgagcgagatcatcgggagagggtcggcgtccgcgagtccgaagagcccgagcgaacgatggctcgagctcccgagcggctcggcaaacgccaccatgcggcctgggcccatccaacctccttggttggttcagcctacctggcaccacggcgccaccttggttaggcgaccgcttcgtcctggggggcaccatggcgccgcacgagcgcgagcagtccttcgaccagttcggcgacgagcgccgacgcggtcggatcgaccaagcgccccgacgcatcgaagcgccgttcggcctcgttgatgaagacctccgggcgcgcgagcacgaccgagttggttccgtggaggacctgacgcaggtgcgcctgcgcgcgaaccgtgccgaagaggcctggagcgacaccgaggacggcaaccggctttccgatcagcgcaccccgaccgaacgggcgcgacaaccagtcgatcgcattcttgatcaccggcgtgtaggagtggttgtactcgggggtcgcgatgatgactccatcagcctctccgaccgcggcgcgaagccgtgccgcgctggcgggcaggtcacgttcgagttcctcggcgtagaacggcacctgatcgagacgatcgaacacctcgtaggccacgccctccggcaacacgtcacggatggattcgagggccctggtgttccacgatccccgacgaaagcttcccgacaacccaacgagctgcatcactgcctcccctcatatggtggtcgccgccgatcgagcacgcctgcaccggcgctctcagcacgagctcaccgcgattgcttgcacgtgcaatcagtctagccgcagatgctcgctacgctctccccatggcacgcaccgtccgcctcgagggatccgtcgctgaagtcgtccgaacctgcctggtctacttcgtcgcgaccgcgccgagcgaccctcgcggccacgtgaactgctcgccgcgagcgaacgacggcacgttgatcctcgacggccccgatcggcttcgcatcgtcgacctcgtcggttccggggcggagacgatcgcacacctgcgcgacaacggccgcatcacggtgatgatcgcctcgttcgacaagcgacccctcgtcgtccgcatctacgggcgggggcgggcccgctcaccgctcgacttccccgagctcgcctccacgctggtcggcgtgcgtgctgtgctcgacatcgcgatcgaggaggtgcggacctcctgcggctacggcgtgccgatcgccgaggggctgcggccccgcccgcaacttggcacctggctcgaagcgaagggtcccgagggcctcgccgactacgtcgcccgccacaatcgctggagcctcgacggcctcgcgagcatcgacggcacctggccgagtgaggcaccgagctcgtagcccccgagcaagccgctcgcccgcgcagccatcaccgtcgctcgatcgagcatccacccagacccatgacccggaccatcgagcgcgaccagcccgttcaaccaggctccgaccccagctgccagtgaaggccggtgcgcgagcaccctggcaccagccgcgaccgcccgatctgcgagccgaggattccagagggcagctcgatggaggagtgctgcgccagcgaggaacggcgccatctgggcctcggcccaacgaccgtaggccggtcctcctcccagcggtccccttgcaccgagagccgcggctgcctgggccccagaagcgagcgccgcccagatcccttcgccttggagtgggttcacgaaacccgcggcgtcacccaccaagagcacacgaccgcgccacggcgccaccccgatcccacccatccgcaaccagccaccgagcacaggagcgtcggccacatcgacgagtccgatccgaccgaggtagtcatcgagcaaggggcgcagccctcgcaggcgtgctcgctctcccccaaccgcgatgcccacgcctacgttcgcgatgccatcggcacctcgaaaggcccatccgtagctcgcgaacccactcgcctgcgcaagcaggtcgactcggtcggcatcgagcgtcgacgacgcaacgtagcgacgcagtgcaaagccccacagcgcccgtgtcggtgacgccgcccccaccgaccgcgcgactgtcgacagcgccccgtcggcaccgacgacggcgtcggcgtcgagcacgccgtcgtcgaggtggacccgcacaccgtcagctccttggacgagaccacgaacccggccgacgatggcacgggcccctgccgcgacggccgcgtcccgcagccatgcatcgaagagccgcctcgtcaccatccgaccctcgccggggtgcgcgagacctggggatgccggcaagtgcaggcgcgcaccctcgacccagacgtccaggtcgccgatccggggccactcgggctctggcgtgagccctacggcggccaaggtcgcgagcgcctgaggaccgaccacgtcaccacatgccttgtcacgagggaaggtgctgcgatccacgagcgtcacacgccagccggcgagcgcgagctgtcgcgcggcgatcgaccccgcaggaccggcaccgacgacgacgcacgacgggagaggactcatgggtccaggctacgagggccccctacgagaacgacacttggagcagtcgaacctggaggcgagccccaccgggaccgggcgtgggatctttgatcccgacctcccagtaggacccatcggacccggccttcgacgcgatgatcgtggtcgccgtcgacgacgcgctcgccgactcgacgtgccatccctcgtcgggcagtgccgcgacgaagaagttgcgaatctcggatggcgtcaacgccgaacgcaaccagacccacgcgtcgaactcggtcccgtagggattggcattatgacggcccgtgatcgttgcgtcggcggggatcaagatggtgcgctcgatgttggcggggatcacgttgccaggatcgagcccttgccacgccccgagtgacgtcgtcgctgagtatggaatcggcgaggaggcctcctctccgccaccagacggaatcgccgcgagcgagccgatcgccgcgacgaggatcgcagcgataccgacgccccagccgagaaccttcttcgaacgaggtgcgagcgccatggtgttaccagtctcgcacgagcgcgcgccgaagcggtagttcgagggcgccgacacagtaacctgatctgtcgcggcggcgtggccgagaggtgaggcagaggcctgcaaagccttgtacagcggttcgagtccgctcgccgcctccacaatcgggcgtggggcagatcgcggcacgcatgtcggatcatacgcgatcgccatggtcgccccacgctccacgaggcgtcgcaggtgcgagaggacgcattggtcacgctctctccggtcggacctgcggcccgcgtcaccggtcgccatcgatccgcgcgagtccgacgcacgatgacaacgccagcgccgcaacgtggctcaccgacgaccgaccacgacgtgtcagggcaaacgccccgccacgcccacgaccttcgtccatcgttgcgacgcaaccacgctgtacacttgagtgggtgatcgagatcgcgtcgacaatgagcgatcccgacgcctcgtgaaggaggtcgacgtgcaggatcgcatcttccaggttcggggcatgacgtgcgaccactgcgtacgcgccgtgcgaagcgaagtcgctggcgtcgccggcgtcgtcgacgtcgacgtcgatcttgccaccggcatcctccgcgtccgaagtgacgcgcccatcgacccagatgccgtactcgcggcggtcagggaggctggctacgacggtgtcgccacagactgacgccccttccgggcctcacgaggaggtcgctctgcgggtcagcggtatgacctgcacctcatgcgcgctgcgcatcgagcgctcgctcgacaaactgcccaccgtcgacgcggacgtgaacttcgcaaccggcaaggccgaggtccgcttcgatcccgccgtcgtcgatctcgccgaaatccttcgtgccgtgcgtcgcagcggctacgacgccaccgtcgccctctcgagcgacgcctcgcctcgcttccactggtgggcgatcgccctcgcggcgctcgtggcagccggagccatggtcgcgccgccgacacagctcgcacgcgatgtcgagttggtggcgaccctcgtcgtcctcgcaacggcaggtcgcccgttcttcgtcgcggcctggaacgccgctcgacaccgcagcgtcacgatggacaccctggttgcgctcggcgctggcgtcgcaatgacggcgagcgccatcgtcaccgtcgcgggcctccagcacgagccgacctacttcgacgctgcagccatgatcgtcgccttcatcgggatcggcaagctgctcgaggaacgttggacgcgtcgcgcgcgagcaggtctcgacgctctcgaagagctcagccgtcgaaccctcgcgcgcatcgacgacgacgggagcctgcacgaagttcccctcggcgagctcgaggcacacgaccgggtgctcgttcgcccgggcgacatcgtcccggcagacgcgcgagtcctcgacggggatgcggccgtcgatggcgctcttcgcaccggacgtcgcgatctgcggcgcgtcggccccggtgacgaggtcctcggcggtgacgcggtcgtcggctcgtcactcacgatcgaactcgatgcacctgcccgactcggcctcgtggtcgagctggctcgtctcgtcgaggtggctcagcaccgccgggcacgtctcgcgacgctcgccgatcgcgtctcggcccgcttcgtcccggccgtgattgcggtcgccgtggtcgtcgcgttcgttcgtctcgccatcggcgcaccggtcgccatcgcactgagtagcgccatcgccgtggtcgtcgtcgcctgtccgtgcgccatgggtctcgcgaccccgatcgccttcctcgtcgcgagcacgcgcgcggccgcgcgaggaatcgtgctcgaacaccccgatgccctcgagcatgccacctccatcgatacggtcgtgctggaccgaaccggcacgatcaccgaggccgatctcgttgcccactggcccgagcgcgtcgctctgtccgagcgacgcctcgtcgcggcactcgctgcgcgctcacgccatccggtctctcgagcactcagtcgagtcgagggcgacccggcgaacgccagcggcgacggcaacgaccccgagccggtggtcgagcacgttgtggagacgccaggcgtcggtgtcacgggacgggtcgatggacacgagatcgccatcggctctcccgcctctgtcggtgcgaccggcgtggaccctgccgcgagcgagcgagcagtgttcgtccgcatcgacgaccaatcgcctatcgtcatcgaactcgccgaacgcacgcgcgagggcaccgcagcaacggtggcggcactgcaccgccttggcgcgagggtcatcctcgccaccggtgacagccgcccaaccctcgcggacgaggcgcgtgagttcggcattgacgacgtcgccatcggcctcgatcccacggccaaggtcgcgctcgtcacgaagctgcgcgctgacggtcaccacgtggccatggtcggcgatggcaccaacgacgccgccgccctcgcaaccagcgatctcggcatcgcactcggtggtggcacgcatctcgctcaggccaacgcggacgccgtcctcctcggcgacgatatcgccatggtgccgaccgtgctcgatctcgcgcggcgcaccgtacggacgattcgccagaacctcggatgggcactcggctacaacgtcatcgccatcccggccgccgctgcgggtctgctgtcgccgatggtcgccgccgcgctgatggcgatgagttccctcgtggtggtgggcaatgccttgcgtctcgacgtacgcgagtcggcgggcgcatcgggaacgactgaggtccgctagagtggggccccatcgggccgttggcgcagctggtagcgcacttgcatgacgcgcaaggggtcagaggttcgagtcctctacggcccaccatatcgccgttttcgaacgcatggtcaagagcaggtcgaaggctcctgtgcaggtagcttcgacgtcgtgtccatcgtgcacgtggagctcgtccaagatgctcacgtcccaccgatggtgtacattcactcactggcactccctggccgccctcggcctactaccgcaggctcctcctcggcaagcggctcaagcacgggaggagtgctcgtgggccgaagcgtctgcgaggtctccttcgtgtcgtcgtggccctcctgtgtggcaccgagctctgccatggactcctgcaacaggtcgtgccactcggcaacggcccacccctcgtgctggccgagcacgacagcggtgacaggcggaggatgacggcgtcgtttccgaagaccccgacgacgtggtgcgccgcttgatctcgtggttcaaccgctctgagcgggttcgtcgaccagatcgttcgccagtggcgctctgggaagtgcgtgaaggtgtgagacctcctccttggcctcggcgagcgtggtagcgaccacggggagcgtgggggcaagggagtcgatgacctggtcgcactgggtacgtagcgctgccgggtacggctcgagcgacgatcgtacggatcgtgaggccaggaccatctccttgagctccccttcttcgatgcgagcgagcacgtcgcgcacgttgcacgcagtagctgtgccagctcgccccgacgacgcacctcgcgatggcttggtgaacccccgctctggcatcggagatgacgaggcgcacaccactgagacctcaagatccctgagctccctcgagaacctctcggtctgcccatccccgacgcacgaccccaaggacctcgtgcgtctcacgtggcatgcacgcccgtcgtgaccacgacggcacgggagatgacctggtgggcaaggcggccgttcgcgtcggtggcatcggcgacgagggagcagaaggcagagatggtccagcctgcggctacgaaaccccgccagctcctcgtctgaggttgcgatgatgcgagagacctcgctctctgtgacccccgttccaccgagggccgcgaccaggtcatcgactttgcggtgctgacgccctgagacgtaggcctccagaacctcgcacgtagagagcacgatcgacgcaggcggcgacgctcgcagatgctcgggacacgctcccctggcggagctgtgatggaagttctgacacgacgtctcctccggtgcccgggttcgcatgcgggcgcggaacgaagacggtctgccatatgggttaccactacctgtgggggtggactcggtctttcccgcgaacccggtggcaacgccgatgtcgatcccacgctcccttggcaccgggccgtcgaaccgagacctgaggcaagggcgccgcgaccttcggcgcgactaccgaccggtagacgcggatggcggcgtgctcaccctcggagaagccctgctccagggtgcgggccggggtcatgatccccgacgcgacggagcacgagtcggacgtccggaaccgtcgatttccccgagacccagccacgcgacgcgaacccacacgtcagtgaggttcgaacacgagtgactacggctcaccaggagaagtgtaccgaatgtggtacacgtcccgcatgagcaagatcgtccccattcgcgagcttcgcagtgagctcagccaggtcatcgaccaggttgccgacctgcgcgagcatgtcatcgtcactcgccatggtcggcccgcggccgttctcgtcccagtggatgagtacgaggccctggaggagacggctgagatcctctcggacaccgagacgatggccgcgatcgacgaggggcgacgtgaagtagagcgtggggagaccctgacgctcgacgagctccgccaagaactgcagtcgcgccgtagaggatgagtcgggtcgagctcgcccggcgcgcccgcaaggagatcatcgacctcgactggccactgtccgacgcagtggtcgaggctctcgggctgctcaagcgcgagcccgaggcaggtcgcctccttcggggacggcttcggggactgtggtcacttcgagtcggtacgtatcggatcatctaccagctcgacaatgatgagcgcgtcgtgcgcgtgctcgctgtccgccaccggtctatcgcttccacgaccgatccgcgctgacagtcagttcctggggagcgacccgatccgttctcggagatcgtcgaagttcgaatgcgagtgcctacggcccaccgcatgtcgacgtcgtcgtcaaacgtcgacacagactcgtcatggagatccaaggactctcgggagcccgcgtctcatctcgccgctttgcacgtgaacccgtcgaacgcgaccgccccttgcagcctgctcgaatgatcgcacccgagacgagccgcgatcgcgcagcaagtcgcggagcgttgaggccgcagctgtccgccttcgcttcgccagacagtgctatcgaccctcgtcgtgggaagtacccccgctgcccggttgcggagcgatcctggcgtagacgctcctgggcacctcggtcatgtcccgcacctgttcggcgttcacgccagaggcgattggcgcctccagcccgaccgcgcgacggccgatcacagcagcacggccggtgagccgtggcacgtggcgatctgatcgccatcagatgagacgcgcgcatcgagcccgagccatgctcggccgggttcacggccccaccactctctgccagtccgtcggccgggccaggacgccaccgtctcccatcccggcatcgaagccctacgtacgagacacggcatgcgctccagcttctgcgccactgcgaggccagcgactcatcggatcacacagccgctggcccgcccaaggtctcgacggtaggctcgtcccatggcctcgagtacgtacctccatggccaccacgagagcgtgctggccgcccatcgacggcgaaccgccgagaactcgtgcgcgtacctcctcgaccatctccaccgcggtgccacggtcctcgacgtgggatgcggcccgggcaccatcaccgtcgacctcgcacggatcgtggcaccaggcacggtcgtcgcgctcgacgccgagatcggcatgctccaagcaacggcggcgctcgccgcagagcgtcagctggacaacgtgaccgtggtcctcgctgacgcgatggccttgccctggcccgacgccaccttcgacatcgtccatctccaccaagtgctccagcacgtccccgatccacgcgcgctcctgcgagagtgtcgacgcgtgtgccgaccaggaggcatcgtcgcggcccgagacgccgactacgcgggcttcctctggagtccgctcgatccggacctcgaccggtggcagacgctctacgagcaggtagcccgtgccttggggggcgagccggacgccgggcgttacctgctcgaatgggccagcgacgcgggctttcgcgaggtcatcgcatcggcaagcacatgggtgttcgcaacctccgccgaacgggcctggtggggagagtcctgggcgagacgggccctgcagtcgggttttgcgacgacggctctcgccacgcaactcgcccatcgcgacgagctcgacgccatcagccgggcctggttgcgctgggcacacgcgcccactgggtggctcctcgtgcctcacggcgaaatcctcgcgcggcggtgagctcgacgatgagctcgacgcggtgtgcgacgaacgcccttggcggcatcgcgtcgaccggcccccgagaggaagtccacccgtaccctcggcctgacgtcctcgcgtgagcgctcgcaagtcctgtggggaaccacacgagcgcgtcgagagtccgagccctggccgaggccgtgcggctgcgctgttcgcaagtatgtacgccgatcagatcactgcggcgtacgtccctccgcgggcctggctgcgaccacgtcgtagtctccgcgaatgacgaagaacgagccgcggatggtgcctgccaaccgcgaacgctgcctcgcaaacttgaagcgctcctcgagctcgcccggaacgggaactccgtcggccagtttgaagccgaccgcgcgcttgccacctggcgcgagcgtgtagaggacgttgacggccacgccgttgtcgtagaacacgtgcgtccagtcgatgccgtccacgacgaagtgagcgacctccaagggcgtcgcctggatctcgagatcgcgctcgtgccgcaggaggcgtgccacccactcgacgatctctggcgcttcgtcggccgactcgacctcgaacgcgtgaccgtagtgggtcgagaagtaacgcgcctcgttcgcccgcaagccagcaagcgcctccgcatacggcgacgcctcgagtccgtccgtactcacagcgtgaaagtcgacgatccgacccattgcgacctccgtcctcatcgaggctgtccgaccgccgttcgaccgggagcagccagcaagcgccatcgactccgcgtgccactcgagacgaccatcgacgagggagctgcatcggcgcctcccggcgccggagccttgccccgacttcgcctcaccggcgacgagcgctcgcgcgcaccgagcagactactcccgaaccggcacacgggcctcggcgaggcgccatcgcctcgagaggcccggcgcatggacgactcgtgccctccgagagttgcacggctacacccatgctccggcaccttcgtaccgctgcggttccaccaccgctgccatgggccactcaggctgcacctcacgaggcgatcggcgtgcgagcaccagccggtccgagcgcactctcgtctgtgaccgagcgcgacgccgcgggtgctcgccagcaccgctcgcccgcgcaccaccggatcgcacagcgtcagatcgcaagaagcgcatcacgcgccaacgatcgtgccaccgaagccgtagccaaagccgctggagccgtagccgctgtagccgtagccaaagccgaatccgccgaaaccgggggcctggaacccgaatccgttaccggcaaacggggctgtcgcggcactccctgagcccaggccgctcgtcgcgtcgtactgggtggtgaccgtgacggaatcgctcgagggcgacaccgtcggagccgcgatggtcactccctgttggtcgaccatcgaaatggcctggagcgtcccgctcggcagctcagccaacggtgcaccgttcgcctcgacgtggcgcatcacggtcgtcgagacgggggcaaggttcatgatccctgcctggctggtgggtgcctcggtgatccactcggccgaggtctcgacacctgaggccgccgacggcgagagcgtcacgacggtatcgaccgccggcgacgatgaccctgccacggtgagttcgagtcgccaccggtcggtcccgacgggtgtgatcgccgccatgacggtggcgccggtgggaatcgtgattgtgtcgaccgcggcgttcggtagctgctcgaagaacgccaccgtctgggcctcgcccttgggcccaggctcagtgagcgtaccgacctggatcaactggtgtgaccgcatcccgcccagcccgacccactctccgatcgcgctgttcgcagagacgtcagcctgtgtgaacgacggggccgtccagctcgcccggacacttcgctccgcgcttccgagcgcggcgagccccgaccagttctcggacgcgctcgttgcgctcacgagcgaggtcgatgccgagccggacccgctcgatgtcgaacgcggcgagttcgtcgcgaccgaccctggggccgggttcgtgacgacggtggagctcgggtgggtatcgagcccacttgatgctccggccgcgtggcccgcccacgcgaacaccgcaaccgccatcgacacaccgagggctccggcggtcatgctcctccgtacgtttcgagcagttcgcatggtacgtgatctatgcacggtgtcctacctgaccaagaaacccgcctgagaagcttctgggctacgctggcacctcacagagcgctcagcgatcgcacggggcgccctcagtgtggatgtcgcgcgcgccccacccgtccggggtgagtctcgggcaacgtgagggccatcacgacgccccagacgacgaggagcgctgcacccgcatccacggcagcgcggagcccgagcgcttgggcgaccacacccaacacgagcggaccaaccgcgtagcccccgtcacgccagagccgatagaccccgagtgcaccgccccgccagcgcgggtccgcgcgatcgccgacgatggcgatcaggttcggataagcaagtgccatcccgacgcccgtcacgatcgccgcggctaccgcagtgaacggacgatgcgcgagagcctcgaaccccagcccagcgccgatgacgatgatcccaccgacgaccggccagcgccgaccgatcgtgtcggccagaagaccggtggggatctggagaagcccccagacccacagatagacacccacgatcaggccgatcaacgccaccgaatccccctcgtgtaggagcaacagcggcacgaaggctgccatgagcgaatcagcgaacttggtcagcatgcctgcaaccgagaccaccccgagcgcccgatcccgccagctcacgagccatgcaagatggagcagcgacgggccgggtcgcgccgactcacctacgctccccccatctgccgacgcctcgacgagagcatgccctctcgtctcgctcgcaggccacacgctcgccatgcctcctaccaccacgaccacgagcgcgaggatccacggcgccacactgcggccgccttcacccagcagcaatccagcaccaaggccgccaagcccgacaccgacgtagccagcagcctcgtcaattcccaccgcgagcgctcgacgagtcggtccgacgaggtcgatcttcgcggtcaccgccatggtccacgtcagagcctggttgataccgagcaccgcattcgccgcgagcacctcccaccacgcgtgcgccacgaggatgccaacggcatagggaacgccgaagagccaaccgatgcgcaggatggtccgccgcccatggtgatccgacagatgacctgcgacgaggttcccgatcgccttcgtgacgccgaacgggacgaggaagctcactgtcagcagcaccgaccgcacgccgaagacggccgacgcaagaggaggcagcgccactcgttccacgccgatggtcgcgccaaccatgacggtgatgaacgtgtacacgccaaactgccgccaattggccccgagcccgagtctcggagtagcagaaccgcccatgcgcctcattcctacattcaaaccaatgtaagaatgagactagccctcggccacctccgttgagcccgactcgaccgctcgaccgtccacgagccacccgaggaagccgtcctcgagccgtcgcgcctcgatcccacggtctcgcagccaccgcaccgcgatggatgcgtacgcacaccacggaccacggcagtagacgatcacctcggaaccgggtgcgagccgcgtcggcacctctcggagcgcgacgagtggggccggcacggctcctggcagatgcgccgcacgccactcctcctccggccgtacatccagcacgaccaacgacccgtcagccatgcgatcgatgacgtcggctgcacgcagacctgcgagctcctcaggtccgagatacgcagccgcgagcgcctcgacgtcgcgatcgagctgtgcgctcacacgtgtcagctgcaaccacagctcggcgacctcgcgtgaacgcaggcggtagtacacgcgtgcgccctcgcgccgagtcgcgacgagatgagcgatcgccaggcgacgcaggtggtgcgaggcactctgcacgctctggtgcgtctcgcgagcgacctcttccacactgcgctcgccctgggccagcaggtcgatgatctcaaggcgccgcccggatcccagcgccgtcgcaacctcggcggcccggtcgaagagcgcaaccttgacagcatggtcgctctcgagaggggcgtcgctcacgtcgctccaggtccgctcgtggcactgcgccactcgtaccccacgcccggcaccgaccgcaacgcgccctgggccgggccgagcttggcgcgtatgcgcgataccaccacccgcaggtgatgggggtcgtcatagccgggaccccagattgtctcgagcgccatgcgatgggtcaccacacgtccttcgtgctcaacaaggtagcgcacgagatcgaactcgcgtctcgacagcgacaccggaccacgctcgtcgtcgacgacgagacgccgcgcagcgtcgagcgtcagtcgatcactgatgcgctgcctggtcgcaacgacgtgacccgacccctcgaggcgccgctcgagtgcacgcagacgagcttggagctcgagaatgccgaagggcttcgtgacgtagtcatctgcaccgttgtcgagcgcagcgaccttgatgcgctcgtcatgggcggcggagagcacgagaacaccgccgcgatggaactcgcgaagccgcgcgacgagtgccaccccatccatgtccggaagaccgaggtcgacgaggatgacctccggcggatccgcaaccgctcgctggagaccttcgatgcctcgaagtgccgactggacctcgtagccggctgcgtgcagcccaatcgcgagcacgcgcgcaagggcagggtcgtcgtcgatgatcaggatcgaactcacaccaacctcggcaacacgacgcgcacactggtagcgtccggttcggattcgaactcgacgcgtccaccgtgcgcttcgacaaagctgcgtgcgatggcgagcccgaggcccgtgcgacccgagacgcccgaggcgtggaaccagtcgaacaagcctctcgggtcgacatcgccactcataggggcgtggtcgacgacctcaatgagcgcatcgccactttgctccagaactcgcacctccacgacatcgccgaggggtccgtgccgaaccgcgttgtccacgaggttccagacgacctcgcgcagcagggaggcgtccccgagtaccttcaccggcccgtcggcgagcacgcaaacctcagacccgaacccacgtacctcgaccgctcgaaccgcatcgtggaccacctccccaagttcgcacaccacccgccggacccgccgcacgcctgcctcgagtcgactcacgtccagcagatcttcgaccagcgtgctcgctcgccggcactgtgcgagcgccgtctcgaggagctcgtcgtggtcgctcggcgcgatagccgccccgaaggcagccaccgtgctcacggccgtttcgatgctcgcgagcggtgtcaagagatcgtgcgacaccgtccgaaggagtgacagacgccagccgtcgacctgctcgagcgtggcgaggcgtacttcggcctggcgaagccggtcgcgctcgagcgccgccgagagctggtgtgcgacgacctcgagcgcaccgacggtcgcctcgtcgaggcgtggaccccacacaaccagggttccctcgggcccacccaacgtgctcacgatggaaccgcgggcctcgaacccacgctcgcgcagcacgatcgagccccgacccgttgcatccgaggagaaggctcgttgcacacgagcagcgtgctcggcattcgaacccgaccagatcagctcccctgcgccatcggctcgaacgagagccgcgccacctggaccgttgacgcgagccagcgcctcgacggccgcacccacgaggccggccgcgttctgcgcaccgaggagacgctcaggaaggtcggcgagcgcgccgaggatgcgagcctgacggagcgcccgatcgcggcttcgccggaaccgctcatccagcgtgatcgcgattgcgcccaccaccacgtagataccgagggggatccaattgacgccgcgacccaccgcgagggttccatagggagggatgaagaacacgtcgtaggcgatgaacccggcggcgaccgcggcgacacccgcgaccgccccaccgatcgcgacgctcgccactaccgggaccaccagcaccaacgccaccgtcgctggcggcacgaccgcacgcaccggaacgagcgcgacgacacccagtgcgaccgtcacgacaccaacggccgcgcccggatagcgcagcatccggcggctcgtgctgaggagtgacatgcgtctacgatcctaccgatggatgcgatcgacacggaggacgccgaccagcttgtcgccacgcccgaagtcgaacccgtcggccgcttccgtatctacctcggtgccatgcctggcgtgggcaagacgtgcgccatgctcgacgaaggcttccgacggttccaccggggcgcggacgtcgtggttggctttgtggagacccacggccgtgactacaccgcctcgctcgttcgagacctccccgtccttgcccgacgacgtgggacctaccgcgggcgcccggcagaggagttcgatctcgaggccgccctcgcgcgcaaacccgaggtcatcctcgtcgacgagctcgctcacaccaacgtgcccggactcggcgcccacgccaaacgctacgaggatgtcgcgacgctcctcgaagccggtatctccgtcatcaccacactgaacgtccagcacatcgagagcgtcgccgccctcgtcgaggacctcctcggcgtgcccgttcgcgagcgcgtccccgatgcggtggttcgagccgccgatcagatcgagctcatcgattcctcgccacaagcgctcaggcgccgcctcctccatggccacgtctacccgcccgatcgcatcgagtgggcactcgagcactacttcaccacccgcaacctcaccgtgctccgagagctcgccctgcgcttcgtcgccgactcgcaggtcccgaccccaacactcgcggtcgcatcccgggctcgttggcaggcgatcctcgagaccaaggagcgctacctcgccggcgtcacgctctccgcggcgtcgccacgcgtgctgcgacgcgcagcccgcatggcgctccgcagccacgctgacctctatgcgctgttcgtacaccccgacgagtacgatcccacgcgcgatgcgcctcgcctcgacgcgctccgcacgctcgccgccgacctcggcgcgatcctcatcgaacgtgacggctccgacatcgcgacgctcctcgtcgacgaggcccgcgctcgccaagtcacccagatcgtggtcggcgcctcgaggcgccggcgcatcgacgagatcctccacggctccgtgctgaaccgactgctgcgactcgccggaccggtcgggatcgacgtccacgtcatcggcgttcgcgactacgacccgagtccggatgagttcaacggctgatcgccgccttgcgctcgagacgcgcgagcgccatgttgagcgcaaggacatccaccacccgctcaccaaggaacccgaactctggaccagtcgccgtcagagcaaccaagcggcgcagctcgctggccggaactccggtcgcgcggtgcaccatgggcacctgcgccagtgcactcgcgaccgagatctgcggatcgaccccgctgcccgaggtggtgacgagctcctccgtcggcaccaccccttctgcccgccagtacgcaacgagccgtcgcgtcgcactgaccaaggcggccgagcgcggaccgaggttcgtgccgccggtggccatgggatcgtcgccatcgggacgcccatggaaccagcgcgcaccccgccaggtctggccgacgagcgtcgagccgtcgggtgtcaatgacccctcggcctggcgaggaaagaccgtctgggcgatcgcgacctcgatgagcgggtacgcgagaccacacagcacgaggaagaccaccgcggcgcgcaccgagcgcaggagcgtccggatcatgagaacgccctcgtcgcggcgagcacaaggtcgatcagcttgatgccgatgaagggcacgatcacgcctccgatcccatagatgaacacgttgcgccgaatgatcgacctcgccgacgacggtcgaaagcgcacccctcgcagggccagcggaatgagcgccacgatgacgagcgcgttgaagatcacggcagacaggatcgcactctccggcgagtgtaggtgcatgatgttgaggaccgagagacccggataggccgtgacgaagagcgccggaatgatcgcgaagtacttggccagatcgttcgcgatcgagaaggtcgtcagcgcaccgcgggtgatgaggatctgcttgcccacctcgacgatgtcgatgagcttggtcgggctcgagtcgaggtcgatcatgttggcggcctccttcgcagccaccgtgccggagttcatcgcgacgcccacgtcggcttgtgccagggccggggcgtcgttggtcccgtcacccgtcatggcgacgagcttgccgtccgcctgttcctcgcggatgagctcaagtttgcgctcgggtgtggcctcggccaagaaatcatccacacccgcctcggccgcgatcgccgaggcggtgagcggattgtcacccgtgatcatcaccgtacggatacccatcgcgcgcagctgttcgaagcgctcacgaatcccggccttgaccacgtcgcgcaactcgatcagcccgagcacgcgatcgccagctgcgacggcgagcggcgttgctccctcgcgcgcgatcgacgccgacagctcatcgagttcgactgggatcacgccaccctgttgacggacccattccttgaccgcctcggtcgcacccttgcgtatcgagccctcgtcggtgtcgacgcccgacatgcgcgtggtcgccgtgaacggcacgaaccgcagcgacgccgggtcgacgggatcacgaagaccgtaggcgtccttggcgagcttgacgatggagcgaccctccggggtctcgtcggcgagtgacgccaggcgccctgcggcagcgacgtcgccatcggccacaccgccgatcccgatgaaccgtgacgccatgcgattgccaaaggtgatggttccggtcttgtcgagcagcagcgtcgagacatcgccagcggcctctacggcacgacccgacatcgcgagcacgttgcgctggaccatccggtccatgccagcgatcccgatcgccgacaggagagcgccgatggtggtcgggatcaagcacacgagcagcgccacgagatcgacgatcgggatgccgacgtgcgcatagtgggcatagggctcgaggacgaccacgaccggcacgaagatcaccgtgagggcgacgagcaagatcgagagcgctacctcgttgggcgttcgtcgtcgatcggcaccctcgacgagggcaatcatgcgatcgaggaagctctccccagcacccgcggtgacccgaacgacgatgcggtctgagagcacgcgtgtgccaccggtgacggacgatcggtcaccacccgcttctcgaatgacgggtgcagactcgccggtgatggccgactcatccaccgaggcgacaccctcggtgatctcgccatcggcagggatgacgtcaccagcctcgcagaccacgagttggcccgcgacgagctgcgtcgccggcacccgctcctcggttccgtcgtcacgcagacgacgagcttcggtctgcgtacgggtgcggcgcagggcgtctgcttgcgccttgccccgcccctccgccatcgcctcggcgaagttggcgaagagcacggtgaaggcgagccacaccgtcaccagccacgagaacagcgatggatgcacgatggaggcgatcgccgtcacgatggtgccgaggtagacgacgaacatgacgggattgcgcacttgcacacggggatcgagcttcgtcagcgacccccgcagggcgacgcgtagaatcgtgcggtcggtcagcgagcgcgaactggcgaccccacgtacgggcgtggcggatggacgagtgggtgcggtcatgcgaagaacctcccatgggcgacggcctcggcgatcggaccgagcgacagagctgggaagaagttgagggcaccgacgaggatgatgacgccgatcaacagccccgcgaacatcggcgtcgctgtgtcgaacgtgccggcggtggcaggcaccggttccttggcggcgaggcttccggcgagtgccaggaccggcaccatgacaccgaagcgacccagcagcatgacgatcccaccgacgatgttgtagaaatcggtgttcgacgagagcccggcgaacgccgatccgttgttgttgccttgggacagcatggcgtagaacacctccgagaagccgtgcggccccgcgttcaagatcgcggcgcgcgcgctcgggagcgcgatcgcaaccccggtagcaacgagcaccgtgatcggcatgaccaacacacccaccgaggcccagatgatctccgtgcgctgaatcttcttccccagatactccggtgtgcgcccgaccatgagccccgcaatgaacacggtgacgatcgcgaagatcaacatggtgtagagaccgctccccacccctccaggtgtgatgtccccgaaagccatgccggccatcatggcgaggccgccgatgggggtataggagtccatcgaggagttgaccgatcctgtcgacgtctgcgtcgagacgatgttgtagagcgtggagttgtcgatgccaaagcgcgactccttcccgacgaggttgccacggctggccagcgccccggcagcatgctggatcgcggggttcggctggtgttcggcaacgagcgcgaccgcgagggtcacgccaaagatgatccccatcgcagcgaggaccgcaaccccatcgcggacgctcgccaccatgcggccgaaggtgtaggtcagggccaccgggatggcgaggatgaggtagatcgagaggacattcgtgaggcccgtcggattctcgaaggggtcagcaccgttggcgttgaagtagccgccgccgttggtgccgagctgcttgatcacctcctgagaggcaaccgggccacgggggatgacctggtggaccccgttcagggcgtcgacgacgtgcacggggccacccagcgtctcgagagcaccctgccacacgaagaccaccgccatcaccagcgagatcggtagcaagatccacaacacgccgcggacggtatcgacccagaagttgccgatggtggcgcgcccccgccgagcgataccgcgcacgagcgcgatcgcgacggcgatcccgacggcagccgaaacgaagttctgcaccgcgagggccgccatctgcgagaagtacgacatcgtggtctcgccggcgtagttctgccagttcgtattggtcacgaacgagaccgcagtgttgaaggcgagagcaggcggcacgccaacgaggtgctgcgggtcgagtggcaagtgcgcttgggagacgatgatcaggtaggtgacgacgatcgagacaccggagaagacgaggagggagcgcgcatagcgttgccacgactgctcctcgctcgcgctcacgccgacgagcgcgagcacgggccgctcgagtcgaaccaagaggctgtagcggccctcgtacaccccggccatgtacgcgccgagcacgcgccaggtcaccgccaaggccacggcgagcacgatgagctcggtcgcgaacgtcatggacgacacaccacctgttgcatgagtccagcctcgcgccgcgacacgcggagccgacacacaaccggcgatctgtgacgctcctgagacgcgcgaccgcccctgccgtgacaccgccgtgacggcgtgatggtggccccgacctgtagccttgtccccatggttgatcgctcaccgcgaacccgactgcgtcgcttcggcatcgcttcggtcggcgcactgatggtcgagctcgccttcggcctcgcaaccaacgcactcgtgcacatccctgtgcacgacccctggggcggagcgcacccaggctgggtgctctacgtccacgccgcgatcggcttcgcgctcctcgtgaacggcgcgatggtcgtcaacaccgccatcgactccggcgtcccccacgccctcggtgccgcagtcgtcggcgtgctctcgatcatcgccgcaatcggcgccggcatcgccttcgtcaacaccggtgcccagcaccagatcctctctgtggcgatggcgctcgcgttcgtcgttgcgctcgcggcctacatcgccctctggcaagctgcccgacggacccgcgtcgcctagtcgctgacctccgacccgggcatcgggacgtccaaggcgcgcgggaggatcctcccaaggaccggcacctggacgacggcgagcccgacggcgagcccgagcacgccgaggatccaggtgaatagcggcgcgagcgcaatgacggttgcagcgagtggcgatgcgaggaccgcggtcgtcgaccagagcgaccctgagagcgcgttcgcccgagctcgctcctcgtcgctcgccaaggcgttgacgagggcgggcgcgaccggcgagtagagcgtctcgccgacggcaaacacacccatcgccacgatgagacagagcgctgcgaagccgcgatcggcgcgacctgccagcgcaaccgcagcgatcgcccagctcgctgcccatgcgatggtcgccgcgagcagctgtcgtgaacggcgccaccgcctcgtggcacgactgacggggacctggagcaccacgatgacgatcgtgttgaccgtcagcgcgaatccgagaatcgccggtcgtgcaccgacttgcacgacgacgaaggccccccaccccccatcgagttcggcatagcccgcaaggaggagcccgatctcgatgagcagaaaccaacgcagcgcgacgttgctccgcaacagggcaaggtagccccctcgctgacgcgcgtgcctcgagcctgtacggggcacccgcggcgcaatccgcaccgcgacgagcaccgccgccaccgcctcgacaccagcggcgatcaaccacaagacctggtagtgcacgagctggcctcgcccgagatacaggcccccgagcgccgacgcaaggccgataccagcgttggtggcgaggaagagccgcgcgaagacgtggtcgagcgtacgtcctgcgaccagcgagccgacgatggtctgaccggccacccagaacaccgcctgcgagaggtacgacaccaacacggcgacaaaggcgatccagtgacggtcggcgacggccatcgcaccgtagccgagcgcccccgcgccgatcgcgatcgtgagggccgatccgagccgcagtcgatgccccagcagaccgagcgccatcgacacggcgagtccacagatcgaaccggcggcgagcaacccaccgacctccaccagcggcacgcctcgggcaaggtgcaggtaggccacgatgtagggcatgccgagaccggagccggctgcggccagtccgttcacgacgtagagcgtgccaagcggcgcaccggcttctcgggagatcggcacgccacaaccctagggccgacgagccttggaccgaggctgtccatacgagcgaccgaagttgggtaccgactcgtccagctgcgaccagctcgcaataagatggcccccgtcacggttgacatcactgcacgctgaccaactctcgaccgccgaaggagcagccgcatggcgacatcgacacccccgacgcacggccgactcgcaccggtcttccatctcttcgacctcttcccgctctcggtctcgagcgtggggccggtcttctcggtcgccgcgaccggtggcgtcatggccgcctatgccgggtggtgggcccttcccgccatcgccctcctcgccacgccgttcgtggtggcgtccttcgtcttccgcctgctcaatcgccactttccgcacgcgggggcctcgtaccactggtccgcacgggtgctcggccgctccttctcccgctaccaagcctgggtcctcattctcgcgtacttcttgtcgatcccacccatcgcgatcccggcgggctcctataccctcgccctcatcgacccgggccacaccccttccaatctcgccctcatggccgtgaccctcggctggatcctctttgccgcgatcccgctccttgctggcgcacgcccgaccgctcagatcaccaaggtcttcatggtcatcgagatggtgtcgctggcactcatcggcatcgtcggggtcgcgcgctttggcgcgacccacgtcccgatccacttcggccggccaccgatcggtgggatgctcatcgtcgccgtcgtcgcggctacggtactcgacggctgggagatcgattcctacgcagccgaggagtcgcacaagccccgatccgaaccggggatcagcggcatcatcggcgcgttcctcgcgctcgtgttctacgcgatcctctatccgttggtctttgccgaaaccccgatgcgactgctcgcgtcgccgcgtgacgccgatccgatcgccctgtgggcacagcgggttctcccggccggcctccactggaccgtgctcattcccatcctcggctcgacggccggtggactgtggctgaccacttacatcttgacccgagccctctatgcgatgggccgcgaacgcctcgtcccgcaggcctttgcccgaaccagccgacggcgcgtccctcacgtcgccaccatcgtcgtgctggggctcgtcgtcgtggtcgtcgccgtgcagaccttcgtctcctcgctgtcgagcttcttcgccctcgtcctgtcggcggcaggattcttcctcctcgccgagttcctctccgacacggtcaccgcgatcgtcttcctcacacgtgcccatcggcgtcttggcatcgaggacgaccatcaccatccggtgctgctcgggctcgccatcgtgtcggcgctcatgatggccggattgctcgtcgccttcttcgtctatggtccgagcgcgatcggcagcgggatcgaccaggtcacggccgtgctcctcgggcttggcatcgtatttgtggtgcttacacggcgtcgaacgaccgcccccgtcgtcttcgtgccagagggcgcggacgactgaggtcacccgcggcgcacccgcaccgccttcctagggcaccacgacgagccggaccgacccgacgccctcgatgatcccctcccagtgacccggcacgagcggcaccatcggcgtcaaggtgccggcgagcacccactcaccgggctcgagggaaccaccgtggcgggctacggcaccggtcaaccacgcaaacgagcgccgcggatcgccgagcaccgcctcggacccgccccggaccacctccgtaccgtcgcgcgtggcgatcgcgaccaggcgatcgaacgggatgccgtcgcggctcgccacgcggtcgccgaggacccacaggccggctcccgcacgatcggcaatgaggcttctgccccgcaccggccaaccgacgatccgcgagtcgggaatctcgaaagcaaccgccagctcgtcgacgacgtcgtcgacttcgtcaggctcgagaatcccctggatgcgctcggccacacgcagggccacctcgacttcgagccgcggatcgacgagccgcgcgagcgacaggtcgctacctgacccgatgcggtcatgctcggcgagtggtccgaagatcggctcctcgagccccatgcgacgccgagccgcttcgtcagtgaggcccactttccaccccgaacgcacggccccatgggcgtcgcgccgtgcccacaggcgcgcttgcacctcgtaggcgtcctcgagcgacaacgttccgaggtctgactcctcgacttccgacgcctcgagcagctcggcgaccgcctcgaggcgatcgccacgagaccggacttgcgcacgctcacgctcgaccatggcacgagtgtaggtcgcctcgcgtgcagaggactcgagccgccggccctccttgggtggcccaatcgtcgaccaccggtcaggtcgcttgcgatctggacgtgctcgccgaacgtggggcttcgtcagctcgcagcaccggcacgtacgagctccgcgagcacgcggagcgcgtcgcggggaccgctctggcgaccgagtctgagcacccgacgcggcgacaggacgtaacggcccgacgggagcggctcgccaagcaagatcgaccgagccgcaacgctcgcaagcgcaccgccagcggcggctgtcgagccaagctgcacgaagcccccgagttcggtgccgacagcgttggccgatcggatcaatcggacgctcaggttccgaacaccgacgatgcgcaccagagctcgtcgctcctcggcccgtgggagcgagcccttgagcagtcggtcgagggtcttccgggacagccgcccgttgaacggcacggtcggcccgagatcgtaacgctcgacgtcgaggacggaacgttccccgaaatcgccgaccgtcatcagcgcgacctgagccgaggccgcccatcgccgaagtcgggcctttgcgaccacgtcatcgacctcctcgatgacgagatctggacgaaaggcctccagcatggcgtcggccgcctcgtcgtagccgccacgaagatgcacctgctcgatgtagggatcgacctcgctcacgaactgcgcgatgaggtcgagcttggccatgcccacgtgtcgcatcgagccgcgaatgcggttgagattcgtcagcgtcactcggtccatgtcgccgaggagcagcgcagcgccgatgccaacgcgtaccaactgttcgacgatgacgctcccgacgctcaggccgaagacggcgatacgcgcacgctcgagccgtcgttgctcgtgggcctcgatcaggtatcgattccgtgcactgcgcagtgcccgcagatcctcgacactcggatagcgcacgagctcacacgaccacgggaagtagaaccacgtgccgtagcaatccggatccccaccgacacctgcgcgcgctgtaatctctgcacgagactcggatcggcccctcgggttctcgaactcgtcgagctcctccagcaactcgccgaccgcatcgacggtcctgtggatgcagacctgctcgcgaaggtcggcgagccgacgacgatcctcctcatcgtccgcgacgaatcgggctggaggcgcccacggccgccgaccgttcacgccctcgccacacgtcgccatagtgatcagccccctcctcagcccgcacgagcacccgacgctcatgcaacctcggacgccgaggtggtgcaaccataccacggtgcactccgaccacgcaggtgcgtcgatcgatccagcagaccaagcgagcccacatggtcctggccggtccccctgaaacgaggccacccgctctgtgagaaccgcgacccgaatggacgagcgagaaggagtgtgtatgaagcgcaggaagcgccacaccccggagcagatcctccggaggctggccgagggggacgagatgctcaacacgggcgccacggtcgctgaagcgccccggatttcgtgcgcacccccgtaggtgggaccgattcggactcggccgccatagtcctcctgctcgacctcgactggcaaacgacgtcccagccgctgcatgagccttgcgcgtgtcgtagcagcgcacccggaccgaggtcacctcctcgcaatccgtgaggctcgccagaggcccgctcaaccatcgctacttggatccaccgctacaacactgtcgggctgtacccgagcctcgagtagcgactatcgatcgaggaggagctcttctgggcccgggaggagaaggccgtggcccacctgcagcccgtcgagcaagcggcgcgagtccaccgctgtcaaccttgagaggagagccaacgacagacagcgccccacggtctcgcaccgagcgcacgatcgacgaggagatccctctccagctcgtggacgcgcgtctcgcgtcggtcgtcgatctcgctcgccaccactcgtggtatccagggtcgtgcgtgtcgcgatggggaacgctctcgcgtcgacgccgacaccgcaccgcttcgacttgacatcaggtcgcacaagcgaagcgatgggacacgtatgccagcgacggccttgcgtgcggcggtcggcgttgcgtgcggcggtcggccttcgtcacacggtgcccccggcaggattcgaacctgcgcacatggtttaggaaaccactgctctctcccctgagctacgggggctgaaccggcacccactatggtagctgccgcccatcgctacgaccgagaccagcctgcacgggaatgcacgtccgaccgtcggccttggcatcggtggggagatggggaggttccatggaagacgtcgtcgctgaaccggtgatcgcgcgcctcgtacgactcacgccggccgtgcgtgcgcgcctccgcgcgatgctcccggcgagtgcggtcgacgacgtcatccaagacacgctcgcggcggccgtcgcacaccacgacgagctcgagggcacggacggacgcctgctgggttggttgctcgtcgttgctcgtcatcgcgccatcgactggctccgtcgccaccgcgggccactcgatattcgaaccctcctcgtcgacgacgccgacacaccggatccggcgagcgccgtcgtcgaccgcgtcgtcctcgaggccgcgctgtcgctcctccctcagcaccagcgcgacgtcgtcgtcgcggtctgcgtccatggcgccccgatcacacgagtcgccgacgacctcggcgtccccgcggggaccatccggtcgcgtctgcactatggacttgcggcacttcgatcgcacctggaggccaaccgtgccatcccatgacgatgggtgcacgctccgcgaggcgtacctgctccacgagctcacgcctgacgaggtcactcgcttcgaggggcacctcgcttcctgcaggtcgtgccaggaccgcctgagcgacaccgcgcagttgctcagagcgctcgcagacctcgaaccacccgacgaaccggtgaccgggtcccaggtggcgcccatggcgcacgaccctcgcccagctcgcgtcgccggccacagtcatcggcgccgtcggggggcgctcatcggattggccggcctggtcgtcggcgcgtcgctcaccttcgcgctcgagcatcccgccgagcagaccccgtccgcggccgaggtgatcacccttgccgctcccccgatccacggcacgctcgtcgtcgaccgccgtgcatggggatcatcgatcaccctgacagcaaccggcctaccgtcgacgggccaggtctcactcgtcgtccgctcgaccggtggacaggtggtggacgcagcgtggcgtgcgatcggaccccagaggatcaacgtccaggcgccgaccccattccaaccgagcgccatcgcagccacgacgctcgtggcccacggccgccacacgaccgtgctctggagctggcaccgactcggcacagaaccggggaccacctagacgcgcgcacacgacgagtgcacgtttgcaatcatgcggcctacgaacggctacactctgctatccgtatgggcaacacgcctgcccatgcaaggaggcacggatgctggtcgtcgcccgccacgctcccgcaacccgaccccggccgggcatggccgatctcgagcgctcgctcaccgaggagggactcgtcaaggcacaagcactctcggtcgagctggtccggctcgcaccgacccatctcgtctcgagcccggcacgccgctgcatcgagaccttggcgccgctcgcgaaggcactcgatctcgagatcatcaccgatgatggccttgggcccagtgcgaaggctccacagatcgccatgagcctcgcctacctcggagcgctcgacggtgtcaccgtcgtcgccacgcacgcgccccagctcgaagtcctcctcgagcagttgctcgccgatcacggcatctccgtggacgccgacgcactccatctcccaccggccggctacgtgatcgtcgatgtcgccgaaggcgtgcgtccccctcgcatcgaccgcgtccgcgcctaccgcgacgtgggaacggacccgctcctcctggtcggctagcgtagccccgtggacagagcgctcggggtcagcgagctgatcgggcgcgtcaacgacgccttgggttcgctcggcctcgtcaccgtgcgcggcgtcgtcgagtcggccaaggcctcccaacgcggtcacctgtacttcgatctgatcgacgacggcgaccgccaagcccgcgtgagcgcagccatctgggcgtcgcgccgtgccggcatcgagacggcgttgcgccgcgctggactcggctcgctcggcgacggcgcgctcgtcgtggtctcgggacggctccaggtctacgctccgcgcggctcgatgtcgctcagcatcgaccgcgtcgagatcgaggcgatgctggatgctcgcgccgcaacccgccaacgccacctacgccaactggccgccgaaggcatcgtggacgccaaccgacgcgtgccggtccccgccgtcgcgctccgcatcgcgctcgtcgcctcgcgtgatggcgtggtgcgtgaggacgtgcgacgcgcgctcgccgacacgggcttcgcgttcaccgtcaggttgtaccacaccgaggtatccacccgcgcagcgagcgtccagatccgccgcgcactcgcggccgcgatcgccgaccagcccgacctcgtcctcgtcgcccgtggcggcggttcggagggagacctcgccgccttcgacgatctcgaccttgcccgagcggtcgccacggcaccggtgccgatctgggtcgccatcggccacgccgtcgatcagccgctccttgcctacgtcgccaactgcgccttcgacgtgccacagagcgccgccaaggccctcgtcgcccgggtcgaggactttcgcgagggccttgccaccgagatcgcaaccgcgatccatcacgctcgggcacggctcgatcgcggctggctccacacgcgccagatcgcccacgccatcgaagcacactcgcaacgacgtcttgcggccgcacaccgcagcctgccgagcccgtccgtcctcgacgctcgcaccgaccagcgcctcacgaacgagcgccacacgctcccggcgacctccgtcatcgacgctcgagtccgggcgcggctcgctcgcagtcgcgcggtgctcacagcagcgcgatcggcccgcgacatcgtccgcctccgcgtacgcctcgaagtccgccagctcgtcgaccaccgccgtgagctcgccgcggcgacgtcggccatcgccaccgctcaccgcactgagcttcacgcgcggcaacgacgcctcacgcgcgccgcggcacgccggcgagcacaccacgatgccgctctcgccgccgtgcgtcggcacctcaccgccgcgtcgtaccggcgagctcgccgggatcgacgcggcctcgagttgctcgcacgccgcatcgaggggctcgcctcaccgctcgagcgcggcttcgccatgatcaccgatccgacgggcacctggcttcgccgcgcggacgccatcgcaacccacgcaatcgtgcacgcccacttcgtcgacggcgtcgccgcgctgaccccagctcgacgatctccgaccacgacgcatccccacctgaccacgcgccaaggaggacgacccaatgacgactgacccggccgatgttcgctggctcatcgacctcgacgaggacgccttcgcgcgagccatcgagcaacgctccttcgaggatcttcgcgacacggcactcgcactcaccgaactcatcgactccgacgccatcggcgtcgatgacctcgcgaccgtggtacggcgtgcgagggccatcctcgacgcgtgcgatctgcgtctgcggcgcgtggagaacgaactcgaccacgacggcaccgccgtcgaggaagcctcggccgaggtcgaggagccgttctagagctctgccgcgagcgcgtcgagggcatcggcgagtccctcgacgatgaccccgatctctgcgggctcgatgatcagcggcggagacagagcgatcgaggtcgccagcacgcgcacgatgatgccacgctcgagcgccaggcgcgcgagtcgagcgagggcgtcggggtgttcggcgagcaggtcggaacgcagctcgacggccccgagcagccctaggccaccgcgcacctcggcgaccaacgcagaggaggccagcggtcgaagccgagccagcagctcgccttcgagcaccgcccctcgtgcgaggatctgctcgtcctcgagaatgcggcagttcgcgatgcccgccgcagtgcaggtcggatgacccccgtaggtcggcccgtgccgaaagaccggggctcctggttgcttgaacggagccgccacacggcccgacaccatgaccccaccgagcgggagatagccgctcgtgacccccttggcgaaggtgatcagatccggctcgacgccgagacgctcgatcccgaaccaggtgccgagtcgaccgaacccgcagatcacggagtcgacgatgaggagcacaccgtgtcgccggcaggtcgctcctagcgcctcgaagtagccgggaggcggtggatagacgccgccagcaccgatgacgggctcggcgatgaccgcggcgacccgctcagggccattggcgacgatggcggcctcgacggcctcgacgtcgtcccacggcacctgcacggtggtcgggatgagctcgccaaagcccgtccggttggcagggatgcccccaagagaggtgccaaagccccaggttccgtggtagccgttcgttcgcgagatgagcacggtgcgctccggctggccgacgagcgagaagtaacggcgagcgagcttcacggccgtctcgacggcgtcaccgccacccgacacgaagaacacctccgactcgggcatcggcgagcgagccgacaagaactcggcgagctcctcggccgggcgattggagaacgtgccgaacgtggagtagccggcaagctcacgcgcctgcgcagcgatcgcatccgcgatctccgcccttccgtggccgacgttggcgtaccacagcgccgcggtcgcatcgaggtagcgccgtcccgtgtcgtcgtagacccagatgccctcgccccgcacgaacaccaccggattcgtgtcgctctcgtagagctgaccaaacggatgccaaaaccgtcccatgcgtccctcctcggacgcgagcctacgggacgtggcgaacggtgccgtcctgtcgccgcacgacgacctccgaacggtcgcggccccgctgcttggccagatagagcgcgacgtcggcggctgcgagcagcgcccgaagatccggcgcgtccgtctcagccgactccgccaacgcgacgcccaccgaggcactcgcctcgacaccgacctcggcgcgaacgctcgaggcgatcgatgctcggatcgcctcgccaagctggcgagcccactcgagttcgacatcggtcacgagcgccacgaactcctcgcctccccagcgcgcgaccaagtcgcgcgctcgcaggcacgaacgcagggcctccgccgaggcgcggagggcaaggtcaccggcgaggtggccgtactcgtcgttgagggccttgaagtggtcgagatcgacgaagaccaccgcgaccgcacggccctcgacctgagcgtcatggagcgcctctgcgccggacgcctcgaaggttcgacggttggcgagcgcggtcagggcatccgtctccgcgtagcggcgcaactcctcagttgcgcgaacctgcccgacagcgatcgcggcctggtcggcgaagaactcgagtgcctggatctggccgaggtccggatagcgaccgtccaccgggttgtcgaccgagatcactccgaggagccgctcgtcctcgagaagtgggatcgacagcgtatcctcgggctgccaggcgtcgtcgtcggcgacgtgctcggctaccgggaccgacatgcggcgagcgaggtcggggtgcagcggataggcgcgatgccggaacaggtacgaccgagagatgcgcatctgcggcgccatgaccgcggcgaacagcgagagtgggatgggaccctcggtatgcaggcgctccgcctcgacgggatcgacgccactcgtcaccgcgaggacaagcgaatcgccttcgcgcaggtagatcgcggccctcgcgaagccacctgccgtcgtgacggcatccgcggcggtctggagcacctcgaggagcgccgtgcgccgctggacgtctcccgaggccgcgaggagccctgcgagtcgagctcgctcggcctcgaggatgcggacctgggccgagacgcgcgaacgcagatgctcctggacgagggcgagcccgaccagctgtgcgagcacgtccaggtacccgacttcctcggcgtcgagacctccgaggctcaccggctggtcgaggaacaagatggcgcccacctcttgctcccacgactccacgagttcaaaggtgagcgttgccgggttccacccctcgacgagcgactccgtctcgcggatggccgccttggcgagcagctcgtcgagcaacgggtggtctccgtcgacgacgtggaggctaccgatgcgccgcgccaccgcaacgaggcgatcgagatcggagcgtgcgagcgcgatctcccggagctcccgagccgaggtcaaccgacccgcgacgtgggtcacacggaagtacccatcgccctcgagactcgcgagcccagcactggcgaacgacgtcaacggagcaatggctgcacacagcgcgcgatcgaggaccgtgtcggtcgtcgggcgggcgagaacctcacccgcgatggcggcaagttcggcgaagcgccgcgcggtcatggcctctcctccgcctcccctcatcggcactatcggacgctggatcggcgatctcaagtcacacgggcagcctcgcccacgccgcgctcagcaccgtggagcgcgtgtcgcgcctacggctgcccgaacgcgaccggcgtacccgaccacccgatcgggtcgacggcgaccggccgaccgggttccgtggcttcgaccaccgacccgccgccgacgtagatggcgacgtggtcgataccggacgaccccaacgtatcgtagaagacaagatcaccggggaccagctgcccgtagccgataggcgccgagtcggcggcctgcgcagcggcgtcgtgcgggagggcaaggccgagctgggcgaagacgtagctcacgagccccgaacagtcgaagtactgcacccctcctgaccactggcccgcggcgccataggagtaaccggtatccccgcgcgccgcgatggcttcggcgatcgaggccgcctgctcgagcagcgatgcggacgcaccctgagccggcggcgtcgcggcaaccgccgccgtctcggtggcgagttggacactcgcccgctgctcgaccgctcgctgctgagcggcttgggcctgagcgacgagctgggccatctggcccttcagcgacgccaacgccgactcgacggacgcctgctcgctcgcggccgccgctcgcgcagcggcggctaccgccgccgtctggctcgccgaacgcacgagtgccgcgagctgggttcgctcgacctcgagcgcgagtgccatggcccgatactgggcgacgaggcttgtctcgtcggtcgcggcgaccgacacgtccgtctggacgatcgctgcgctgttcgggctcccggcgagcaccgcccccatgcccgccaatgcgtcaccgctggtgaactgatcgagggccgcacgggcgagccgggcccgttcacgcccgagcgcctgtgtctcgctcgcgatacgcgcacgcacacccgcgagctcggcctgatcctgggcgagttgcgccgtcgccgcgtcgtagcgctccgccgcgacctggaccgcaccgtcgagggcggtgagcttcgcagcgagctgagccgcttcggactggtcggtggcgagatcgacgggacgcgcaagcggcactgcttggagcgaggccgtcacggccgcagcgatgccgaggagggccgcccgcaccagcacgcgccgcatcgcacctcccgcacccagattgcgctcaggctaccatgccactggcggccgcaccagacaggcgacggcggcccgtccgagcgatggaggtcagcgatggtgcacggcgtcgacgacacggcccagggagcaccttcgggcgcactcgccggcatcgtcgtcgcggacttctcacgggttctcgccgggccgctcgccaccatgatcctcggcgacctcggcgcgaccgtcatcaaggtcgagcaccctcgcggcgacgagacgcgcacctggcgccctcccgagcgcgacggaagggccacctactatctcagcgtcaatcgcaacaagcgtgccatcgcgctcgacctcgacgacccgaacgatcgtgccatcgcatgtcggctcgccgcccgagctgacgtgctcgtcgagaaccttcgagtcgggaccatggcccggtggggcctcgcctacgacgacctccgcgcgacgaacccgcgcctcatctacgcctcgatctcgggctatggtgacggacccggcgctcacctccccggctacgacgtcgcgatccaagcagcgagcgggttcatggacctgaccggccaaccagacgggccagccacgaaggccggcgtcgcgatcgtggacgtcgagaccggtctcaccctcaccatcggtgtcctcgctgcgctcgtcgcgcgggagcagacgggacggggccagctcgtgcggaccagcctcctccagagcgcgttgttcggcctcgtgaaccagatcggtggctacctcgcgaccgggaacgtgccacgacggctcggcaacgcccaccccagcctcgcgccctaccaaccgctcaggtgcgccgatggcctcctcgtcatcgccgtcggcaacgacgcgcagttcgagcgcctcgcgacggcgctcggcctcgacggcctcgaggatgacccgcgctttggctccaacgccgatcgcgtgcgccaccgcgacgagctcgccgagctcctcgaggcgcgactcgcgaccgagacccgcgagacctgggcgcgccgtctcgaagccgcgggcgtccccgcatcgcccatcaactcggtcgccgaagcggtgacgctcgccgagtttctcgggctctcgcctcgagtccggcttcccggcccgctcgagctcgacacgatcgcgaacccgctcgccctctccgacacaccggtcacctacgcgctcgaacctccggatctcgacgccgatcgcgactgggtgctggcgtggctcgatgcggcagaacgaaacgcctgaacgagacgccgtgccacgtggacgagccgcccatcggcaccgaatggcccgacgacctggaccgagaacggcacccggctcgttcgccacgggcccgctccgcccccgaccggcacgctgagcgccggcaggccgagggcgttccaggggatggtgagctcgttgagccgcaacgtcgaccaggcactgaggggtccgggcggcgcgaggagggtcggcacgagcgcgagcgcctcgctgtcggcgaaccaggcctcaaaggccgcccgccacgcgtggagccgagcacgtgcctcgagataggccgcaccgtcgaccgcgagcgctccctcgagccgtcgcctcacccacggatcgagccgatgcgcctggcggaggagccatccccacgtcgccgccgcctcgaagtcgaggatcgtgccgccggcacgggcgagctcaccgagatcgaccggcgccgacaccagtcgctcggcgagctcgccgagtcgcccatcgacgttgggctcgccgacacccacaccgacgagtggccagtcgcccaccagctcgtcgatcccgagcgcacgagcgccctcggacagccgatcgatgtcgggggcgatgagccccacggtgtcgagactgggcgccagcggcgccacacccgacgtcggcagaaggccgtagctcggcttcagaccgaggaccccattggccgccgctgggatccgcaccgatccgccggtgtcggtaccgagggcgagatcgacgagcccgagcccgaccccgaccgccgatccactcgacgaaccacccggcacgagcgacgcgtccaacacgttctccggggtgccatcgaacgggttgacaccgtgcgtcccgtaggcgagctccaccatgaccgtccgcgccgtcggcacccacccggccgctcgcaaccgtgcgacgacggtcgcgtcccgaagcgcaggtcccaccatggtgccaaggagccgactcccgacgcgcgtcggcacgccgacgacgtcgatgttgtccttcaccccgaggcgacgtgcgaccggagccgcttcgatcgacggggcaccgagtgcccaattcctaggagccgtcgacatctgcctcctctgtcgcgacgccagacacctgtccgatggtcgcaacctgcgtcacactgggcgccatctgccgcaggtacgtgtcgaagaacgcgatgctgacggcagcgacggcctgctcggcaggcccttcggtcgtgtagggtccgaggtggtcggccccgaggagccactcgaggtacttgggcgcctgggcgtccgcgtagatcgcctgggatgcggacggcgggttcaccgtgtcggcggagccctgcacgacgagcatcgggacggacgagccgaagaacgacccgccgaagggggagaacaccgcgcccgacagcacggcgacggcacgaacgccagggatcgcacagcaggtgttgtccgcgctcgcaaggaccacgtcgccgccgtcgctctggcccgcgagcgcgacgtcgtcggtcgcgacacggcccgcgagcacgcccgagcgcgcaagcacgtccatctcgccgatggcggccgagaggtcacccggttcgttgagcatgtccgactcgaaggcgtccgcgatcgccgcgtcgtgcaggtcgaccccgtaggtcgccagcgcccacgcagagctcagtgggaagcggggagcagcgaccacgtagcctgcgcgaacccacgcctcgatgagcggcacgtacgcactcggatcctcgtcgaagccggccgcaaacacgatgaggggatagggtccacccacgctcgcgaccggggcatcggccacgatggtactcgatgccgtccgggacggatagaagacgtccagcaggtagctgcgttccgaacacgcgtgcgtcgtcggtacgcacgtcaccctgccaggctcggtgacggtcacccgaagctcgcccaccccagcgatctgcccgctctggtgcgcagacgacgagcgcggccgcgtcgacgagggcgctggctcgtgtcgatgcgtcgtcgacgcgctcggggtcgtcgtcgctcgttccatggccgtcgccgtcacgaccgacgccgacgccacgacgacgacggcaccgaccccgacgagggcgcggcgcctagccctgagtctgcgtgaacgagacgccgttctcgacctccgcgatctgcgcgatccttcgcgcgtgacgccccccatcgaagtcggccgcgaggaacgcatcgacgatggcgagcgcgaggtcgtgaccgagcagacgcgccccgagtgcgaggacgttggcgtcgttgtgcgccctggcgaggcgagcggacagctcgttgtagcacagggctgcacgcacgccccggaccttgttcgccacgatctgctcgccctgacccgaacctccgaagacgatcccgagttcggccgcgccggtcgcgaccgcctcggcagcaggctggcagaagagcgggtagtcgacggactcctcagagtcggtgccgaagtcgaggacgtcgagtccagcctcgacgaggtggcgcttgacggcctccttcagcgcgtagccggcgtggtcggcgcccaatgcgatgatccgactcacaggtaggcccccggtgcttgctgggctccaggaggctgcggcaggccgcgaccgcgcaactgctccagctgtgcattcgaggccatgcgctgggcaaacagggtcgcttggatgccctggaacagaccttcaagccacccgagcaactgggcctgcgcgacccggagctcggcctcggacggcacaacgccctcttggaacggcaacgagaaggaccgcagctcgtcggcgaggtcgggtgagaccacctcgctcagcgcgcgcaacgactgctcgtagatctcggcgaggcgctccctggagcgctcgtcgagggtcgcctgacggacctcgtcgaggagcgcgcgcaccatcgccccgatgcggatcactcgagccggcgacatcaccgcatcggtatcggcgctaccagcgttgggctcgcccgatgctccagccgtcgtctgctcggcgtactcagaattctcagccatcagctccctccatcgaccggctacgcacgaccccgcggcagcctacctcaccggacctaggggcccaccgcgatcggcacgaggacctcggcaggggtcagtgcaccgtggcgagcgcgcatccgtagcgcgccttgatcggctgggtcatcgaagaacacgggcgcggtcgcgacgaggcagacgtcgccgaggcgttgctcgaaggtctccgggaccggccccccgaagagcccagcggcgacggcctcctcgcgtgtgaacaccttcgcgacgtcgccgtagcgagcgcggcatcgctccgccaacgccgccggatcgccagcggtgtgcaaccatcggaaacgaccctcgcccgacaccagcgagcagtcgcctcgcacgtcgcgatcgagtcgcagagcgcctccgtcgaccgccacctgaccatgatcggccgtgacgaccagcgtcacccctggcggcagccgctcgagcagcaggccgaccatcgcgtcgaccatgcgcagctcgcgccggtaggcctccccgagaccgaactcgtgcgcggtggtgtcgatcccttcgtagtaggcgtagacgaaccgctccccacgagcgagtgcctcgtcgatacgcgtcacgacctggctcaaggtcgaccaccaggccagccgcgcgccacggagatgcaccttcgtgaagcaggtgtcggcgtaggcgaacttggtcaccgcaacggggttcgccccgaggaacggggtcaccggcgcgagccgctccggtgccggcgccgggcctcgcccgttcacagtccagcgcaagacgttgagcacggatccaggcccgacgacgacgcggtagccaagcacgccgtgcaccgccggcaccacgccggtcgtgagcgacgtcagcgcggtcgcggtcgtcgtcggtgccgtcgagtgggctggcaccacccggagcgcgccgagggtcgcaagctcgtgccgatgctccatcaactggagatagccgagtccgtcgagcacgagcaggacgactcgctcgggtgaccccacgtggtcggccaaccacgcgggtgctgccggctggcccgccatgtcgagcaggccgaagatccccggcaccacaccggcgagcgacggcccgtcgtagcgtggcactatgaagccgtgatcggcctcgcgcgcgatctccatccgccctccttgggccaaggctaccgtgtgttcgccgcagcctgaaagccgaaccgccgcgttcgtcgcttcacgaccactccacggctcgcgtgtccgtgggcgctcggcccgagctcgcgctcgagccgcgaccagcatgggagctgagctccgtcctgcccgcaccccgagcgaacgacaggagtcgtcgcaccctcgaacgagccagcctcgctcgggaacgacccggccccaggcgcgctcgtggcccaaggtgggcgatcgaccgatcgccccacgacctcgcggccaggagctaggctcgagatagtgagggtctccacgcgcggtgactacgcagcccgagcattgctctcgctcgcgctccacccgagcgaccaaccgacctccgtcgccgagctcgctcgacgcaccgggctaccccagccctatctcgagcagatcctcctcacgctgaagggggcagggctcgtacgctcgaagcggggcgcaggcggcggctacacgctcggccggagcgcggaagagatcacccttgcccagatcatcgcggccgtcgacgggccgatcaccgtcggtgacttcaaggaaccccacgaagacggcgcgtgtgaccacgaaggtcagtgcgcgctgctcgaggtctgggccgaggtcggccaccacatggccgatcacctgcgcagctacacccttgccgagatggtgcgccgtgctcgtgggctccgcggcgacgtgctcggcgccgtctcggatcctcggtgatgacgaccgacggcgagagcgacgcgcgctaccccgcgcactgggagagcgacatcgtcgcagccgacggtcgcacggtccacgtgcgacccatccgtcccgatgacgcaacagccatcaggcgcctgcatgggcgctgttcacccgagaccatctactaccgcttcttcacgccgttgccggagctctcggacgccatgctccagcacttcgtggtcgtcgactacgtcgaccgcatggccttcgtcgccgaatccggcgacgaactcatcgcggtcgctcgctacgaccgcctcgcgggctcctcggatgccgaggtcgccttcctcgtcgacgacgcccaccagggccgcggtctcggcgcggcgctcctcgaactgctcgccgcctacgcgcgacagcacgggatcgggcgcttcgtcgccgagacccttccggacaacgtccgcatgctcaaggtgttccaggacgccggctatcgagtcgcacgcacctgggccgacggcaccgtgcatgtcgtcttcccgatcgatcccacgccgagctcggcggccgtgatggccgaacgggagcgccgggcggctgcccgcagtgtggccgcgctcgtcaacccgacccgcgtcgccttggtcggcgcgagccgaacgccgggcagcgtcggtgacgtgctcctcgccaacctcctctccgcgcgcttcgagggaagcctctgggtggtcaacccgaacgccgcagcggtccgcggcatcccgaccgtcccatccctgcgcgccatcggccaacccatcgacctcgccatcgtcgccgtgcgcgccgaggagctccccctcgtgctcgaggacgcccacgccgccgaggtgcgtgcgctcgtcgtggtcaccgctggcttttccgacatcggccccgaaggggccgaggaggaacgtcggctggtggcgagcgctcgacgtctcgggatgcgcgtcgtcggtcccaactccatgggggtcgcctcgcccgcgatcgggctcgccggcacgctcgcaccctttgcactcgaggccggtggcacctcggtgcacgcgcagtcaggtcccctctcgctcgccatcgtcgccaagttggcgcaggcctcgatcggcatcgcgagcttcgtgtcgtcgggcaacaaggccgatatctccggcaacgacctgctcgcgtggtgggagaccgacgagcggacccgttgcatcgtcctctacatcgaggacttcgggaaccctcgtaccttcgcgcgcgtggccaggcgggtgagcgcgacgaagccgatcctcgtcgtcaaacccgagcgcgagggtcgcagccgtgtcgagcccgaccgaccaggtgtgctcgacaccgaggtcgcgatcgatgccctcctcgagcgcaccggcgtgcttcgcactcagacgctcgaggagctgaccgaactcgttcgtctgctcgagtctcagccgctgcccgccggcgaccgagtcgccatcctcgccaatacccaggggcccgcccccttggtggccgacgccgtcttgcgggccggcctcgatctcgctcccctcgagcccgccaccgtcgagcgcctcggcaccctcggccgcgccgcggctcgcaaccccctcgagctcgggcccggcgtcgtgccggccgactgggaacgtgctctcgaactgctcctcctcgacgccacggtcgacgccgtcatcatcagcttcatccccaccgtggtcggcgcgcccggcgatcctcgactcctcgccaacccactcccgggaggcacgctccgcggcgcaccggcccagagcctcgcgcgcgcggccgagattgccgacgccgtgacgaaggtcgccacccagcgcggacgcgatcgaccgaagcccgtcgtcgcgaacttcctcgcgctcccgggtgtaccagaacgcctcggcgccggtccccgcaccatcccctcgttcgactttcccgagtcagcggccagggccctcggccacgcggcccgctacgcccgatggcgggcgagggccaacggaacgccgctcgagctggtgcccctggctggcgactgggcgcgcgatcccctcgacgaatccgccgacgaggaccgcgagctcgacgccgaggccgtcgcgggcctcctcgactggctggggatccctcgacgcgccccatcgggcggccgccgcgaggaactcgagggtcgagcggtgcacctgcgcctcgagctgatccacctggagcgctacggcccattcctgcgagcgggcctcgctggtgacgccttccgacgcatcggggcctcggtggccgtcgcactgccccacaccgaccgtgacgtgatcgacttcctcgaggcgatcccgggcgcggacctcgtcgtcgggtcggggccgtatccgagcgacgacctcgtcgcgatcgtccaccgcctcgtgacgcttgctgaacgccgctatgacgtggcggccctcacgctcgagcccgtcgtcggcacggcaaggggctggtgggctcgcagtggtcgctgtgtcgtccgaccactgcgcctcgaacccgcgatgatcacgcgaagccttcgcgcgcccggatccccctcacccgcctgagcctcgtcgcaccggcgcgagctcgggtggcgagccgtcgagtggtgacaaaccctcactttgcggcgagcctgcgccctcacaggagggcgtcgatggcccccacgagcatcgggtcctgtggctcgacagtggggcgaaaccgctcgatccgctctccgtcgcgcgagacgaggaacttctcgaagttccactgcacgtcacccgccacgccatcaccatcggggacctcgcagaggctcgcgtagaggcgatggcgcccctcgccgttgacctcgatcttcgcaaacatcgggaagtcgaccccgtaggtggtccggcagaacgtctcgatctcctctgcggtcccgggctcttggccgaggaactgattgcacggaaagccgagcacgacgaaaccatcgtctcgccgtgcatggtagagctcgacgagcccctcgtactgcggcgtgagaccgcagcgcgacgcgacgttcacgacgagcagcaccttgccccgataggcggagagttcctccttcgtgccgtccagccgctccatcaccaaatcgtacgggaacatcgaacccctcctcgcgtctaccgcgttaggtcaaggcctccgtgggcgaagttcttcccattccccagatctcgcccggcgtgctcaggacaggttgagggccgcgtacttgacgttcaggtactcgtggatcccttcgaacccaccctcacggccgaaccccgagcgcttgactccgccgaacggggctgccgcgttggagacgaggccctggttgacgcccaccatcccggtctcgagggcctcgatggtgcggactgcccgggagagcgactcggtgaagatgtagccgacgaggccgtaggtggtgtcgttggcaaggcggatggcctcgtcgtcgtcgtcgaagcgatagaccggtgcgactggaccgaagatctcctctcggaacacgcgagccgtcggaggcacgtctcgaagcaccgtgggcgagaagaagtaccctcggtccccgcgccgctcgcctccggtgaccagtgaggcacccgcagcaacggcatcttcgacgagccccgagaccttcgccaacgcgtcagcgtcgatcagggggccgacggacgcatcgggctccgtaccgcgcgcgaccttgagcgacgccagagccgtcgcgaggcgctcggagaaggtgtccgccagggactcatggacgaggatccggttcgccgacgtgcacgcctccccgccgttgcgcatcttcgcgaagaccgcgcccgcaactgccttgtcgagatcggcgtcttcgaacacgatcagcggtgcgttcccacccagctccatggacaagcgcaagagccctgacgacgccttgcgcatcagcaggctcccgacctccgtcgagcccgtgaacgacagcttgcgcagaccagggtgtccgatgatcgcgtccgagatcgggccggggtgcgaagtcgtgacgacgttcagaaccccaggcggcagaccgacgcgctcgaagatcgacgcaagggcgagcgtacacagcggggtctgctccgccggcttcacgatgaccgtgcacccagccgcgagcgccggggcgatcttgcgtgttcccatggcgagcggaaagttccacggggtgatcaggtagctcggtccgaccggctggcgtgtggtgagcacccgtgtcgtggcgtcgggggagacgtagaagtcgccgtgcacgcgcaccgcctcttcggagaaccaccgcaggaactctgccgcgtaggcgacttcaccccgagactctgcgaccggcttccccatctcgagggtcatcagcagcgcgaggtcatcctgggcagccatgaccgcctcgaaggctcgccgcaggatctcggcccgctcccggggagcgctgtgggcccacgcctcttggtgcgcgacagcagcgtcgacagcctggcgagcgtcgtcgaccgtagcgtcggcgacggaggcgatgacctcaccggtcgcgggatcctcgacgtcgaagcgacccccgtcagcggcctcgcgccacgcgccgtcgacgtagagtcccgtcggcaccgtccgaacgaccgctcgctctcgctcctccacgtcagcctcctcctgtcggatcgcagcaccctgcagcgaccgtagcctaccaagctcctcgcaacggtatccatcgcggaccgcgccgcgtcagctcgattccgcactgccctaggctcaggccatgcacgcatcggagcagtacctgcgcgagctcgtcgagctcgaccccattctcgcgaccgagctcggcctcgacaccgatcgtctccccgacttctcgcccgacggcaacgacgagcgagcgctgctcgctcgtcgcgcacttgcctggctcgccgacgaatccgatccggaccccatcgccgccgacctcatgcgcgagcgactctcgagtcagctcgcactctacgacgccggcgagcacgagcgggcggtgaacgtcatcgcctcacctcagcacgccatcaaggaggcgttcgacctgatgcgcatcgagggtcccgacgacgccgaacgggttgtccgccgccttcgagccgtcccgagcgccctcgccggctaccgcgcgaccttggagcgaggtcgagccaacggccgtctggcgcagcgacgacaggtgctcgccgctgccctgctcgccgaacagaccgcggatgcctacttcgctggcgtcgagcgtcgtgtcctccaggcaacgcagcaaaccgaagccgaccaacggctggcgggcgcgatcgaggccgcgcgctctgcctacggcgagctcgcgagctacctcaaggatgcctacgccccgagcgccatcgaccaagacggcgtcggcagggagcggtgggccctgtggtgccgccacgcgaacggtcgagatgtcgatccggaggaggcggtcgcgtgggcggccgacgaactcgccgcgctcggcgccgagatcgagaccgaggccaggcggctcggcctcgaacccgggcctggtctgctgacggcgctcgatcaggacccctcacggcagatcgtcggtgtcgacgccttcctcgcgtggaaccaggctcgcatcgacgaggccatcgagatcgtcgactcccgagccgtcacgatccccgccgcgatccgtcgatgcgaggcgctcgaggctcctcccggcggtgctgcggccatgtactacacgccaccctcggaagacctcgcgcgcccgggacgcacctggtatccgacccatggcaagacccgcttctcactgtggaacgagctgaccaccgtctaccacgagtccgtccccggccaccacctccaactcggcatcgcgacctggcgtggcgcagcgctcgatcccttccaacgaacgctgggctcgatctcgggtcacgtcgagggctgggcgctctatgccgagcgactggccgacgaactcgggctcttccccgacccggcgtttcggatcggctatctcctctcgcagcgcttccgtacgctgcgcatcctcatcgacatcgggctgcacaccggcatcggtgcgcagcgacgctcggccgagcccctcaccccagagcgcgccatcgacgacctcgtccagatcgcaggtctggagcgtccgttcgctgcaagcgaagtcgatcgctacctcggctggccggcacaggcgaccagctacaagcttggcgaacgagcctggcgagacgcgcgcgagcgcgctcgcgcgcgtggggtcagcgatcgccgcttccacgagtcgctcctcggcctcgggttcatcagcctcgaccagctcgcgaccgtcgcggccacgctggcaccgtaggggtagcgccgtcgtcgtgcgccaccccaacgacggccttagccctgcttgggtggacgggtcgcgctgcgcaccaacgcccgaagggcgagcaccaccacggcgacgatcgccacgacgaccgcaaggctgatgatggcgtgcacaatggtcagcaagaagcccaagaccagcacgcccacgacgacgaccgcgacacctatgaggacacgtccaagcatcggaccacctccacggtcaaccctagaccacgatgctgagcgaagtccgaatccgcgctcgagaaccgccgcacatctcgagtacctagctgacgatgtccttcgacagaaagctcgacacagcagccgtaccccacacgaccaaccacgccgcctgctccgcaaggtccttgaggatgggcgtcaggtaggccggcgagcggaacaagttgatgaacgagccccagtacgtcgagagcaagatgggtcgcacgacggcgagctgcgggacggcgccgatgacctccgcagcgatcacgatggccaacgtgatcgcggtcgccgtgagcgacgacgaggtcgccgtcgagatggcgacgccgacggccaccactccgaccagcgacgctcccacgacgagcgcgctgaggagcacgtcgccgacgccggacgcgacgccgacggcggtcccggacagcgtcacgagccgcccgtgcggaaacaagacgaagcccacgacgagcccgacgaccgcgacggtgagcgccgcgacgatggcgaacaccagtgcggcaacccccttggcgacgacgacccgcgagcgagaccccccggacaggagcaggtagcggagcgatccgttggcggcatcacccgccaccgcatctcccgcgacgatggcgacagccagcgggagcaccagggtccccatggtggcgagcgcggcagccggcaagaagacggcgttctgggtgatgaccgagaagaacggcggaccgccgccgttgcgaggaccacccgcgaccttgaccacgataccgagcacgatcggcaagaccgagagcaacacgaggatgaccaggttgcgaggacggcgaaacacccggccgagctcgtcaacgaacatcgaagccctcccccacctctgcgaggaagagatcctcgagactcggcagcaccggggtaacctcctcgagttcgataccgcgctccaccgccgaggcgatgagtgctggcatcgccgagcgcggcgcgacgacctggaccgcgaccccatccgcagacgccgtcgccccagggagggcgagcaagcgctcgagcggccgaccgcgcaggcgccaggtcggctcgtcgatctctcgcagctcactgaccggcccctggcgaacgacgcggccctgcgacatgaaggccacgtgactacagagcagttccgcctcggcgagcagatgggtcgagaggaacacggtgcgaccctcgtcgcgaagggcagcgagcagccggcgcacctcgcgcatgcccgcggggtcaaggccgttggtcggttcgtcgaggaccaagagctccgcatcggtcatgatggcttgggcgatgccgagacgttgtcgcatgccgagcgagaaccgagcaacgcgtcgatccgccacggccccgagccccacccgttcgagcgcggcttcgatcagccgctggcgcgcgcccgacgcgacgcctctcgcggccaagagccgggcgagattgtcgcgagcgctcaggtacgggacgtagcccggaccttcgaccagcgcgccgacccgtgcgcgcacggaggcgagtcgcggaaccgtcgcaccgagcacctgcgcgcgaccggcatcgaggaagatgagtccgagcagcgcgcggatcgtcgtggtcttccccgatccgttcggaccgaggaagccgaagatgctccctgctgggacctcgaggtcgacccggtcaaggacacgggtgcggccgaaagacttctcgagcccctcggcactgatgacgatgctcacccaccgatcacgacggtggcgtcgctctcgaggatcgcaggggtgacggcgccgacgaggacttgtccgctcggcaactggagggcgttgacgagcgcggtctggagcagcatggcgtgcgctccatcagcgagcgtgactggctgctccagggtgcgaagcgtcgagccgaacgacgaggaccccgcagacgtcgaggtaggcgcgccgagcgctcccttcggcaacaccgcgacgcgatcccagcccgacccaagcgtcgtcgcaccggccacgttcactgcacaggttccgggcgcataccccgtccagccggacgcggtcggcgtcaccgacgaactctgcagaggaaccatgcagcccgtcggcgagagcgccacggactcctgacgcaccgtggcaccggctggcggcgtgaacgtgaacgtggacgcaggcagcgagccgaaggagatctgggtgaactgccacgagagatccgtggtgccatcggcaccctgaatcgccataccgagcacttggtcattggctgcgtcaacccagaagctcacccgcccgatggtcgagccggcctgcgtcggctggatcacgagggtatagacaggctgaccagcgacgtaagtgttgtggccgaggcgcacggtcgaatcggtgccaagtgccgcaacgatcgtgtccgccgccgtggtggggtcgaacgtcgactgtgcggccgaggacatcgacgatggcgccgagccagaggccacgagatgcatcgcctgctcacctgatgagttccacaaccacaccccggtgcggctcgcgtagaggtcccgctcgctctgggcgttgagcacctcgacccgcagaccttcgcccacaccgcgccacagccgcacgctggccgttccttcagggattgccacggcgttcgtcgacgacgagccctggacgcccgagagcaaggacgccgccggacccaacaggttggacgtgatctggagggtgcccgagaacgactggggtcgagccccgagcaccgccgcgaccaactcctgcggtgacaccggcgtcaacgactcggtctgcgcactcgccagcgagggcgtcagtgcggccgcggccaccgcgaccagcgcggctccgacgggaatgccaacgcgtaccccacgacgtcgcacaccatgcgccatggctcctcctctacgtcctctacgcttgcccgtcctcaacgtccgacggcgctcgatcgacggcactcgattcggtgcctgaatcccacgctagtcctccactcagagcgccgtcaccgccgatgtgtcgggatctcaggcaaccataggcctcctacaaggacaccctcgagcgcgtctcaccccatcctcagctgcgacgacacactcgaccttgtgcgtacggaccgtcgcggtggcccctgaaggacgatggatgctcccaaccatcgggccacggcgcagctgcatcgcgccctcgcgctcacacgcagacggtgcacgagcggctggacccagagcgcgtgcgtccgtcgcctcgcacacgccctcgtggccgatcgagcggagcacgctcgagcgtggcggcatcgaccacgggggctgcgaacaggaagggagcgcaccgtcgtggtcgcagcatgctgcccaccgaaccaacgcgaacgccgtcacatcggcgaaccacggaacgtgtccgagggttctgacgcgagcggtcgcgccggcggaagcgggtgtcagcagggaaacaatcccgacgcccgacgtgttatactgtggcagcgccacctcgtgccctcgtcaagttcgacccgtgtccacgccgatcccgaagacgacgaaccgaaacccgactagatcgagtgggcagccagagcatggcgagagcctcggggggctgtgcgagcgcagtggctctcgtggcaggtcgggacacgactcctggtcgctacacggagcacggcgcccagcgtagttcggcgcgtcgatgaggggcagcagcgataccgttcatgagagagggcacgatggcgacgaagagtgatagcgcgctgaagcagagttcgcgtaagcgacgctcggtccaggcggaggtcgactctgcgctccaggcggcgggccttggagcggactcgatccgcctcttcctcgacgatctcgccaagcaccccttgccgtcggcggctgaacaagtcgaactcgccaagcgcgtgcgcgagggcgacgaggacgccaaggccgagatggtcgccgccaacctgcggctcgtcgtccactgggcgcgccgctaccaagatcgtggcgtcgaactggccgacctcatccaggagggtacgttcggcctcatccgggctgtcgagaagttcgactggcgacgcgggttcaagttctcgacgtatgccacgtggtgggtccgccagtcgctccagcgtgcggtccacaaccatggtcaggcgatccgcctccccatggaggcagcagagcgttcccgtcgcgtcgacaacgtcacccgtgagctcgcggctgacctcggccgtgcgccgaccgaagaggagatcgcgatggccgcgaacctctccgcgagtcagctcgccgacgtgcgtcacgcggctcgcgtcgtcgcgagtctcgatcaggcggtgggcccagagggcgagacgagccttggcgatctcgtggtcgcccaggacacctcgttcgaggaagaggtcgacgaatccatctcgcgggaaatgctgcgtcgcgccgtcgaagagctcgacgaactcgagcgccaggtcgtcaccctgcgtttcggtctccaaggagatcggcctgcttccctcgaggcgaccgcgcgcatcctcgggatcggaccgcgacgggctcgtcgcctcgaagcgagtgcgcttgcaaagctcgctgagaatccgcggctgaggacctcggcggcctagaacatcggcggcagagcacctcggcggccaagaacctcggcgggctcgggccacggcccacgcacacttccagcgtccccgacggccaccgttgggcctccgggcattgagctgcaggcgcactgcgacaggctggggcgccatcagcgactcgccagccaggcaccgcaccagatatcagaagccgaaggcgacatcgctcggcgagcagccggccacactcccgcccgaggggctcgtcaacgcccctcgtcgacgcggagaatcgcctccgtgcgggcgcgcgccgcgagctcgccgaggtcctccgggagctccgcggtcacctccacgcgtccaggacgcgttggatgctcgaacgcgagcgcggtcgcgtggaggaacggacgttcgagcccgccgtaggggacgccatagacctcgtcgccaacgatcggatgcccgatggcgctgaggtgcacacggatctggtgggtcctcccggtctccagcgtgagctcgacgagcgacgtatccggaccatgccagaccaccctcagctgcgttcgagcgtcacgaccgccgctcaccaccgcgacacgggacagatcgcgcagatcgcgaccgagcggcgcctcgatgcgtgcagcttgcggcggtacgcccacgacgagtgcacggtagcgacgctccacctcgtggtcgtggaccgcccgccgcaacgactcgtaggcgcccgcgctgagggcgatgaccatgaggccactcgtgccgcgatcgagtcgatgcacgagcccacgacgcaacggatcgccgggaagggcacggagcgacggccaccgttcgagtgcccaatccgcgacgctcggacgcacatcgcggaggtgggtgcgatggacgatcagaccagccggcttgtcgatcaccgccacgtcgtcgtcctcgtagcagaccaccggtgcgccctccggagccggcggagcggcaggatccggccaggtggcctcgaggagctcgccggcccgcaggcgcctcgaacgtcgctgctcgacacggccgtcgaccaggaccccgccatcgtccacgagctgctgggcgaacgcccgctcgatcccgccggcgatcgcgaccgcccgatcgagacgctcgccagcgagcgacgctccgatcgtgaggcgcagctcacccacgatgcccgcgcacctcggacagagcgagcacgaccaccccgaccgtgatggcggcgtcagcgaggttgaacaccggccacagcgggagctggatccagtcgatgacggcgccgtggtgatgacgcaccacgcgatcagccagattcgagatcgctccaccgaccacgagagacgcggcgatctgcgaggcgacaaagcgccgcgtcaggccccacgcaccgatcgcgacggcgaccacggtcgcgacgacgccggcgaccacggggtgacctacgcccagcgagaatgcgacgcccgtgttcaagacctcgacgagatggatcggcccgatgctcaccggatgcgttgcgaagtggtcctcggcgatcgtcttcgtgacctggtcggcgatgacgacggcacccgcgacgcaggtggtcaggaggatgcggcccctcaacgacggcgcgtcagccccccctccttgcaccgcacgcacaagcgcgcgtacgggagcgcgcgcagccgcgccctggcgatcggctcgtggcagacctcacaggcaccgtaggtaccggcatcgatcttggccaatgcatcggcgacctcactgagcgctgcgcgagcgctggcagcaagggcgaggtcgcgctctcggtcgatcgcggccgtaccaccctcgccagactcctcgtcgaactgcacctcgagaggcccgttcgtctgcacgagctgatcggcctccgccttgagctgcgaagcctgctgctcgagatgggcccgctcgacgaggagcaggttgcgctgctcctcgatgaacgtcccttcgtcgagcgcgtcgagctcgtcctcgtccaatgcgaggtacgcctcggcacgctcgtcgttcggaatagttcgctcagccatgaagtcctcactcctcgctacggtgccggccccgggcacgcacgagctgctcaatgatagctggcctccccgtcggcatcgacgccgacgaagaagcgcggcccagctcagcgctaggctggcgccatggacgaggcacctgagccatatcccgcgcaacctgcgacccttgacctcccagcactcgagcacgacgtgctcgcctcgtgggagcgcgaaggcaccttcgccgcgtccatcgagcgccgtcgcgccgagggggcgccagccttcgtgttctacgacggcccaccgttcgcgaacggcctgccacactacggccacctgctgaccggcttcgtcaaggacgcggtaccgcgctaccagacgatgcgaggcaagctcgtcgagcgtcgcttcggttgggattgccatggcctgcctgccgagatggcggtcgagaaggaactcggcctcaccagccgtgaggacatcgagcgcgtcggcgtgggtgtcttcaacgaccactgccgagccctcgtcgaccacacctcggatgagtgggaccgctacgtcacgcgccaagcgcggtgggtcgacttcgaacacgcctatcgcaccatggacctgccgttcatggagtccgtgatgtgggccttcaagcgtctctacgaccgcggactgatctacgagcactaccgcgtgctcccctactgctgggagtgcgagacgccgctgtcgaacttcgagacgcgccaggacgacgcctatcgcccgcgtatcgaccccgcggtcaccgtggccttcgccgtcgagggcgacccgagactcgcaggcacgctcgagggcccactctgggcccttgcgtggaccaccaccccgtggaccctgccatcgaacctggccctggccgtcaaccccgccgagacctacgtcctcgttcgctcccaagccagcgatcaagacgccggacgcacttacgtcctcgcggaagcgaggctcggggcctatgcggaccgatttcccgatgccgaggtcctcgcgcgcgtggcgggccgcgacctcgtcggccgtcgcttcgcgcccctgttcccgttcttcgccgacacgccgggcgcgttcgtcatcctcggcgccgacttcgtcaccctcgacgaaggtaccggcatcgtccagctggcccctggcttcggcgaggaggaccagcaggtctgtgaggcgaacgggatcccggtcgtggtcccggtcgacgaccgtggccgctacacggccgaggtcgagccatgggcaggggtccaggtcttcgaggccaacccggcgatcatcgaggtcctccgcgaccaaggagcgctcatcacccaggaggactacgagcactcctacccgcactgctggcgtaccgagacgccgctcatctaccgtgccatgagctcatggttcgtcgccgtcacggcgctcaaggaccgcctcctcgccgagaacgagagtatcgactgggtaccggcccacgtgaagcacggcgcttttggcaagtggctcgagggtgcgcgggactggtccatcacccgaaaccgctactggggtgctccgatcccggtgtggcgcagcgacgaccccgcctacccgcgtatcgacgtctacggctcactcgatgaactcgagcgtgacttcggcgttcggcccagcgatctccaccgaccggcgatcgacgagctggtgcgcccgaaccccgacgatccgaccgggcggtccatgatgcgacgcgtccccgacgtcctcgactgctggttcgaatcgggatcgatgcccttcgcccagctgcactatccgttcgagaacaaggagcgcttcgaggccaacttcccagcggacttcatcgtcgagtacgtcggccagacgcgagggtggttctacaccctccacgtcctcgccgtcgccctcttcgaccgaccgccgtttcgccactgcatcgcgcacggcatcgtccttggcaacgacggacgcaagctgtcgaagcgactgcgcaactacccggacccttgggaggtgttcgaggagatcggcgcagacgccatgcgttggttcctcctctcgtcgccgatcctgcgcggccaggagatgctgctcgagcgcagcgccatggtggacacggtgcgccgggtcatcaatccgctctggaacaccttcaacttcctcgtcctctacgctcgcgccgatcaccttcgcggccagcgcgtccacagcgcgacccacgtactcgatcgttacctgctcgccgcgacccacgatctcgtcgtcgaggtgaccgacgccatggatcacttcgaactctcgcgtgcgacgacggcggtcgagcgtcacctcgatcgcctcacgaactggtacgtccggcgcagccgctcgcgcttctggtcgcggcgcgacgacaccaccgaagatgccaagcgcgaagcctacgacaccctccataccgcgctcgaaacccttgcgctcgtcacggcgccactgctccccatgctgagcgagcacatctatcgcacgctcacgaacgaggcctcggtccacctcgccgattggcccaacgccgaggccctcccgagcgacccgacgctcgttgcccagatggaacgcgtgcgcgaggtctgctcactcgcacactcgattcgcaaggcagcagggctgcgtgctcgcctccccctccgtcgtctcaccgtcgtcctcgcagatcccttcgatctcgagccctacgtcgagctcatccgggacgaggtcaacgtcaaggaggtcgtggtcgagcccgccgccgaacacccagtgacgtggcagctctcggtcaacccgcgcgtcctcggaccacgcctcggggcacgggtccaagacgtgatccgcgctgcgcgcgaaggtcgcttcgacatcagcggcgaccgcgtgacgtgcgacggcgtcgagctcgcgcccgacgagttcaccctgaccctcgccaccgacgaccccaaacgggtgcgttccttcgccgaccgccgcggcctcgtgatccttgagaccacggtcgacgacgaactcgagcgcgagggccttgcgcgcgatctcatccgtctcgtccagcagcatcgcaaggatcacggctacgagatcgtcgaccgcatccgcctcgcgatcgccctcgaccgcacgggccgggtccagggtgcgcttgcccagcacgccaacgaggtgctcggcgagtgcctcgcgaccgaactcatcctcgacgacgcagcggcactggatcttcccgaccgctcgcaggtgacgatcggcggcgagcaggtgacgatcgcgaccgaaccagtccgcgctctgacggagcccgacggccagcgctagcgacgcagaggggcccctcgcgccagggagtgcactcgatcggactcttcgagcgccactgatcaacgacgagtgtgtcgcccaccccgcgagcgaacccagagcgaccacgtccacgcgaggccgccccggcgggcagcgacgatcctcgctgcccgccagcgacaccaccatcagtccgcgaccggactcgctcgcagctcggccgcgctcgcgaacgcgtcatgcgtctcggcgctgtcgcgccccgacgccaccgcccacgcgtagaacaccaaccccaccacgatgtccgcaacgatgtcgtagggataatggatcaagcccttgtggtggtcgaagggagctccgaagcgagccgcaccgaagcaggcaagtgcgagcatggcgagcaggtacaccacgagccacgctccatgacgccagtcggcggccgtgatcttggcaacgggagctccgagcgcggccgcaacgacgtagacagccgcaccccccaagatccccacgacgagcttccagtcgacgctccagcccgaccagtagatgatgagcgtcccgccgatgaacgcgagcggcgcgaggatcttgtcgcccgagagccggaagggtcggtgcgcatcggggtggaagcgacggaacaccgagagcgacaccggacccatgacgtaggtgaacgccgtcgccgacgagatcaccccgaccagactctgccagctcgggaacggcagcaagaagacgatcgagaacacgaccgtgatccccatggcccacaccggcacgccgaagcgctccgagatcccggtgaacacccgtccgaggtaacgattccgagcagacccaagcacgacacgcccacccgacgagaggtagacgagtccggttcctgacggagagaggacggcgtctgcgtagagaacggccgcaagccaaccgaggccgatcacggtcgcaacctgcgcgaacggcgatgtgtagctgaggcctgcccagcccttggcgagggcggcgtgcggtacggcggcgatgaagaccacctggaccagcgtgtagatgagggcacccaggaggatggcgctgatgatggcgcgcgggacgtcgcgctgcgggttgcgagcctccccggcgagatcgaccgcctgacggaaacccagcagcgagaagacgatcccgccggacgcgaccgcgatgaacacgccggcgctgccgtagggcaagaagccgtgcgtggccggggccgtgtagttgctccagtccttggcgacgaacaagatcgcgaggatggtgagcgtcggggtcacgaacttgaggaacgtcacgaccgagttgatcttcgcgaacaccttgaccccgtagatgttgatcgcgaagaacacgaccagcaagatcgcctccacgacaaagtcgaggccagtgttgttggcgaacgctcggatgtagtgctctgcgtactggacgaccgcctcggcctcgatggcaggaacggccgcgtatccgaggaaggcgccccaactcatgatgaacccgaccagtgacccgtgggtgaagtgcgggaaccgcgtgatgccacccgcctcgggcaacatacccgacagctctgcgtagaccagcgcgatgaagatcacgatcaccgccgcgatcagccacgccaccaccgccgcagggcctgcgtagttggcagcgtacagcacgccgaagagccaaccggatccgatgatcgccccgagaccggcgaacgtcaggtcgatgtaggacatctcccgtcgtaaccggccccgccctccactgtggtcgctcgccatgcacaacctcccccgtgcgatcggcaaccttcggatctcgctccgaaggccgtacgcggacctgcccacgtacgccgcgaacgctagcagccgcgatgccgatgcgggatacggaatgcaacgaattcacgaaccagcaacggcccgatcgtgtcaccgtgtcctcgccgcccagcgagctatcgcgtcgacgctgcgtgttccgcgcaccgctggatcgggagcaggtgactccacccccgcctgaaggcggggacttcgggtgcgctgttcacgcacctgtggctcctaccgcaggaggaaccttggcggaaacgcctgccgccgtgcggcggcgactcgggccagaagccctgcccgcgctgtccaccgtgcgccccacggcaataccaccaccaacgagggcgatggcccgatcaaggatgttccgtgcggccaccgcgtccgcatgtgcggtatgaccacactgcacgcatgcgaacgatctcccgcaccctggcctgctcgctgggtctcggaccccgcatgcaggacaggtctggctcgtgcctgccggtggcaccgccacgagcagggagccgtacttcgggcacttgtagtccagttgccgacgccgctcgccaggagctatgtccaagatggaccggttgagtccggctttctgacggactctggtgccgggagcctcgaccgtgcccctggccgagctcgtcatgtgcttcacccgcaagtcctcgatggcgacgaggctgtggttcttggccaagtcgctcgtgagcttgtgggtgaagtcctggcgtctccgggcttggcgagcccggagacgtgcgatctcacggatcgtccgacggagtcggttcgagtaccggcctccgttgtgacgcttcgcgtaggtgagctggcgagccttacgccgttccaggccacggagccgacgctcttcgcctggggtgagcgtcgggggcatgatcctcggggcagactcgccagcgacgtaggcggcgcaggcaataccgaagtccacgcccaccgtgggtccgtcgttcacgggcgcgcggtgggtcgtggcgaggacggtgaagttcacctgccacacgccaccgagcagcggaacgtggccgaggcaagctcaccatcgagtgagcgcgagcgtcggaaccggacccaccccagcttggggaggcgcacttcggaccattttcggttgaggtggcggatctggagatcggaggccgagggccggaagcggagttggccgcgcctctcgaaggctggcttacgggcgcgtccttgccaccagttctggtgtgcccgatccacgtcacgaagtgcttgttggagaaggtgtgccggtggctcggccacccactcgacgcacgagcgcagttcagccagctcgtgacattgttcgcggtacgtcacctgcgccctcgctcttgaccacgccagttgccgatgctcgatggcgaggttgtgaatggcacggcgagtatgtgcccaggtggtcattctggctgcctggtgcgggctcggggagagccggtagctccgaccgacgtactcgcccacgtcaccaacgctcgtcagcgtcatacctgcaaggaggggctgttcgaggtagtgccctacgtcgagtaacagcgccgaccagcatgagagcgccgcttacctcccgcctcgaggcgggagtccgcgcggcgcgttgtggtcgccgtcactgcctcggcgatggactcggtccgaggcgagcggtcgctcgagcggcgagctgacggtggcgcgacctcgcggccctggacccccgggtgagggcaccgacgcgtcactcgagacggccgctggatgcctcgacgggtgcatcgagaccgaggtgcacgtatgcccggggcgttggcattcggcccctcggcgtgcgcacgatgaggccacgctggatgaggaacggctcgtagacctcctcgagcgtgcccgcgttctcccgcaccgcaacggcgagcgtcgaaagtccgacgggacgcccagggaactggacgcacagcacccgcaagatctcgaggtccacgcgatcgaggccgaggacgtcgacgccgaagaggtccaaggcctcgagcgcgagctcacggtcgatcgcaccgtcgccgcgcacctcggcgtagtcccggacccgacgcagcagccgattcgcaagcctcggcgtgccccgcgatcgacgagcgatctcgagcgccgcgtccggctcgatcggcaccgagagggtgcgcgccgcacgttcgaccaccgcaacgagctcgtcgtcaccgtagtagtcgagccgatagtggtagccaaagcgatcgcgcagcggcgccgagatgagcccgacgcgtgtcgtcgcgccgaccagcgtgaagcgcggcacgtcgagtcgcaccgagcgagcacccggccccttgccgagcacgagatcgacccggaaatcctccatggcgccatagagcagctcctcgacggcccgggggagtcggtggatctcgtcgatgaagagcacttcaccaccgtggaggtcggcgagcaacgaggcgagatcaccgatccgctggagcgcggggcccgaggtcacgcgcacaccggtgccgagctcgcgcgcgatgatgaaggccaacgaggtcttgccgagcccgggagggccggcgaacagcaggtgatcgggcgtctcaccccgaccacgtgcggcctcgagcagcacctccaactgtgccttgagctcccgttggccgatgaagtcggcgagacgctccggccgaaggctctgctcgagcgcccgttcgagcggatcgagcgcgatggcgtccgatccggctgcgcggcgtcctccggcccactcgcgacgcggactcatcgagccagctccttgagcgcccagcgcacctgggcctcgaagtcaaggtcgccggggcaccgccgcacgacggcgtcgatctcgcctggccggaatccgagttcgccgagcgcagcccgcagcgcggacacctcctggctcatgggcactcccgtcacgggcgcgaggcgcttcgcggtcggcgcaagctcgaggacgacccgcttggccgtcttcggtccgacgccggcgatcgcggtgagccgcccgaggtcctccgtggcgatggcggtccagagctcgtcaccctcgatcccgccgaggatgccgagtgcgagctgcgggccgaccccactcaccccgatgagcgcatcgaacgcctctcgctccgcctggctcgcgaagccgtagagggcaatggcgtccgcccgcacgatcgtgcgtatccagagctcgcactcatcatcgcggcggagcagcgtcgcccacggagcagtcacgtgcacttcatagccgacgccagcgacatcgatcacgaccggtgagcgcccggcgctcgccacgcggccgtggagccacccgatcatcgctcccaccgccgctgcgcgagccgcgtataggcgatcgccatggcgtcggcgacatcgggcggctgcggcggctcgtcgagaccgaggagccgcacgacggtccgctgaacctgctccttggccgccgacccgccgctggtcgccgcgttcttgaccgtgttcggggagatgtcgtaggccaccaccccacgccgccagagcgcgagacgaacgaccccgacgacctcggacaccgggagcgccgaggagacgttgcgcgtgaaggcaagacgctcgatcgccgcctccgtcggatcgaaatcgtcgagcacgctctcgaacccctcggcgatctcgtgcaaccgactggcacggcatgcccgtgccgccgtcgtcacgagacccgcgcccacgagacgtagggtatctccggtcgcctcgatcaccgcataccccaggcgtgcgagacccggatcgacgccgaggatgcgtagcctcgcctcaggcaccgacggcctcgcgaaccgcctcgagcagctcatcggagggacggaacgtgagtccagcccgcgcgatgtgcaggtagatcacccgctggtcgcgatcgagcacgaagacgctccgccgatagaagccgagcggaccgagcacgccataggaccgggccacctcacgatcggtgtcggcgagcagcggaaaggcgatcccacgtcgctggacgaagctctcgtgtgaatcgagaccttgcggcgagatcccccacatcacggcaccgagcgcgcgaaagtcatcgatggaggctgagtaggcgcgcagctgggccgagcacaccggcgagaagtcctcggggtagaacgcgagcacgaccggcgtcccgcgttgcgctcgcaggtcgtagcgctgtccaccggtgccggggagcacgaacggcggcgcttcgtccccgagcctcacctggctcactcggccacgaactcctcgaggagcgactcgggcatgtcgaagttcgccgtgacttcttggacgtcgtcgaggtcctcgagcgcctcgacgagcctgaggacccgacgggcctcctgggggtcctcgaccgggacggtggtctgcgggaccaactccacctcggcgctctccaccgcgaacccagcggcttcgagcgcatcacggacggcaccgagatccgacgccgcgacggtcacgagccacgcatcgccgtcgtcggtgaggtcttctgcccccgcggcgagtgccgcttggaacaactcgtcctcgtcagcgtcgcgcgagagacgaatctgtccgagacgctggaactgccacgacacggcaccgggctctgcgagcgagccgccgttgcgcgagaaggctgcccggacgtcggcaccggttcggttgcggttgtccgtcaggcacgacacgatgatcgccacaccacctggggcgtaaccctcatagttgacctgctcgtagcgagcaccttcaagctcaccagtgccgcgcttgatggcgcgctcgatcgtcgcctggggtaccgaggcgtctcgcgccttctgcaccatggtacgcagcgtcgcgttcgccgaggtgtcgcctcctccttcacgggcagccacctcgatctggcgaattagcttggcgaacagcttgccgcgcgccttgtcgacggcgcccttcttgtgcttgatcgtcgcccacttggagtggccggacatggtcctccttgctacccatacgtgcccgtcaccgggcaagcagagcttactcgtgccgcacgaggtgtcttgagatgtcctcgcggcgtgcgccaccccgcgcgaaggcgaggacatggagccgtgcatcaccgagcaactcagggtggaacgaggtcgccacgacgttcccctgtcgcacgacgaccggcacggttcgctcggatccatcggcgaactggtaggccacctgggcgaccacgtccaccgaggatcccacacgcgtcacgacgggcgcacgaatgaacacggcccgcatcgggccgccgtcgacacccacgacggtgagatccgcctcgaaggagcgcacctggcgcccgaacccgttccgtcgcacgtcaacgtcgagcaccccgaacgaccattggtcggggcgccctccctcgatgccacgagcaagcaagatgagtcccgcgcaggtgcccagcgctggcatgccctcggcgagcgccgccgccaacggctcacgcaacgcggccgcctcgatcagcaaggcctgcgtcgtcgactcgcccccgggcaacacgatcccgtcgacagcggcgaggtcggcgagacccttgacggggcgagctgcgaggcccgcagcggcgagagctgcgaggtgcgcgtctgcgtcgccttggagcgcgagcaccccgatcatcggctcaccaaccgcgctcggcgagtcgctcgtcgatctgatcgagaccgaggccgaccatcggctcaccgaggttgcgcgacaccgcgagcaccacgtcgggctcgttgtagtgcgtggtcgcctccacgatggcacgtgcccgcttggcgggatcaccgctcttgaagatgcccgagcccacgaagttcgcctcggcgccgagctgcatcgtgagcgccgcgtcggctggggtcgcaatacctcccgcgcagaacagcggcacagggagcttgcctccgagcgcatggacctcagcgacgagttcgtagggagcgccgagtcgcttggcccatccaaagagctcctccgggcgcgcctgggcgatggctcgcaggtcccgcgtgatggagcgcaggtgtcggaccgcctccacgacgttgccggtacccgcctcacccttcgaccggatcatcgccgcaccctcagcgatacgacgcagcgcctccccgaggttggtcgcgccacagacgaacgggacctcgaaggcccacttgtcgacgtggaactcctcatcggctggcgtgagcacctcactctcgtcgatgtagtcgacctcgagagcctcgagcagctgagcctcggcaaagtgcccgatgcgaaccttggccatcaccgggatagtcacggcgtccttgatctgctcgatcagggcggggtcgctcatgcgtgcgacgccgccatcacgacggatatccgcaggaacgcgctcgagcgccatgaccgcgaccgcacccgcatcctcggcgatcttcgcctgctccgcgttgaccacgtccatgatgacgccgcccttgagcatctcggcgagtccccgcttgactcgtgccgtgccgacttcgtactgggtcatggctcctcccttcgaacctggccgctccttgtgtaccagagtctaggagggccgtgtaccacacactcgctcagacgtcgatcggtcgacgtcgggtcgcccacggctcgtcctcgatggcgtctgcgcgcgccaggagttcgtcagcgttcatccccgtcgccgcccatgcccaccacacgagcccggccgtctcgcccgtcggctcctccgcgaggcggcgcaagagccgtgcgacgaccggagggtaccgagtaactgcacacgcgaccaggtcgagctcccacgcgagcgcgctcatccacgggcggcgccgaccgccaccgaggatccgatcgatccccatcgcgagcgacaacggcccgagcaatccaagcctccacgcggcgagcgtgcggaccactagcgcctcgagttcgaacgacgacgcgagccgtaccgccccggcggtcagcacgacgagcggctccccgcgacggccacggaccaaggctgcgttcacggcgtcgccctcgatcaccgcaacctcggtggctccgagcccgagcagcggctcgaccccctcgacgatcgaggcgagccgcgcctcgtcggatcggctgagcgcggctcgcctccctcggggcttccggggcaccatggcgacgaccaacaccacagcggccacgatgatgacggccaccaccccaccgagggcagcggccatggcggtgagccctaggagcgctcccacgacgcccaccacgacaccggcaccgatcgcaaccgcggcaagacgcgcgagagcccccgtgagcaccactcgacgccgcaacggccgccgcacaccccacagctcgataccacccgtgttcacgtcaccgacccctctcgactgacccgctcgacgagctcgaggtagcgacgagcaatcgagccgatgtcatgggcgtgtgcgcgctcgtagcctcgtgcgacgagcacacgccgacgatcgcgatctcccactatcgagcgtattgcgccggcgagcgccgatggatcgtttggctcgacgagcacccctgcatcggcgacgaccggccggtagccctcgattgcactcgcgaccaccaccgctccccgcgccatcgcctcgaggagcaccacaccgaacgactcgccgccaagcgacggcgcgacgaggacctcggcctcccggtaggcacgatcgagcgtcgcgtcgtcgacgcggccccgccacgtcaaccaccccggccagcgctcggcagctcgacggacgagcggggcgagcgggccgtcgccaacgatcacgaccgacgacaccgagtccaccagcatcggcagggccgcgagcaagacccgaatccccttgcgctcctcgaggcgcccgacgaacgcgacggagccgggcctgcgtgcctgatcatccggcaccgcttcgggcacgctgagcccgttcgggatgatctcgatcgggccgggggcccatgcgcgagcaaccatcgctgccgatggcgagaccgccgtcgcgacgcgtattccccgcgcccccacgcgaccaacacctgcgagcagagccctgccaaccccacgcggcatccctgcgcggtgcccggtcgcgatgacagggatgctcgcccgacgggcgagggcgatggtcatcggtccgaccaggggcacgagcggctcgtggaggtgcacgaccgtcgcgcctcgcatcgctcgcgacagcgaccggaccatgcgcagatcccagccgatcggggcacgggacccgttggcagggacccgaaccgaccggccgagaccgccctgcccaggtccgaccagatccaccgacacccccagctgcgagagggcgcgcgtgagcgccgcggcttggcgctgcacgcctccgggaacgtcgaggtcgtaggggcacacctcgaggactctcacgaggtccgcctcacgtcgtcacagtgcgagcatcggcgaccaggttgtgccattgactcggtgcggcctggatctggcgctcgagtgcgcgcaccacccgtcgatgaagctcctcgatgcgagcctctcgtgacccctgcgtcggcggcatgatcggcgcccagatccgaatcaggtgcctccgtcccggcagctggtagcacgccgccgggtagaccggcgctcccgacaacaccgacagcaccgccggcccggctgccaccgagaccttccgaccgaacagttccccgggacgacccgaaccggtgacgtcgcgatcgaccacgagcgcgacgcgcccaccttcccgtagggtgcgcaacagagcccgagttgcctggacgccggtggggacgacgcggatgccgagcgcatcacgcagtcgatcgaagaagctcgtcaccgacgcctcgggaagtcgctcggccaccgccgtgacgggtgcgccggcggccgacgcccacaccccggcgacgtcccagttgccgacgtgcgccagggcaacgatgcagccttcaccgcgcccgaccgcctccaggaatgcctcgtggcccgtcacctcgacgccgtcgagcagacgcgccatcgcgtgaggggctcggagcgtgtcgacgtagtagcgcgcataggacacataggcccgaagcgtccaggcgatcgcccgcggatcgctcatcgggcgtctccgcgccaagcactggtgctcccaggcgatacgccgccgcgatccggtcagcacaaaggcgatcgccccaccgacccaccagacgatcggatcgagtcgccacggcagccgtcgcaccaacgcagaggcgatctcgaaccgtcgagctcgcagaccagcgcgcagcgaccttgcggtccgcaccgcctaacgcgcgtcgcggcgccgccgacgccgagcagtggtcacttcccgcgacccgagcaaaccgctcagacgcgtccgcagccgcgcccgccgccgccgattctcgcgtcgcagcgcgacgaggcgctcatgggcacggagccgatctggctggcccgaagccgagcgccagatcctgacgaagcgctgtgcagccgtccaggtcgacccgaggagcagcacccacaccgcgatggggagcagcgcccacacggcgatgccgaggaggaggacgaccgagcgctcagcgcgctcgaagacgccacccttggcctggaaaccgagcgactccgccttggcgcgctggtacgagatgagcgacgccgcgagagcagcgccgaaggccgccacgccaagaccaggctgatgctcgacgagcaccaaaccgaccccaagtcccccgaggaccgccgcgtcgctcacacgatccgagaccgagtcgaagaacgcgccgcgacgggaagcagccccactcgccttcgcaacgggaccatcgagcaagtctccgaggaagccgacgagagccagtgcaaggcctacccagcgtgcgccgaacgcgagcgcgaggccggcaccgatcgccgcgacgatccctgcgccggtgagcacgtctggtgtgatcccgagccgcgcgagctgacgaccgaccggcgcggtcgcccgatcgacttgccccctgaactctccgtccagcacctccggccactccttgcgatcgcccatccgatgtcgtcgtcgctgcaacgcatctacgctcggacaacgctacggcgtagcctaccacatcgcctccacccgcctgtgctggtcgcacggggcgtgctatggtgggccagctgcatcgacagcttgggaccgacgggaggtgccgtggacgccactgtcgcagcgagcccgcgtgctcgcatcatctgcgtcgtcggacctgcgggcgtgggcaagaccacgctcgtgcaggcgctcgccacgctccagtctccaccgacgcgcggcgacgacgatgcccgcgcactgatcgacacgtcgccggaagagcgcgcgcaccaccactccgtcgacctgggcgtcgtacgcctcgagcaccgaggccacgcgatgaccctgctcgacgtccccggtatcggtgagctcgccgctgcgcgggcacttgcactcgccgtcgccgacgcagcgctcgtcgtggtgccacccagcgacagccccagcccggagctcctgcgcatctggcgcgagctcgacgagcgccaactgccccgcttggtggtcgtcaatcgctgcgacgacagccgctgtgcgatcgacaccgtcgtccgtgccctcaacgagcgcctcgaggcccatctcgacgccgtcgagctcgtcgccatcaccgccgacggccatcaggacctcatcgacgtgctcgcggaggcgtccatcgtcggcatcggcactgacgagcacctcgaaccgctgcccgaggtcgagcgcgagttcgagcgccaggcacacgacgccttgctcgacgacatcgtggccgaggacgacgccctcctcgagcgctacctcgccggtgaggagctcgacccgaccgagctcaacgctgcactggcgatcgccatccgcgagcggcacctgacccccgttctcgccgcgtcggcgaccacgcgtctcggcctcacccatctcctcgacatgctcgatgccctggtaccagcgtcgccgacgccaacggacaccacgagcgcgctggtcatcgccacaagctccgacaactttcaaggtacgtccgcgacgctcgccatcgtccgcggcgccatccggcccgacagcgtcctgcgcgactcggcccaggaccgcacggagcgactccatcagctgctctggccgaccctgcccaagcctacgccgacgacggaggccgccgcgggtgacgtcgtgatcgcccccaaggtgggggccgcggtggggacctggctcatcgatcctgctggccacgacatccccgatccagtgcagcgcccgacaccgacctacacgctcgccgtcgaggttcccgaccagcgcgccaacgacaaggttcaagcagctgccgctcgcctcgccatggaagacccagggctgatcgtcagccgggaggcagagacccaccgcctcttgctcaccggcatgggggcgacgcacttggctctggtgatcgagcgactcggccgccgcagcggagctgcgatccagacggtcacgccacgcacgccctatcgcgaaaccattgcgggcacggtcgaggtggaagggcgccacaagaagcagaccgggggccacggccaatacggcgtcgtggtctgccgcatcggacccggacctcgtgcgagtggcgtggtgttcttcgatgagatcgtcggcggggccataccgcgaaccttcattcccgcggtcgaggcgggcattcgggaggcgtgcgagcaaggtggtccgcatgggttccccgtcgtcgacctcgaagtccacctcatcgacggcaagcaccatccggtcgactccaacgagctcagcttcaagcttgcaggggcgctcgcgctgcgcacggccctcgagcgagcagggagcgtcgtcctcgaaccgatcgcacgtgtgcacctcagcgtcccggcaagcgcacagggcgacgtgctgggctacgtgacgtcacgccggggtcgcatcatcgagtccactccggtcgggccgagcgtcgagatcgaggcagaactgcccgctgccgaactcacgcatctcgccgtggacctccacggcctgacggcgggccagggatcgttcacgagcacgcacgaccgctacgagcccgtcccaaccgcggtcctcggacgcttgctcagcgcgacatccaagtgacgccgccctacggcccgactcggcactccctccctggcaactcacggtcgacgaccacacctctgcaccccgtacacccgagaaccgtgcgttctgcggcgctcggagagagcggtatcgtgaccaccgatcctcccttgcccaaaggctgtgatcgagtcggggcacgccacggtgagctggtgcgactcggtggcggcagccggacctcggagtcgctcggcaagcatgtcgccatggccgcaggcagctggcggtggtggctcgtcgagccaccaccgggtgcgtaccactccggccgacgtcggcagactcgatgaacgcacgcacagtcagagggccagtcgtgcgcgccgcgatccgctcctttcggcaggggtccatccgctccagtgaacgacgaggtcccccgcacggctcacgttggcctttgcacgcggccttcacgacgcgcgggagcacctccgctccaacaagccgagagcgacggcggcttgcacgcgggcgatcggctccgccacgacgctcaggcctcggctctggagggctctcacgaggtcacgctgcgctccgctctcgttcggaacggcactcgcgccgtccgacacctctcggcacgttctccgcgacggcgaccacatggagctcatgtggccccaacagatcacaccacgcggatcggtgactcgacaagggacgaattacccagcgttgtcgatcacctcaatgcgattcccaaaggggtcgtcgacgtataagcgccggactcccggaaggtcttcgtcccaccgccaggaagcgcccgacgcttcgagcttcgcaacgagatcgtccagctcctccactcggagggcggggtgcgccttgcgcgccggcctgaaatcctcctccaccccaagatgcagctgcacgggcccgcacgcaaaccagcggccaccacgagctgcgagcggctctggcttcgcgaggacagtgaagccgagtacgtcgcggtagaacgcttctgcctcgggctcgcgaccggctggcatggcgagttggacatgatcaagggctacgactcggacgcccacgacgtgaatcctcccacccacgctcgactcgtgccgcgcccggcgccaagcgctcatcaccgctcgcgaccactgacgccgagaacagctggacgcctccttcccagaggcagcctcagacaccgcagtgctcgtcctgtcaggtgccaagcccagcgaggcgttgtgcatgccgggcaccgacgtcgatctccatccgtcgtgccactcgcgaccacatcccgcgaggggtcgtccccaggtccgcgcctcttccccagagacaccgtcgcggacgacgagcgtcacgacccccgcggccaccgctcactcgagcggcgcgcgcgacccacaccactgctgcgagtccagaaggccgatcagctcacggagcaactgccgtactcgggcccggcgccggcgtcactacgagctcgccggccacgcgcggcgcaaccgatcgcgcgtgtccccgagtgcctcggggaggacccgtgtctgcgcggcggtcaccatgaagttcgcgtccccgacccaccgaggaacgacatggacgtgcaggtgctcgacgatacccgcacccgatgcccgaccaagattgaggccgaggttgatgccctggggatggtaggcgctctccagcgccgccattccctcgcgcacgagctcccacatctcgccgagctcctcgtgcgagagcgcgccgaggtcgctgccgtgccgccgcgggaccaccatcaggtgccccgacgtgtacggatagaggttcagcacgcagaaggcacgcgcgcgacgagcgaccacgagatcatcggccccatcggccccgtcgccgatcgcgcacaggacgcacccgtcgaccgccggagcaccctgcgtgacgaacgcggagcgccaccccgcccagaggtagtccatcacggacgcacctccgccatggcgaccgctcgtgcgatctcgtcgatcgccgtctcgagcgcgacgccgcgggcctgcgaccgatcggggcgcgtcagcccgaccgaatgcgcagcgacgtcatcgttgcccacgaccacgatgtaggggactcgctcggtccgagcacgtcgcacccgtgccccgagcggttcgtcggccgcgaccacctgagccccgacgcccgcagcaacgagcgcagcacgaacctcctcggcccagccggccgcctcatgagccaccggcaaaatgcggaccggttcacgcacgagccacggcggcagctcaccatcgaagtgctcgatgaggatggcgaggaagcgttcgacggacccgaagagcgcccgatgaatcatgaacggacgctccatccggttgtcagcgccctggtagccgaggtcgaagcgctgcggcaactgcagatcgacctgcaccgtcgagagctgccagcgccggccgatcgcatcacgcaggtggatgtcgatcttgggcgcgtagaacgcaccctcgccctcggcgacccgataggtgagccccgaccgctccagcgcgctccgggcggccgacgtcgcgaactcccagtcctcgtcgctgcccacggacttggcgggccgcgtcgacagctcggcctcgaagtcgttcagcccaaaggcgccgagcaggcgcatcgcgaggtcgagcaccccggtgagttcgtctgccaactgatcgccgcggcagaagatgtgggcgtcgtcctgcgtgagcgagcgcacccgcgccaatccgtgcaaggtacccgaacgctcgtagcgatacaccgtggccagctcgaacagccgcagcggcagttctcggtagctacggggatgctgccggtaggcgaggatgtgcatggggcagctcatcggcttgaggaagtactcctcgtcgtcgagctccatcgccgggtacatcgactcgcggtaccagcccaggtggccagagagctcgaacaaggcgccgcgcgtgacgtgcggcgtccacaccgggacgtagccggcggcaaagtggatgcgacgggagaactcctcgagacggtaacggacccaagccccgtcgggctcgaacacggggagaccgccgccgatctcacgagggaagaagaagagccgctgctcctgaccgagccgacgatggtcgcgccgctcggcctcggcgatctgcgtcagccacgcctcgagcgcctccggggactcgaacgccgtccccgcgacgcgctggagccgtgggccgtgctcgtcgccgcgccagtacgcgccagagaccctgagcaggcggagggccgagagatggccggtagagggcacgtgtggccctcgacacaggtcgatgaagtcagcacccgtgcgatagatcgagaccgcagagcccgaagcggcatccgtctcagcctcgccagcggcgatgcggtcgaggatctcgagcttgaacggttggtcggcgagctggcgccgagcctcgtcgagctcgagctcgatgcgctcgaagggttcgtcggccgcgacgatgcgttcgacctcggcggcgatcgcggcgagatcgtcgtcgtcgagactgcgtcccccggggagctcgacgtcgtagaagaacccctcctccgtcgccggtccgacggcaaggtgcgtacccggccagaggcgcgagatggccttggcgaccacgtgcgcacccgagtgacgaagcacctggcgaccctcgggtgtcgaggcagccacaagggtcgcacccggaccggctcgatcgagatcaacgagctcgccgtcgtccgagcgcgccgcgaccggtcgagtggggtcgacgaaccggctcacagctcgaccccgagcatccgtgcggcctcgctcacaccccgacccgctcgagccgcccggtcgatggcctcgagtgcacccggggtgtcgaggtcgttgtcgagcgccgcgtcgacctcgtccacggcaccgtccccggtgccggctgcgcgccagagcccatagcgctctcgcgcctcctccaggagcccacccgtccagtcccacgacgtccggtagtgctgcgacagcaacgcgagccgtaccaccgcagcgggcacttccttgaggagctcgcggacgaacacgaggttgccgagggacttggacatcttgacgccgtcgagccgcaccatgccgacgtggacccagtggcgcacgaagggttcgccggtgatggcccgcgactgcgccgcttcacactcgtggtggggaaagatgagatccgaaccaccgccgtgaatgtccaccacggggccgagctcgcgcatggcgagcgccgagcattcgatgtgccacccgggccgacccggaccgaaccgcgactcccaggcgggctcgtcggccaaggacggctgccacaacacgaaatcgagaggatcgtgcttcctgggatcgtcgggatcgccgccacgctccctggcaagtgcgatcatggtgtcccgatcgaggtgggagatcgatccgaacgtgggctcgctcgccacggagaagtacacccatccgtcgacctcgtaggcgtgccccgagtcgacgaggtcctgtaccagggacaagatctccgcgatcgccgaggtcgcgcgtggctcgaccgccggccgtcgcaccccaagggccgtcatgtcctgatcgaactgcgcgatctccatcgcggcgaggtcgaggtagttggtcccgagctcgcgcgccttgcgcaagatgtcgtcgtcgacgtcggtgacgttgcgcacacagcgagcgcgctgccgatggcgctcgaggtgtcgtgcgagcacgtcgaaggtcacgtagaccgccgcgtggccaaggtgcgcggcatcgtagggcgtgatgccgcaggtgtagatcttgatctcctcgcccggtcggagctctaggtccacgacccgttgcgcttgtgtgtcgtagatcctcattggccgtcgtcctccctgatacccaccactcgcaggctcgacctcgcgcgatagcgcaggttcacgttcagcagcaccgcggtcatcgcctccagtgcgccggccgcggcgagcgaaccgacatagagcgctcgcagaccgtcgatgctcccgaggagctccatgacgacaccagcggagctctggaagtccgaggccaccatggtgtcggcgtgcacggggcgcccgagctccgcgagatcgcgggccggcacgtggtgcagcgccgcgaccaccatcgaccgcgggagcgtcgactggaggagctgggccaccgatccgcgaggcggtgccagcgctgcgaactccgatcccgtacgcaccaacgcattcgcgacgcacaccacggtcttggccgcaagcgcctcggcgaactccgccgcgacaggcacgacgctctcccagggcacggcgaccacgacgagatccgagcgagcggcaagctcgttaccgcccccgaccagaccatcggcgagctggggccagcgatcgccgagccgactcgccgactcttgcgcgcgctccggattgcgcgagcccagcacgaccgtgcggcctgcctcggcgagtcgagcaccgagcgcactgccgagcggcccggtcccgccgatgatgccgacatccacgaacgcccccagagtcccatcacgaggacgccgctggggcaggactcgcaggccccaagcggctaccgtaggtccgagtctacggtgaaggagatcacatgggcatcctcgagggcaagcacgtgctggtcactggcgtcctcaatacctcgtccatcgcgtaccacgtcgctcgagtcgccatcgacgagggtgcggaggtctcgctctcgagcttcgggcgcgccatgtccatcacccgacgcgtcgccgagaagctcggcatctcctccgagatcatcgagctcgacgccgccgatcccgcgagcgtcgacgcagccgcagccacgctcggcgagcgacacgaccgtctggatgcgatcgtccactcgatcggctatgcgccgccgagctgcctcgacggccccatgctcgatgccccgtgggacgacgtcgcggtcgcggttcgggtgtcggcgtactcgctcgccgagctcgctcgcgccttccgaccgatccttcgctcgggcgaccatcccgccatcgtcggcctcgacttcgacgcgacggtggcgtggcccggctacaactggatgggggtcgccaaggctgcgttcgagtcactctcgcgctatctcgcacgcgagctcggtgccgacgggattcgcgtcaatctgatctcggcgggcccggtccgcacgatcgcggcgaagtccatcgacgcgttccgctccttccaggacagctgggccacgcgcgcaccgctcggctgggatccgaacgacgccaccccggtcgcacgcagcgtcgtcgcgctctgctcagacttcttccccgccacgacgggcgagatcatccacgtcgatggcggctaccatgcgatgggtgcctgagggcaccgagatcgctgcggctcacgtggccctgggcgttccgcccgacccaaccaggaggtgcaccgatggtgcgcatcccgagcacgctcgccagctccttcgcgatcgcagcttcgcttgccgccgcgagcgcgatgtcgttcgctcagccggccggcctccgcggcggtcagagcggcaacggctggaccgtcaccgcgaccggcgcgtcatcacacacgacccccactgggccgaaccctggcctccagcccgtctactggccggtcctcgtcacgcacacgggttcgtcgctcgcgacgagctgcgtcgaggtacgcacgctcgacccgggcgcgggatcgtatccgaccgtgctccaggcggccgaggccgcatgggcgcatcttgccggcgtacctcgctgtgatgcgagcgggccgtcgccgtcggccatcgtcaccctctggaccaggaccctcgcggcgacgctgaccccgccgagcgccgctgtctggccacccagggggatcgtcggcctgcccctcgaggtcacggtcgccggagcgaccactcggacgttcaccacgcagacccctgcgggacccctcgtcatccgggcgaccggagcactcgcggcgcagctcggttcagcctcgatcaccctggcgagcggcgacgccacgctgaccccggacgtcgtcggtagcgtccgcctgctcccgatcgagacctgggacgccgtagcgaccctcgggacgaccgagctcgcgctgcccgccgtcacgatcgtcggcccagccaagctcgtctcgatcgccgcactgcacgccgagctgcgcagcctcgcctagcgaacgcagcgagcgccaaacgagccgtcaccgacagcgtgcccgcacccgaggcaccaccgacgagtggccttgtctggactcaagcgctactggtcgtcgaggtcgtcaccgtggagcgtcgaggcctccacgtgggcgacgggttccgtccccaaccggcccgcctgatagtcctcgaacgcttgacgaagctcagacctcgtgttcatgacgaacggcccgtaccacgcgatcggctcaccgatcggggtgcccgcgagcacgaggacctgggtccgtcgcctcggggctgcgagtacgaccccttcgccctcgcccatcaccgcgagatgaccagcctcgacctcgacgcggtcctcgccgatcagcgccgcgccgtcgaagacgtagagcaagcacgtgcgcacggcaggggtcggaatccgagcctccgcaccggcctcgaggatgaggtgagcgaccgtcaccggccagtaggtgtcagccggacccgagatgcccccgaggctgccggcgaccaccttgaccagcgcgccgccatccgcgctctggccgatcccgagatcaccgcctcgcacgtcctgatagcgaggggccgcccacttctgccgtctggggagattgacccagagctggaaaccgtggaagacgccaccggtcacgacgagccgctccggcgggcgctcgatgtgcaagatgccgctcccagcggtcatccactggatgtcgcccggggcgagcgcaccaccaccgccgaccgaatcggcgtgttcgaacgcaccctcgagcagataggtcaccgtctcgaagccccgatgcggatgccagggggtgcccttgggctcgccaggaccgtagtcgacccgtcccatctcgtcgaggtggatgaacggatcgagttcctcgagtggcacgccagcgaaggcccgcttcaccgggaaaccctcgccctcgaggcccgacggcgcggccgtgagccgcacgactcggcgccacggacccgtcgccctcaccagcacgtcagctcgcgtcacgttcgtcatcgggcctcctttgttgcagatgcaatcatagtcgctcgtgacggacgaggagggctcgcaccgctgcgacgtcctcggcgcggggaccgtcgcccgctcccgggacctcgagcaccacatcggcctccggcaggcgccgatcggcgacgagcgagcagagcgcctcggctccgatcgccccctcgccgatgttcgcgtgacggtcgcgccctcgaccacgctcactggccgaatcgttgcagtgccacagcgccacgggcacctgtgccgcctggagcgccgtgacgatctcctcgcgccccgcggcttcgtcgatggcccagccgacggcgaacaggtgctgggtgtcgagacacacccccacccgcttcgtccggagggccccagccagggcccccagctcggccggaccggacgccaccgaacccgtcgccgggttctccacgagaatgcgaatcgtcgacgtcgcctcgagcacgcgctcgagcccctcccggatccgctggcgcgctgcatcagggtcgtcaccaggcgcggagccggcgtggacgaccaccgactcggcgccgatgccttcggcagcgatcgcggtctggcgaagcaacgccagcgatcgatcgcgcagcttcgcgtcgacggaggcgaggttgatcagatacgacgcgtggaccacgatccgttcgacgccggctcgctgcgccgcctcgcgcaccacatcaggctcgggcgccacgccgacggaccaccgccacgatcgaggggagcccaagaagcactgcgcaacgctcgcgcctcgctctccggcgcgttcgagcatcttgagcacaccgccagcggccgacacgtgacagccgacgcgcaccgtggcgaacctcccctgttgcaagtgagccctgttgcaagtgagccctgttgcaagtgagccctgttgcgagtgagccctgttgcgaccgggccctctgtctgggtccctccgtcttgctcggcgctgctaatcctcgcgaccgaactcgggcagctcgaccgtggtcgccgaacgcggcgactcggtcgcggccggcttcgaggatgcgccctcaccgaagaggtcctccagcatcgacagaccgtcatcgcgtgtcgtctgctcggcgcccgcgcccgcctcgtggcccgttggccggtcggccgtggcagcccccgcctcgtcaggggcgacctcggcccccgtgtccttggggccgtcctcagggctgtcgacatctggctcgccagccgacccgccggaccgagccccaccggcggcctctgcggcctcggcagcgagaccggccgcgtccttggccagcagggacccatcggccaccaggtcgtcgacgacggagcgagcgtgacgggcgagttcgcgcaagctgccctcgatcctgcccccctccgcctggagtcgctcgatcacgccggcgaggcttgcggcgagccgatcgctccgcgcacgcacctccgcggcctcacgctcgaaccgcgaccggaactcctcctccagtgccgcagctcgcgccttggcctcgtcgacgacacgggccgcctgggtcgccgcctcgcgccggagggcctcggcctcggcctcggcgtcgcgccgcaacgtctgcgccgtctcctgcgcgagtcgtagcgttcgaccgatcacgctgtccggatcgaggtccacctccacgccagcggcagactcctgggaacgctgctcgtcggcgagggcaaggcgtgcctcgagttcgcgaatccggcgtcgcgcgtcggcgagttctcgctcgagcacctcgacgccctcggccacgcgctcgaggaacgcatcgacgtcatcttggtgatagccgcgcatgcgttcgcgaaactcgacctcgcgaatcgcacgcggattgacgacatgctcgtccatagcgactcctgtttcgtacggctgcgggcgtctcgggccagagcgcggcggttaccgagcgatgatcgggatcaacaggagctggatgaccaagatcacgatgagcggagagagatcgagccgcacccctccgccaccgatggcgggcatcacacgcctgatcggcccgagcaccggctcggtaagccgcccaagaatgatgcggatctcatggagcgtaccgccgggattcgttaccgggaaccagctcagcacgaccgagagcacgatgatgatctcatagagctccagcaggtcgatgagcagtcccctaactcccatgctgtagtccggcccctctctgaacggtccgctgtcgcatccggaacatgtcctcgtccgcaacctcgatgcgcgctggcgacaggaggtagacgctggaggagatctccttcaacttgccaccaagagcataggcaagccccgcggtgaagtcgatgatccgacgccgaagctccttatcgactccttcgaggttgatgatgaccggctgatctgccttcatgcgatcaccgatctcctggacgtcggcgaacttcgtcggcatgacgagatggatcttcgcccgctcgggctgagcactcaacgtccgcaacaccggttgggtgcgttcctcgtgctcccccgcatcctcgccctgacccatcagcacctgcaccttcggtgttcccacggtactcaccggctccgtgcgcagccgccggtccgactcgacgacgtccctgtcgaaccctccagagatggttccttccatctcctcatcctcctcaaccacgcccaaccaggcaagcgcgcggcggaacccgctcatggaacctccactccctccgacgcgctcaggttagcacgtgaaccggggcgagggccgagcaaagcggtccccaatcgcaggattgtcgcaccctctgtggttgcccagcgccaatcagcgctcatgccaaacgagcgctcagggagctccaactcgtccgcaagggccacgagcgaacggaagaacgtccgcaccggtgcttcctcacccggcaacgcgacacccatcacgccgacgacacgcagaccaagggatcgagcggcggcgaccagctccggagcgccttctcgcggcacaccactgcgagtcgccggagcgtctggcggtgccacctgtacgaagacctcgccgtcgaagccgagggcggcgagacgttccgcttcgaccactctcgagagcgtctcgaccacgctcgcagcaccactcacctgcttgatctggcgacgctgcaagtgaccgatgaagtgccaccggacgtcgagatcgcggagcgcggcggccttctccgcgagctctgacgcgtagttctctccgagctcccgattacccgcctccacggcggcgcgcaccgtttcgaccggatgggtcttcgtcacgcagacgatgcgaggcggccggaccggagcgagcgtggccacctcggcctcgatggcgcgacgccgctcgcgaagctgctcgacgaggttcatcgacccggcccgacgaggagcgcttggcgcgcagacgtgcgatcccgccgccaggagtaccaccgctcctcgtggatggtacaggcctcgagatcgacgatctctccgacaccgacacgcccaagctggtcgcggatcgccgccgtgagatcgagcgtcggacctcgaaagtactgggggccaagggtggtctcgacctcgctgcgagcgggcccgacgaactcgtagcagcatgcccgggcgtgcgccccgatcaccgcgacccggacatcgccgccgagcccctccgctgccctctcgacgatccggccgaccacgcccggccaaccggcatggaccaccgcggcgtcgccgttgcgtgcggcgaggaccaccgggacgcagtcagccgatcgcacgcccgcaacgagctgatcgccgactcgccggatgatcccgtccgcgtcgacgccccgacccacctcttgcgcctcgacgaccgccgtgccgtggacctggtggacccacgcacacggcagctcccagccgaacgcactcgctcgtggccacagctccgcggcatccccgtcgccacgctcggtctggaccactcgcagacgcccatcgagcagactcagctcgatcacggtcgtctacctcagaaagaaaggaacgtccccgtcgtcgtcgtcgggatccggctccggctcggccacgacctcacgccgcggagtgaacgtgagcggtggcagctcggcgtcgtccacggcgacgcgacgcgtcgcgtcgctctccgaccaggtgttgaacccggccgcgatcaccgtcaccttgacctgatcttcgagggcgtcgtcgatgaccgacccgaagatgatgttggcctcgtccgaggcggcagcctgcacgatctgggccgccttcgtcacttcgtgcagcccgagatcttgcccgcctgcgatgttcatgaggatgcccttcgccccgtcgatcgaggtctcgagcagcggtgagttcatcgcctggcgcgctgcggtctcggcgcggccatcgccgcttgcctggccgatgcccatgatcgcggtacccgccgagcgcatgatggtccgcacgtcggcgaaatcggtgttgatcacaccgggagtcgtgatgagatcggtgatgccacgcacccccgacagcaagatgtcatcggccatgcgaaaggcctgcacgagcgaggtcttctcgttcgcgatcgtcaggagacgatcgttcggtatcacgatcagcgtgtcgacgtactcacgcagccgactgatcccatcctcggcctgctgggcacggcgacgaccctcgaacccgaagggtcgcgtgacgaccccgatggtgagcgcaccgagcccgcgagcgatctccgcgacaaccggcgcgccgccggtccccgtcccgccgccctcgccagcggtaatgaagaccatgtcggcccccttgagggcctcctcgatctcctcgcggtgctcctcggcggcctggcgcccgacctcggggtccgaccccgcgccgagccctcgcgtcagctgtcgaccgatgtcgagccgcacatcggcgtcgctcatcagcaacgcctgcgcgtccgtgttgatggcgatgaactccacgcctcgcaggcccgactggatcatgcggttgacggcgttgccgcctccaccaccgaccccgaccaccttgatcaaggcgatgtagttcgccttcgcgtccaccacgttcctcccgccgccgttggcccctcaatcccccctacgctaccgtgcccacacggaccgcttagccggaacgcacgccaaacgtgccggagggtccaagggcgagcacgttggccccgagggccacgcccacgcctccgcttcccaccaacgcgccacagctcacgagctccccggcgaccagagcgggggccggcccgagcacgcacgaggcaccggacgccaagaccgcgacgacccggccgccagcgctcaccacgcggcgcactccaccccgaaccccgacgacgaccgcacgtgcggcgaccgggccgacatcactgccgacggggggagggcacgcaccgcccgagcacagcgcaagatgaggctcgacggacgacgccaccgccggcacggccacgacccgtcccgacgcgagcagcgcacggccctcaccgagcgcgaccacgcccgttcgggcgcgcacgcgcacgatcacaccgtccggcaacacccgtcggaccgcgaccaccgccacgatcgggcgctcctcgcccagcatggcggcgtcgaccgccggcactccgagcacgagcggcgctccggcgagccgcgcgtcgagcgtccccgcgacggcgcggtccatcgcctgcccgagcccttcgacgcgaacccaccgaacccgcatccacggaccccacacgacgctcaccgcggcgccgacgcccagggcgagggccgtgagtccgatcaggactcggcgccggatgcgcctcgatcgttcgcgtcgtgcgtcgtcgagtcggtaaatccgacgagacgcacctccgtccgcagctcgactcccacccgacgagcgacttcggcgcggacgaattccatcaacgctcgcacgtcgtcggccgagccccccggatcggcctggatgaagttcgcgtgcttcggcgacacctcggcgctgccgaggcgataccctcgaagacccgcctcgtcgatcagcttggctgcgggagcctccggcgggttcacgaagaccgaccccgcgttgtgaccgcccggctgatgtgcgcgtcgccatcgcaccacctccttgatcatcgcctcttcgtgggcacgatccccgcccgccaactcgagctcggcctcgagcaccacctcggtgggaagcagcgcactgtggcggtagccgaactcgagcgcctcgcgactgcgtcgtctgatctggccgctcgcgacgtccgcgacgaccgccgagccgagcaccgccgccatgtctccgccgtggccccccgcgttcatgcgcaccgcgccgccgacactccctgggatgccgaccgcccaggccatacccgcgcgaccgaccgcggcgagtcgtcgggccgcgacgggcaggagcacggcacctccgaggatgaccggaccgtcgctcggggcctcgatctcggcgaatccggcgccgagctcgacgagcagcccgtcgaagcctcgatcggcgaccagcatgttcgatcccgcgccgaggacgaggatcggcaccttcgccgcacgaacgagcgcagcgatcgccgcgacatcctcgacccgctcgagcacgacgccccagcgagcgctccccccgacgcgataggtcgtccgcgcacccaagggaacctcacggtgcacctcgatgccgagctcgccgccgagacggacgagatcgctcacccgagcaagtcctcgagctcgctgtcgaccatggtcacgtcaccggctcccatggtcaggaccacgtcgcccgggcgcacgacggaggcgacgaaggcagccagcgcgccacgatcggcgacccagtgggcgcgctcccccagtcgctccgccgcggctcgccagacgacctcgccgctcacccctgggatcggctcttcaccggccgcatacacgtcggtcacgacgacctcgtccgcatcaccgagcgcccgaccgagctcgacaccgagcaacttggtccgactgtagcgatgaggctggaagacgaccacgatccgaccggagcccagctgacgcgccgcctgcagggtcgccgtgatctcacccggcagatgggcgtagtcgtcgatgatccgagcgccacggagctcgcgcttgaactggaagcgccgcgcgacgcccacgtagcggcgcagcgccaacgcgacggcgtcgaagggtgccccgacgctgagtgcagccgccaccgccgcggcgccgttgcgcacgttgtgcatcccgagcacgccgagctcgatactgccgaggcgccgatgatcgaggaagcactcgaacgccgaatgggtcggcgtgaggacgggattgcgaatctgcagccgcgctgcctcggcgacaccgtaggtcagggccccctccggggcgagagccgccagccgtggatcgtcgacacagatcaccggtgcgagcgcgctgccgccgacgaacgcctcgaacgaggcgaccagcgcgtcgaagctgccgtagtggtcgaggtgatcgggctcgaggttggtcgccacggcaaggtgacggtccaccgcgaggaaggtggcgtcgctctcatcggcctcgacgacgaacaacgacccgatccccgcgtgaccggacgctcccgcctcgttgagctcggcaccgatgacccagctcggtgcgaggtctgccgcctggagcgcctgggcgatcatggccgtcgtcgtggtcttgccgtgcgtacccgagacggcgacgacctgcttgcccgccgtcagcgccgcaaggagctccgcgcgcgacagcaccggcacgcctcgggcgcgcgcagcggcgagctcgacgttggacgacggaatcgcggtcgaggcggcgacgacgtcggcgccgtcgatccagcgcgcatcgtggccgagatggacctcgaccccgatcgcctccaaccgctcgacgagcggacctcgcttgagatcggacccgctcacgacgaatccccgacccaccagcacgctcgcgagcgcgctcatgccggctcccccgatgccgaccaggtgcacccgacgaatcccctcgagcgacgtcactccagccatcgcgccacctcctcgacgagacgttcggtcgccctttcggtcacgagcgctcgagccgccgctcccatggccgtgcgcagggatggatcaacggcgagctctgcgatggctcgccccagcctctcggcaagcccagggccctcctcgacgacctcgctggcaccagcggcaacgaagtactccgcgttggcccgctggtggtcacccggtgccttcggcaacggcacgagcacgctcgcgacgcccgcgatcgcgatctcggccagcgtcgacgaacccgcgcgcgcgacgacgacgtcgcccgccgcaatggcatcaccgagccggggatcgaaaccgacgaccggctggtagctcgccatcgggtctggcacctgcggtggaacattgcgctcgccgaggaaatgccagaccacgacgtcgtcgacgagaccgcgcccgacgacctcgaccatcgcggtgttcaaggcgagcgatcccagcgagccactcgtcgcgaccaccagcaccgcgtccggcgcgatcccgagacgcgacctggcctcggctcgcggtgggagttcgcgcgtgggtggacccacgatcaccgcacgatcgcgcaccaacctcggcacccgtgcgggccacgcgaggacgagctcgctcgcgaacggcgccatcagacgattcgctcgacccagcaccgcgttctgttcgacgaggacgatccgcgcgcgccgtgcggcggcgacggcgagcgcgagcacctgtggcgccccaccgagaccgaccgcgaccgacggttgcggtgcagccaggaggcggcgaacgttctcaccgaatgcgccgagcttcggagcgcggcgcgcgcggacgatcccagcctccgcaagacgcacgcgctcgatcgcgtgtcctcgcaacgtcgcatcctcgacgggacgatcgctggtcacgagcagcacccgggcgcgggcaccgagcgcggtcgcgacctcgaggcccgcgtggagatgaccagccgtcccgccagcggcgacccacacgacgcgatcgctcatcgacgccgctccccacggtggaccgaggcgagcacgaccccgagcgcgatcgcctcgacgaccaacgacgaacccccttgcgaaacgaacggcagaggaacgccggtcacgggcaagagccccaccacggcaccgagattgaggagtgtctgcgccgccagccacaccgccacgagcaccgccaccgcatgcgcacccgacatcggcgtccgctcggcgagcgccagtaggccgaggatgatcccgccgagcgcagcgatgaccccgagcgcaccgatgacgccaaagtcttggaccacgagcgtcatgacgaagtccgtgaccgcattgggcacgtagccccagttggcgagtcccgctcccaggcccgaccccgtgacgtgggcggtggcgaaggaaccgagcgcctggacctcctggtacgacaggcttgcacgatagcgccatgggtgcagaaacgacagcaggcgcgcacgccgatacgccgacgagaaggcagcgagcgtcgcgaggcctccgcccgtgagcgcgatgggagcgagtcggcgaagcgggaccctcgcgacgaccagcgcgccggctccgatcgccgccaccaccagtgcggtgcccatgtcgggttcgatgaagatcgcaccagcggtgaccgccgtgaccacgagcaccgggccgaggacgcgctcgctgggtcgtgacgtgacgagcttggcgaggtagagcaccagcgcaagcttggcgaactccgatggctggatctggaacgggccgacggggatccatcgctcggcgcccccgacggtcgtgccgagcccagggaccatgaccgcgcccagccccgccagcgccgccgcgaggagcaccggcgaccacgcgagcactcgctcgaggccggcacggcgtacgaccacgaagctcacccatcccatcgcggtggcgatcgccacccaggcgacgtcgtggagggcggcggacaccggcgaacgcccgaccgctgcctgtgcctccacggtcgcggccagtccgacgagcgtgccggcgagcgcgagcccgcccccaaggccgacgatccagccgacggccgagccacgcccccgacggcgcccagagggccgaacacgtgcgtcgatcaccgccacgcccatcacctcccaagcgccgcaacggcgcggacgaagtcctcacctcgttcctcgaaactccggtaccaatcccacgaggtcgccgccggcgcgagcagcaccaccgtgcccggcagcgctcgctcgctcgccaccgccaccgcctcgtccatcgagttcgcctccacgatccacggcaccgcgtcgccgaggtcggccaccactcggtgggcactctcgccgatggcgaccacgccagcgatccgctccgcgacgtcgcggagccgctcgaaccccgtgcccttggttcgaccgccggcgatgagcacgacacgatcgaagctcctcaccgcagccacagcagcttccggcgtcgtggctttcgagtcgtccacgtaggtgagcccaccacgaacggccacgacctggagccgatgagcaagcccccggaactcgcgcgcgactcgacgcgcgcgttcgagctccgcgccactcgcctccgcaagcgcccaggccgccagcatgttcgcgacgtcgtgtggtgcacgacgtcccaactcctcgacccggacgagcgtgcggccgtccggcccgacgagtgcaccatgctcgacccgatagtcggcgtcacgcgccgtcgcactgaaggtccgcacctcgaccccgcgagggatcgcgatggcgtccacggcaccctctccgacgggccacacggcgacatccccgggcgcgagccgctcgatgaggcgcgccttggccgcgcgataggcctcgaacgacccgtggtagtcgagatggttcggcgtgaggttcaacacggtcgcgacggaagctcgaaacgtcggggcccagacgagctggaaggaggagacctcgaccacgagtcgacgagcgccactgtccgccaccgccgagagtggcgtgccgagattgccggccgcgacggccccgtcgccgagcatgctcgcggtgagcgtcgtcaccgtggacttcccgttggtaccggtcaccgcggtgatgggggccgcggcgagaaggtagccgagttcgagctcgccgatcaccggaccgtcgagcccgagacgttccacccgttcggtgcgaatcccgggggacacgacgaccaggtcgaagcgcgcgccaacgatggcgtccggatccacgagctcacgcccctcggagcgcgccttgtcacgcagcgctcgagcgtcgtccgccacgatgacctcggcgcccaacgatcgcagcacccgttcggccgcgagaccggacacgctcgctccgagcacgagcacacgcccgcctgccacctgggcacgcagcgcatcggcgctcatcggacccctccgagcgacaggaagtcggcatagaacacgccgatcgcgagcgccgtgcagaccccggcgatgatccagaagcgaatcaacacggtggtctccggccacccgagcagctcgaagtggtggtggatcggcgacatgcgcaagatgcgccggtgccagacgcgaaaggtgaacacctgcgccacgaccgacaacgtctcgatgacgaacagccccccgagcaagacgagcagcagatcaatgtgcaggagcagggcaaggccaccgagggcggacccaaggccgagcgacccgacgtcacccatgaagatgcgcgcaggcggcgcgttccaccagaggaaccctgcgagcgcgccggtgactgccatggcgaataccgcgagatcgagcgcatcggggacgtggtagagcccgacatggcggaacatccaatacgccatcagcgcgagcgccccgaaggcaaagatcccagaacctgccgcgagaccgtcgaggccatcggtgaggttgacggcgttcgaggaaccgacgacgacgatgaccgcgagcacgatccacccgaccgacccgagttcgagctgggccccaccgacgcgaaccaccgcgagcaccggagggactccgacccaccatcgagccaggaccgcaaacgcaagcgcgaccgcgacctggagcgagaacttccccgccttggtcaacccgagcgagcgccgattgcgcaccttcaagagatcgtcgacgaccccgatgaggctggaagcgatcgtcaggccgacgacggcgataccgccgcggctcagctggacaccgagatgggcatgcgtgaccgcccagccaagggccgtcccgaccacgatggcaatgccacccatggtcggcgtcccggctttgaccaggtgccggctcgggccgtcctcacggacctgctgacccaccccccgcgcgcgctggcgctcgatgagccacggcgttccgaccacggcgacgaccagcgacaccaaggcgctcgcaaggatggcgatcacgcgagcagccccccgtcgtcttggagcgcagcgtgcaccacgtcgatgtcgtcgaacggcgtcgcaacgccgtcgatgacctgaactcgttcgtggcccttgcccgcgaccacgagcacgtcgccgggggccatcatcgccacggcctcctcgatggccgctcggcgatcgaggacgacccgcacgccacgacgatcgcgccaccccgcgacgatctgggccgcgatggcagcaggatcctcgctgcgaggattgtcgctggtgacgatggcaacgtcagccagctgctcggcaaccgctcccatgaggggccgcttggcctgatcacgctccccgcccgcaccgaagacgacgagcaggcgcccccgcggaccgaccaggagtcgagccgcccgcaacaccgccgccagcgcgtccggagagtgcgcatagtcgacgacgaccaggcctcgcgggccgaggatgcgctgcatgcggccccgtgggctctcgacctcgccgagcacccctcggaggaggtcggggtcgaagcccacctgctcgagcacggaaaccgccagcaggatattgcggagattgtgctcaccgacgagacgcgagcgataccagcgtccgttgcgacggaaccggatccctgccgcatcgatctcgatgtccgtcacggcgctgatgctcaccggtaccaccggcacccgcaccgacgccgcgagcctcgcgccccagggatcgtcgacgttgatcacgccgatcgccgtccgttcgggctcgaacagccgtgccttcgcggcgaagtagtcctccatcgacccgtggaaatcgaggtgatcttgcgacaggttggtgaacaccccgacccgtacgtgcagcccctcgatgcgctccatcgcgatcgcgatcgaggacacctccatcgccacccagcgccgccccgagtcgcgaaactcagcgaggcggcgggcgagctcgggagcctcgggcgtcgtgaggcgactccagagcgtgccgagcacaccgaccccttccccgaggcgctcgagcagctgggacacgaccgacaccgtcgtggtcttgccgttggtgccggtcacaccgatcaccgagaccgccgacgacgggtcgccgaagatgcgatgggcaacgcggccgaccgccgtacggagcgaggcgcgtggcaccacgagttggggcacaccgaccgcgaccggctggccggcggtgagcaccgcgacagccccgcgtcgcaccgcctccgcggcgaagtcacgcccgtccacgtgacgccccggaaccgcggcgaacaggtcacctgcgcggatctcgcggtggtcgatcgcgataccggtcaccgaggtcgcccggtcaccgacgatgcgcgcgtgctctacgagggccccgagggcgtcgagcgtgacgccaacctctggacccacctcgcagactcccctcccgcacggacccggaccatggtagccctgcagcacgggggcagcgttcacccctggaccccagcccctggatgcatgtcgacgctgctcaaaagggtcgacgtgacttgcccttcgggcgtcaccccgtagcgagccagcgcagcgcgcatgatctgggagaacacaggtgccgccgtcatcccaccgtagatgggcaccggctggtcgaccatcacgatcgcactgaggaccgggtgctgggccggcaccatcccgacgaacgtcccccagtacgccccaggctggtaaccaccgcgcgcatggtagggcttctgcgaggtgccggtcttgcccgcgacgaggtagccaggtatcgccgcatcaggagccgtggcgttcgaccccgtgacgtgcgagaagagccccagcagctcggaggcgatcgccgcaggcatcacccggtgacgaggtgcggccggcgccaggtggacggtcccatcggtgcccacggtgccagcaaccagggtcgggttcacgaggacgccgccgttggcgaccgcgttgtaggaatcgaggatctcgagcggcgtgacgagctggtcctgtccgatcggggtcgagccgatcgccgtcggtgaccactcggagggaggcttcaggtaccccgcggtcgcgcccgggaacgcgagccccggatcgacaccccacccaaggcgccggaaggagtcgtagatcgccgtcgggccgagccgctcggccagttcgatcgtgcccacgttcgaactctgggcgaggatttgcgacatggagaggacctcggtggggtgcgactcggcgtcatggaacaccgagccgtcgatcaccagctggtttggaacggtctccgtcgaggtcggggtgatgatgccccgctcaagggccgcagcgaacgtcgcgatcttcgcgaccgatcccggctcgtacgcgtaggccaccgggtcgttcaaccagctctccgtcggcagggcgcggggcacgtcgacgggctgactcccgccgaccgacgacgtgcccggcagcgccggcgccgcgagcgacgccatcgcgaggatctggcccgtgtggggatccatcaccaccgccgtcgcgccgagggctcgcgtcgtctcgatctccgacgccaaggcgttctcgacgtcgctctggaggacgggatcgatggtgagctcgatggacgtccctgggcgcggcgggtgttcggcaacgaggcctccgggtaccggcgcaccctgagcggtcaccctctcgagggcccaccccggtgctccggcaagcacgcgctggtaggcgtactccaggccaaacgtaccgacaccagccggactcacacgaccgatcaccggctcggcgagatcgccgagcgggtacacaggcagcgtcgtcggtgtgacggtgatgccgggcagcgcgccgtcgagggcgagctgctcgatacgcccaccgacgctcaagagggcatcgggatcgacgacgctgtagcctccgtgcacctcgagcgcgctcgtgaccgacgccacggacagcccgagcagccgcgccagtcgctcggcctcgggcgcaacgtcgtggatctgcaacggatcggcgatgatcgcgtcgcgctcgatggaggtcgcaaacgcgacgccgttgcgtgcgaagatggcgccgcgcggtgccgacagcacgacgcgtgtctcgctctcggacgtggccagctgcccataccgcggcgccgggcccacggtcagacggacgagctgcgcggcgatggcgccgagcgccaccaccgtgacggcacccacgatgcgcacgtgcctagccacgcgcgaccgttccggccggaaggggcgccgactcgcccgttggttgaccaagcgccgtcgtcgggacgggtgctccccgtccactagcaagctcctcccacgtcgggtggacgaaaccgtgtgccgccgcgaccgccgccgcgtggctcggtgcgctcagggtgctgagctcggcgacgaggtcgagatgatgcacctcggcggcttgcagcgcgagctcggtcgcctggacggtattggcgaggcgctgtgcaacgagccgcgcggcgatcacgcccaacgcggcgaccacgaccacaccgatcacgagcacacgccatggcaccgaccgacgacgtggtgcgcgcgtcagcacacgaagctcgggggaacgtaggcccgagcgacgaggcagtgcctccgctagcgcagcgcgagccattcgtgcacctccctctcccacgctggtgcgagatctgccaccgcgagcttgcgcgcgaccctcaggcgggcactcctggcacgagggttgcgcgccacttcgtcgtcgctcggcacgacgccccgccgggggcggcgctccagtacgctcgtccagctgccagccggtgtggtgcgcggagccccgccccgctcggccacctcgaagaagcgcttcacgaggcgatcctcgagcgagtgataggtgagcaccgcgagtacgccaccgacctcaagcgcctcgaacgccgcagggagcagggccgtcagctgaccgagctcgtcgttcaccgccaggcgcagagcctggaagacgagggtggcgggatggcgcctcgtcgtacgccgcgacggtggggttgcctcgacgacgacctcggccagctgctcggtcgtcgtcggcatggcggcgaggatcgcgcgggcgtagcgacgcgcaagcggaccgacctcgcctcgacgcagcagctcggtgagcccatcctcgtcgagcgaggcaagcaatgacgccgctgacgtcggcgcctcggggtccatgcgcatgtcgagtggcccggcgaggcggaacgagaatccccgctgcgcgtggtcgagttggagcgaggagacgccgagatcggcgatgaccgcatcgatccgacgcgcgccgacgacacgtgcgaggtcgcgaaacgtcccgcggaccggctcgaaccgatcaccgaacgcttcgagtcgccgcgccgcgagatggagtgcctccggatcccggtcgaggccgatcacgagcgcagcaccggcatcgaggagtgccgccgcatggccgcccaagcccacggtgacgtcgagcacccgtcgaccctgcggttcgaccgcgcgcacgacctctgccaccatcaccgggaggtggatcggctcagccacgatcgcctccccgatagcgctcccaggtcgctggatcccacagctccacggtgccgaaggcgccgtggacgcgaacgtcgtggtcgaggttggcataggcacgatggctcggcgggagcatcagtcgtccgaggcggtcgatctcggcctcgaaggcttcggaggcccacgaacgcagtcgccgacgctcctccggatcggcccagtgctcggcgcgcacctcgccgacgaacgcgttgaagtcctcgacgcgccacacgaccaggcaggggtcctcgtactgcgaaggcgtgacgaagcactgatcgccgaactgaccacgaaagcgcacagggagcgtcaagcgtcccttggcgtcgagcgcatgcgagaaggagccgaagaaccggccggtcggctcaccgagctgccacacctccccgcgcctcctcaccgtcacccagaagggtgccactcacgccatcggcacccacggcgccccactttagcccacgacaccccaccggggcgtgtgaatcgcgtccgttggctccacgatgcgcacgagaccgtgcgagcgacccacgccacgctcgcgcgagatcaataccgaggtcggcgtcagggtgctcaaggagggcgccgagttcgcttgagacgatcgcgacgggtccgcgtgtccgacaggcctccatggctgcagtgtgagccgggagccggctcacagcgagaaccgaggtggagttagcgagccaagatcgcccggcgcaccgtcgcgacgagcggatcgagctcgataccgagctgctcgagccccagggaggccatggtgccttccggtcgatcgcgcagggcgtcgacgagttctcgctgacgatcgcgccagagcacggcaacctggaagatcgcgccgcctcgacgacgtcgctgcgcgagacccgcgaccttgttgccgccgacggcgacctctccccagccccagccagcaaagcacacctgcgtcgagagcgggactcgctcggggacctcacgcaccaccgtcacgtcggccaccccgagggctccaagggcctcggcgacggcttccccgagccagaggaacgatctgccaagatgcggatcgagacgcgggtcagacgccggcacaaacacgtggaaccacgcctgctcgccgggagccacgacgaccgcaccgccaccggatcctcgccgaacgatgtcataacccttggctacgaggctcgcagcatcgatcgcgtccacgcgcgtggtcgagcccagcacgaccgtcggcgccgtgggctcagcactgagcagccacggtgatccctcgtccgctggccaccaacggtggatgaccgaggccggagcgcgcagccgcaacgtccgccacggctgcacacgacgatccatgcggccgatcttacggcgtcctcaggcgaggcgataggcgcgcgccactcggtgcctagcatgggggcggcgtcggaccgggaggcaaggcagggctgtggaggcgtacgtgctcattcagaccgagatcggtcaggtcgcgtccgtactggccgaactgcgcaagctcccgttggtggtacgcgccgacgacgtcacgggcccgtacgacatcatcgccctcctcgagggcgagaccctcgaggacatcggacgtcacgtggtcgagggcgtgcaggtcatcgacggggtgacacggacgctcacgtgcccgctcggtcacctcagactcgacgcctaccactccgtcagaacgcagagagcgtccgagcggccccagccctgacgacgccatggcggagttcttctacccgccgcagttggaccgacgacgacgtcgcgaggacctcggcgctcgtcacggcatctgcgagggcgagcacggtctggacacggtgcgtcgccgatgccacgagacccacggtgagcgcggtctgaccggtcacgagggtgcagtaggcggcgagcaccgcccgcggcccacccaccgtacgcaagaacccgacttcgatctcgcgcgggcgaatctcgaacccggtcgcgcgcgtgcacatgccggtcgccaccggcgcagcccacgccgtcccgcccaggacttcggccgcacggcgcccgctggggccgaacgcgacgagcggcgcagcaccgaggtcgatcccgggcggacccaggacgagttcatgctcggccctcgccgtcgtgcgacggagcgccgcaagctggatcgggatcgcgatcgccgccaccaccacgaaagccgccacgccacctgcgagccaccgccgacgccgtcgcatccgtcgatcgctccaggcgcgctcgccctcgagcgctcccggagcttcgtgatcaagcgagtccacgcttccacgctagcgctcaccgacgacccaccccggggagtccatcgatgccaagagcgctgagcaggcgccgacgtctgcgccagcggcgagcggtgaccctcggtgccgtcaccgtcgcgatcgtcgcgggaaccggcgtgatcgacgcggccctcaccctcgatccatcgattcgggtcacgccccgtcacgtgagcggcgtgcgtgccccgaccgcgcccccgatcaccttcaagcacggcgtgcagtccgcgacggtgatcccggcgcttggatcagggtctctcgaagcctcgccccacgagcgacccgtcccgatcgcgagcctcgcgaagctcatgaccgccctcatcgtcgtccgccgacacccactcggctcgaccgcatccggccccactctcaccatgaccccagccgacgtgatcctcagcgacgtcgacgtcgctgaggatcagtcgactgtaccgatcaccgccggcgaacgcctgaacgagcgccagctcctcgaggccctgctcgttcgctccgccaacaacatcgccaccatcctggcgacctgggttgcgggctcagaatctgccttcgtggccacgatgaacgcaaccgcacgcacgatggggctcaccggaacacactttgccgacgcgagtggcttcaacaaggccaccgtctccactgctcgtgacgtcgccatcgtgaccgctcgcgtcgaggacaatcccacgctcgccgcgatcgccagcgagcatgccgtcacgctccctggcgctggcaccctgcccaacatcatccaagcgatcggcaccggcgacgtcgtcggcgtgaagtccggcttcaccatctggtcgggaggctgcgcctcgatcgcggtgcggacgcccacccccgtcggtgagctcaccagcgtgggtgtcgtcatcggcgaacagggctacgcctccctcgcgcgtgcggcgcggcgcgcccaggcgctcgcgaccaccgctgctgcgcgcgtcgcgagcgagcgcatcatcgacacgcgcgagctggtcggatgggcgcgggcaccgtggcgagcggcgccgattccgatcgtcgcagctcggagcgttcgcgtcctcctgtggccagcgaccgaggcctcggtgcggatcgcgctgcgaccaccagcgctgccggcgccacgcgggcgcgccgtcggcgagatcgtcgtgaccacaccgaccacaaccatcaccgttcccgcgattctcaccgcgagcctcggaacgccgtccttcggctggcggctcacccacgcgctctaaggagcgtgcgcgtcgcacaggcctcctgcggcgcgagccttgctcgctcgatcgccgacgaaaccaccccggtgtggcgtcgccaacgacacggagcgccggttcgtccggcgctccgtgtcacactgatgattcgccacgcctgcgggtgcgatcttggctcctgccgtcagcgaagcgcgccagatcctcgcgctccaccctggcgccgacgctcctcgatcgcgaccacggcaagtccgccgacaccaacgctcgcgagcgcgacaccaccccaggtgagcgcggtgatcgaggacggggcgctacggggccccgtgaccagcttcaccgcggtcggctgggtcgcgaccgtcggagctgacgacgtggccggagcggtcggcgtcgtggatccactcgtcgtcggttggggtggcgtcgagcccgcggcggtactcggcggcgcgacgaccgtcacgctatccgttgccgactgcggagcggcatcggtcgagaccaccgtcgcggtgttcgagagcaccgtgcccgcggcatcggtcgcatccacctggaccgggacgatgatcgagggcaacgattgaccgggctggagggtctgggtcgacgcaaaggcatacgtacacgtcaccgtgggtggcgtcgaggagcttgccagcgtgcagctccagccgtcgttcgcgttggcattcgtcagggccgtctgcgacacggtcacacctgcggggagcgggtcagtcacggtgaacgcgaaggaactcgaactcgatgggctgttcgacagcgtcccggccgcgaacgtcgctcccgagctcggacccggctcggcggtcgccgagctcgtcgcaacgccagcggtgatctcccatgagaaactctcaccagggttcgcgacgtggttcacgttgtcgaccttcgtgatcgagaggatcggacccgtggagaagtaggcgggatcggacccaacgagcacgaagtcgtcggctcccaatgaaagattcgggggggtcgactcgtaggtgaggttgatttggccaggactactcttcgtcgaggccgagacgatgtcgttcgtcaggctcgacggattgacgtagccgaagtcgacgacgttacctgcgctggaggagccattcacgttgcccgacgcgacccagaggttgcccgtcgtcggatcgagcgtcatggactcagcctgcgacgcaccgttcggggcgttaacgatgttgtacactgcgccctgtccgctcggcacgttgctcgtcgaactggcgttgtcgatcgggaggctgggcaggctgacgtagccgacctgcgtgtcgaactcacggacgaaccacagctcattctggccagcgtcgagctggaagtctccaagccccgacgagcccgtcggcagcgaccagctgtaggcggccgtcgtcaccggcgacgatggaatcccgctgcccaggttgtacatcgcgatatctggcgagggactcgtctcgccgacgaatgcatagacggtgccgccgatcgtatcgacagcgagcgaacccgtcagcgacgcggtgaccaccgcgctcacggtgttcgtcgtcgtatcccaagcccagacgtggctgccaccggtccagtacaccgtcggccccaccgccgcaatggcgtagtgctgggtgctggagaactgcgtccccgcgggctccggcggacagctgatgcttcccggcaccgatcccgtgctccactcgtcatagctcggcgaggtcgccgaggccgtcgcgttctgcgatgtgaacgcctggaggttcacggcaatcactggacacgcgctgacgccagtgacgcccgtcgggatcatccccgtgacgttccggtagtacagcatgttgccgacggcgaccccgtcgccgagatactgaccgcccaggccgttcagctggatcgtcccgaccaccgcatgtggcgcggctcccgacacctcgatcaggtaattcggcgagttggagtcggtgtcgacgtagtagttgccgttctgagcctgaaccgtttgctcgagatggaccaagggggagatcaccccgttgtcgacgaggacaccgaggttgaacgccaccggctgatacgcaggtgccgtcgacgccgacagggcgctcggccccatccacgcgaccgcgaccagcgctcccgcaacacccgcactcgtggtccctcgcaggatccacgtcgatcgcctcgtcacaacgcccctcctcaacgtccctcccctacctggctcgacgcagtgcagctgcgatcggcgtcagtactctagcactcactgtgtctcaattccacacgtcttgtgaactctcacggaatgcattcttcatactactcattgtggttatccgacctcgtcgacgtcgaactcctgtcgcgacgcaccgttctcggcagctcgcaatgagcccgaagaatgcctcgcaccgtccaatacggctgcaccaggcgtccatcaggatcggggcgcgacacacacgccaccgcacgcgctcccacgctggtcgaggtcaacgctccgcacgcaggtgggcccggtgggattcgaacccacgaccaagggattatgagtcccctgctctcaccgctgagctacgggcccttggttgcccacgcggccatcgacgctctctcaacccgtcagagcgcgggcgacgaccctcgctcacgccagattcgaagctccgggggagagactcgaactctcaaccgcacggttaacagccgcgtgctctgccaattgagctaccccggaaagcgacgtcagtctaggggtcacgatcacgctcgcccacctccgacgctcgttcgacgcgactccaccagccacgcgaacggtgtccgcgtgagcaggaagtcatcgaacgccgtcaacagacctaccgcgggccgccagccgacccagacgacgacgcccccgagcaccaatcccgccaacacgtcgcccgggtagtgcaccccgacgtagacccgcccgaacgcgaggaggaggcccgcgatcgtcgcgatccaggccatgaggcgatcacgcgcgagccagaggccaacgatcaccgcaccggcgacggtcgcgtgaccgctcgggaacgagtagcccccgctgcgcgcaagcagcacctcgacgtggtgcagcgtgacgtagggccggcgttcacccacgagcggtttcaggacatagtgcgcgatcacccaggcgaggacggtcccaccagcggcccagagaacccccgcaaccgcacgtggcgcctgtcgacgcgagcgagcgcgccaccacgcgaccagcagcaccacggcgagcacgccgacgccgacgaagtgcgcatactgcgccatcgcgccgtgggcccaccccgtctcacgcgcgatgcgattgacgtcgagataggcctcgtcgttgagatgctcgagctcgcccacgtcacacgcctccaccagtgttggcgatcgagcctaacgcacgcatgcgaaccggtgcgccagggccgcagccgaccctcagcaccgctcggctagtcctcgagcacacgccgcagcaccggcgcgagatccccgcggcgcaaccgtgcgatcgcgcgagcctcgatctggcgaatccgctcgcgcgcgatgccaaagtacgccgccgcatcctcgaggctgtggggctcgttgccctccagaccgaagcggaaggcgagcacctcacgttcgcgtggctcgagatgggccagtgcgcctgcgatgaccgtgcgaagatcagcgtgctcgatggtctcctcgatcggttctgcgtcgcggtcgggcacgatgtcagccagcgtcacgtcgcgctcctcgcctaccgcctgatcgagcgagagcaccgaacgcgcgtaaccctggagttcgcgcacgcgcagctcatcgatcccactcgcggcggcgagctccgccatcgatggctgccgcccaagggcttgctcgagctcgcgccgctgaacctccacacgagcaagttcggcggcgatcccccgaggcaagaccacatcgcggcgcgtccgcgtgagcgcctgcgcgatcgcctggcgaatccaccaggttgcgtacgtggagaaacgaaatcctcgccgcccgtcgtagagatcgatggcacgcaagaggccgatcgtgccctcctgcacgaggtcatcgagcgagatccccggttgcacgtagcgtcgagcgatgctcacgacgaggcccatgttgccctcgacgaagcgctccctcgccgcttggaccaccgccgcgacgtcgggcggcacgtcttcggcttcctgggcttcctggagcacgatggagagggcgacctcctcgtcgggcagcaggcgaccccgcctcccgcgcgccagcaccgcccgagcgccgtccagcgcctccggcgacaccccactcacgagccgctcccgagcgcgacgtccgaccgcgcctcgacgaggtaggcgagcagcgcaccggctgcatcgagatctcgaggttccgtacgaaggcgatgcagggtcatgatgtgatccgtccagcgacgctggcgctcctcgcgctcaggtccagagaggccggcaaggccgcgcgcctcacgctcgagttcgacacccgcctcgcgcaacacgagcaccaccagggcatcgtcgaagctcccttcggagtcgctggcagcgatgcgatggtagagctcgcggacgtcatcgccgacgccctcgagcgcggccgcgaccggcgcctctcctcgcgagccgagggctgcagcgagtgcacgataggtcgggtcgcgaaacagtgcgggtaccacgaggtccccgagcccaggatcgctggcgagggcgatgagcaccgacgccgcagggcgatcgaggcctgacgcctcgctcgtacgcagacgtcgcggtcggagggcgctcggaagccgcgccgcaagctcggcctcgcgaaatccggtccgatccgccagcatggcgatgtactcagaccgcacgagcgggtcgccgaccgaggcgagcaccgcagcgacgtcggccactgcacgcgcccgcccctccaccgatcgaagatcggcacgggcgaggactcgttcaaggcggaaccgagccaccggcacggggctcgcgagagcctgtcgaagcgaatcgggatcctcggcgaaggcctcggcaggatcacgtcctcccggcaaggtggccacgagaagctccacgcctgctgcctcggcgaggggggcgacctgctccgccgctcgctggcctgcgtcgtcaccgtcgaacaggaccacgacctggggagcgaagcgacgcaggatgcgcaggtggtcgtcggtgagcgccgtgccgcaggtcgcgaccgcagcgacgccagcggcatcgagtgcgatcacgtccgtgtagccctcgcacaccaacgcgcgccgctcgcgcaggaacgtcgaccgcgctcgatcgaggttgtagaggacctgacgcttgtggtagtaggccgtgtcctgcgtgttccgatacttcgggacgccatctctggccggaggcacgacccgaccgccgaacgcgatgacctgacccgcgacctcgcggatcgggaacacgatgcgtccgctcatcgggtcatgcagcgacccgtcctggccgcgcacgcggatcccgacctcgagcgcgatcgccgccgatgctccgagttcggcgaggctcgccgctcgcgacggcggtgcatagccgatgcggaacttcgcgatctggtcctcgctgatccctcgagccgcgagatactctcgagcgcgctcacctgccggtccagcgagctggtccgcgtaccaggtggtctgggcttcgagcacggtaagtgcctcgcgacgcgtggacgctcgcggctcaccggcagcctcgtgctcgatgcgaagaccggctcgtcgggcaagctgctcgacggcttcagtgaagtcgaggccctgcacctcacggacgaaggtgatcgcatcacctcgggcgtgacagccgaaacagtagtacaccccgagctctgggttcacactgaacgacggcgagcgctcgtcgtggaacggacacagaccgacccaacgcctcccgacccggcgcagcgcgaccgtctcggagacgagcgcgacgaggtccgtcgcatcgcgtacgcgccgcacatcggcgtcggctatggccactcgctcaaggctacgccgtctcggcggcgtccttcgcgcgcatcaacgactgtgcgacggcgaggcgcgcgatcggcacccggaacggtgacgcgctcacgtaatcgagaccggcctcgacgaactgcgcgatggaggccggatcgccaccatgttccccgcacacaccgaccttgagtccgggacgctctcgccgccccgcctcgaccgcctgccgcacgaggcgcatgaccccgcgtgggtcgaccgtcttgaacggattggccgcgaggagctcgctcgccagataggcgggcatgagcttggcctcgacgtcgtcgcgcgagaagccgaaggtcatctgggtgaggtcgttcgtaccgaaggagaagaagtcggcctcgcgagcgagttcgtcggcgatcagcgcagcccggggcgtctcgatcatcgtcccgaagcgcacttcgaatcgcgcgtccgaggccgcgcgcgcctcgtcgaaccattgcctggcgagcgcgagctcctccctgctcaccgtgagcgggatcatgacctccacgatgggctcaccaccggctcgtgcgacgtcctcggccgccgcaaggagggcgcgcacctgcatcccgtagaggccaggcttgacgacgccgaggcgaacgccacggatccccagcatcgggttctgctcatgccacgcacgtgccgcagcgagcaggcgctcgccctcgtcgtcgagaccccccgctgcctcggcacgctcaagcgcggtcacgtcggggaggaactcgtgcaggggtgggtccaagaggcgaaccgtcaccggcagcccactcatgacctcgaggatcccccgaaagtcacgccgctgggcctcgaagagctcctcgagcgcgctcgcttcctcctcggggctctcggccaggatcatccgccggacgatcgggagtcgatccggctggaggaacatgtgctcagtgcggcacaggccaatgcccttggccccgaagcgccgcgcacgctcggcgtcgtcggcggtgtcggcgttggcgcgcacgcccaccttcccaaaggcgatctcgtcagcccatccgagcacgatctcgaactcctccggcggtgcggactcggcaagcggcatccgtccggcgacgacgacgccactcgtgccgtcgatcgaaatccagtctccgacaccgacctgcctgccaccgacgcgaaaaccgccctcctcgatcacgatcgcgtccgcccccacgacggccggcttgccccagccacgcgcgacgaccgccgcgtgcgacaccagcccaccgcgggtcgtcaagatgccctcggccgcgagcatgccgcggacgtcctccgggctcgtctccttgcgaacgaggatgaccggctcgcctgccgcgtgtgcttcgaccgcactcgcggcgtcgagatacaccctcccgacggccgcacccggcgaggcaccgagcccccgggtcagtacgtcgacgacttcggcggcaaagcgcgggtggagcacctggtcgaggtggtcgggagtgatccgggcaaccgcctcctccttggtgagggcgatggcgggatccttggtcatctgcaccgccatgcggagtgcggcgacaccggttcgcttgccgactcgcgtctggagcagccagagcttgccctgttcgatcgtgaactcgacgtcgcacatgtcgcgaaaatgccgctccagccgtgcgaagacatccatgagctccgcaaagacctcggggaactgatcctggagggcagacagcggctcggtaatgcgaatgccggcgacgacgtcctctccttgggcgttgacaaggaagtctccataggcaccctgctccccggtcgcggggtcgcgagtgaagccgacgccggtacccgagcggtcatcgcggttgccgaagaccatggcctggacgttcaccgccgtccccaggtcgtcagggatgccttcgcgctcgcggtatgcgtgcgcgcgctcgccgttccacgaccgaaacacggcctcgatcgcgccacgcagctgatcgcgagggtgctgtgggaacgggctccctgcgagctcaccgacgagctcgaggtaggcaccggccagccgacgcaactcgcttgggggcagctcgccgtcgttctccgtgccgactcgttgcttcgcctcgacgagcaagcgctcgaacggctccggatcgagcccgagcacgatgcgcgcgtacatcgcgatgaatcggcgatacgagtcgtacgcgaagcgctcgtcattcgtctgacgagtgagaccttcgaccgacgagtcgttcagccccaggttgaggaccgtgtccatcatgcctggcatcgagaactgcgcgcccgagcgtaccgacacgagcagcggatcggatgggtcaccgagccgccgacccatgcgatcctcgagcgccccgacgtgacggtcgagctcctcgtcgagcccgtcgggccacccgttgcccaagtaggcacgacaggcgtccgtcgaaatcgtgaagccgggtggcaccggcagaccgagcacgctcgtcatctccgcgaggttggcacccttgccaccgaggagcgccttgagctccttcggcgcgactgggtgcgcatggtcgaatgggtagatgaacggcacgaaggaccctccacagctcaccgctcgtgcgcacggggcgcgcacgaggcatccgacgccgggcgtcgttgcccacaaggtgatgggagtctagcgttgatggaacgttaatgtccgagcacgcggcctcggcgtggccgccaagcgctcacgaacgtgggcgaccaggtctgcgaccggaatgcgtacctgctcgagcgtgtcccgatcgcgcaccgtcacggcgcgatcctccagcgagtcgaagtcgacggtgacgcaccacggggtgccgatctcatcctggcgccggtagcgcctcccgatcgactgggtctcgtcgtagtcgacgtccacgatcgtcgcgagatcggcgaagatctcgtgcgcgagctcgacgagggccggcttgcgcgagagcggcaagaccgccacggtgtagggcgcgagatgaggcgagagccgcagcacggtccgcgactccccgttgacctcgtcgacatggtaggccgcgaggaggaacgccatcgctgcgcgtgtgacgcctccggctggctcgatggtcgaggggtagtaacgctcctcggtcaccggatcgagcacggagagatcctcccccgaggcggcggcgtgggctcgcaggtcgaagtcggtccggtttgcgatcccctcgagctcaccgtagccccagggaaagcggaactcgatgtcgacggtgcgtgacgagtagtgcgagagctcgtcggcgtcgtgctctcgcaggcgcagccaatcaccctcgaggccgagctcttgataccagcgcagtcgctccgcgatccagaagtcgtgggcctcggcggccaccgacggatgcacgaagtactccatctccatctgctcgaactcgcgcgtgcgaaagacgaagttgcccggggtgatctcgttgcgaaaggacttgccgatctgcgcgataccaaaaggcggacgcagccgcatcgcgcgcgcgacgctctgtgcgtccacgaacatcccctgagccgtctcgggtcggaggtaggcctcggctccctccccctcgaccggaccgacgaaggtgcgaaacatgagattgaaggcccgtgccggggtgaggtcgcgagacccgcacttcggacacacgccatcgatctggtctgccctccagcgctcgtggcaggaccgacagtcgaccagcggatccgtgaagtgctcgaggtgacccgaggctcgccagatggccggaggcgtcaggatcgacgcctcgaggccgaccacctctcggcgctctcggaccatgtaggaccaccaggcctcgcggatcttgcggagcagaaggacgccaagcggcccgaagtcgtacgccgagcgaaatccgccgtagagctcggcggacggaaagatgaagccccgacgcttcgtgaggctgacgacggcgtccaaggtatcgggctcaggcatggcgccagtgtaggagcaacgaccctgctcatggcgcgacgggccggcttgggcgaggctcgggcgcgacgtgggcgagaccgcgcaagcgacgaccgaggaccgcctcggcgatccgggtcgcgagctcctcgaagcgccgcgcagccacggcatccacggcgcgcagtccgtcgcgcgtacgcccctcgagcaccagccgagcggcccgcatcgccggaaccccgatcgcgaccccgccgcaggcgtcacagcgcgcctgctgggaggcggggtcgatccgagtcagctccccctcagcgccgcacgaaccacaccgatcgaggctcggaccaaaacctgcgagctggaccgcccgcagcgtcaacgcggcgaagagctctcgagaaggggcctccacgagtagcccgagtccgcgcgcgaggagcgcgaacagcgcgtcgtcgccgtgcccgtcctcgctcagaccatcggcgagatcgagcagctcgtaacaccaaccgacggtgtccggatcgaggtccccacgtccggcgaggttcgccgcgacgagctgggcttgggccacgccgtcgagctcgcgcccccgccagcactccacgtcgagcaccgcggacggctgcacgatccctctgaggcggctcctcgcggcccgcgccccccgaacggtggcacggaccttgccgtgctcccgggtgagcagcaacgccaggcgatctcgctccccgagcggccaggtccgcagcacgaccgcaaggtcgcggtaccttccgctcacggcgcgcgacgtcggaagcgacgacgacgccccccgacgatgagcaaggcgacgaagatgaccccgacgagcaccatggctccgatcccggccgcaccccctccgatcgcaccggccgcgagggcacccatgaccgccaccacgagggcgagcaagaaccacccggccgctcgctgcagttgacccgagccgctcatcggcccaccccgccaaagcgccgatcgcgcccctggtactcggcgatggcctcgaagagatgctcgcgccgtacgtccggccagagggtgtccagaaacaccagctcggcataggcgagctgccagagcaggaaattggagatccgatactcgcccgacgtgcgcaccacgaggtcagggtcgggcatatccggaaagtacaagtgggaggccaccgtcgactcgtcgatcgctcgagccggcacgccttcggcaacgatccgtcgaagggcatcgacgatctcggctctgccaccgtaattgaaggccatcgtgagcgtcaggcgatcgttgtgcgcggtcagctcagccgcgagatccatctcgcgcgtcaccgacggcggcacgcgccgactgcgtcgccccaggaaccgaatccgcacgccacgatcgttgagctcatcgcgccggcggcggagcaggctccgattgaagttcatgaggaagcgcacctcgtcgggcgggcgtcgccagttctcggtggagaaggcatagacggtcagccaccgaaccccgacctcgagcgccccctcgaccacgtcgaacagcgccgtctcgccagcggcgtgcccctgggtgcgcggcagtccatagcgctgagcccaacgtccattgccgtccatcacgaacgccacgtgcagcggcacgcgcgtcgtatcgatgcgctcgagcgccgatggcacctcgctgggcctagccacggcgcaggcgtgactccaagtgctggtgcatgccccgctccatggcgtccatccagagctccgtcatgagctcatccccgcgcaacgtgaagcgacgctgcaccgcatccactcgcttggcgctcggcgtcgtcgcgacgacgagtgaggtcaaggagatgacgacaccaccctcggcttcctcggcaccgccctcgaggacctcgacgatgcccgttggctgcgccacgacgagctcgagccgaccgttcgcgacgaagcgcagataccccacctcggtgtggagcggcgatccgtccggacccgtcgtgtgctgttccatgcggaggaacggccgaccattgctctcgaagcgcaggcgctcttggtagctgaactcggcaacctcgggatagctgccgatcccgctcccggtccaggttccctcgagcatctctcgaatcgtcatcgcccctcccccggccagccctcagcctagcgaggtcggcgtcggcgcgtccgggcgtccggacctcacagccccagctcgtcgagcatccgtgcggatcggcgccagtcgcgctgcaccttgacccggagcgtgagcggcgggtacgcgcgcagccggcgctgggcctgacgtcgcacggcggccagcacccgtccctcgtggccgagcacgatcgcacgctggctcggccgttcgacgtagacgacgacctccacaccgtcgtcgctccacgactccacctggcacgcgagcgcctgtgggagctcgtcgcgcagatggtggaggaactcctcgcgcaccacctcggccacgtaggtcgcgcgtgggagatcgagcgcgacccctgcctcgtagagggcaggaccctccggcaacgaagaggccaggtaggagcgcagctcttcgatcccttccccggttcgcaccgaagccacgaagtactccgcgagcggcacctgagcgagctcggcaaggaccgcgagcgtgcgagcacgacggacgcgatcgatgcgtgcgacgacggcgacgtcgctcggcttcagacggctcgcgagttctcgctcacgagcacccacaccacgctcggcatccacgaccagcagcgcccggtccgcgccgtcccactcgtcatcgacccagcgtcgcaggcgcgccgagagttcgtcgtgcgccgctgcgatgccgggggtgtcgacgaggacgagctccgcatcgcccacgcgactgatgacccgcacggagcgccgggtcgtgttcggatgtcgagacacgatggtcgcgcgctcgcctgcgagcgcattgaccagcgacgacttgcccacgttcgtgcggccgatcaccgcaacgaaccctgatcggcgaatgggaggcgcgtcgtcaggatccatcgagacctcccgggtggcgctcgacgagcacggacgcgacccggtgacgcgccacttggcgtacctggagtcgcaccccatcaacgtcgacttcctcaccgacgcgcggcagatgaccgagcagccccatgatcagccccccaaccgagtcccactcgccctcgggcagctcctcgccgatacgctccgagaggtcgtcgatgctcaccgagccccgcacctcccagcgaccctcccccagctccaccacaccctcaccaccggcgtcgaactcgtcgtggatctcgcccacgagctcctcgatgaggtcctcgagggtcacgatgcccgcggtcgagccgtactcgtcgacgaccacggcgaggtggaacttcccgtcgcgcatctccttgagcaggtccgccaccggcttggtctccggtacgaagtggatcggtcgcatgtgctggccgaccggcacgtctcgaaggccagtgtgctcgagtgcgagcagatccttcgcaaggacgatgccaaggacgttgtcgagcgagctctcatagaccggcaatcgagagcgaccaacctcgatgacgacctcgatcgcgcccgcgaccgtcgtctccgctgggacggcgacgacgtccgggcgcggaaccatgacctcccgcgcgatcgtgtcgccgaaggagatcaccgagtggatgagttcacgctcgtcggtctcgatcacgtcaccctgctcggccgcgtccgccatggcgagcaactcggcctcactcacggtggcgccgggcgcgcgccacggcgtgagcagtgccgacaacgaggcgacgccaccggccaacacgcgaatcggccagaagcgcaccaagacggcgacgatcggagcgagacgcagcgcaaccccttcggggtgcaccgccgcgacgttcttggggatcgcctcgcccaccacgaagatcacgaggatctcgaccgccgttgcgacgacgaccccgagcgtgccgaagacatggtcggcgacgaccccgaccagcgtggccgcgatgagctgactgacgagcgttaggagcaacaccgtcgacaggtacgtcgagggagcttcgacgagcgaggccaaggcgcgagcgccccgccgtcgctgatcgacgagcgcttgggccttgactcggctcgtgcgtgtcaggccagtctcggccgcagacaggatcgccgataccccgacgagcagcacgaccgcgacgagggaccaccaatcagcggtgctcaccgctcgctcgccacctcagcaccaacctcgccacgaagcgcgcggtagcgctccagcagcgccgcctcctccgcctccatgcgctcggcgtcctcgtcggcctcgtggtcccaacctcggatgtgcaagatcccgtggatgagcagcaaggccacctcgtcacccacgctcccgtcgtggccacgatcgccgcggtgctcaggcgcgttcgtacgggcaacctcaggacagatcacgacgtcgccgaggagggtcggcaatcccgatgcggtcgagggacggtgctcgctggcgtcgtcgccgacgtcgtcgatcgcgaaggagaggacgtccgtcggcccgacgcggcctcgatagcgagcgttcaggctcgcgatggtctccgcatcgacgaagaccaccgacagctcgctgaccccgtgcacgccgagggcggtgagcacctcggtcgcgaggcgcgccaccatcgcttcgtggatctcgacggcggactgctcgttcgcgacgaccaccgtggccgcgggaggcgcaggatcagccacgggaccctgccgcggtggggtcgtcgtcgtaggcctcgaggatcgcgcgcaccacggggtggcgaacgatatcgcgccggtcgaggcgcacgatcgacacgtcggggatgttggcgagacgcccgatggcatctaggagcccggacgtccctccatcgagatcgatctgggtcgcgtcaccggtgacgacggcggtggatccgaagccgatccgcgtgaggaacatcttcatctgacccgtggtcgtgttctgagcctcgtcgaggataatgaagctctggttcagcgtacggccacgcatgaacgcgagcggagcgacctcgatcagccctcgctcgagcagtcggagcactgcttcgggctcgaggagatcgtagagcgcgtcgtagagcggacggagataggggtcgaccttggccgccacatcgccaggcaagaatccgagccgttcgcccgcctcgaccgccgggcgtgtgagcacgatgcgttgcacccgcttggcacgcagtgctgcagtcgccgccgccaccgcgagataggacttgcccgtgccggccggaccgacgccgaaggtcacggtcgagcgttggatggcttcgacgtagcgacgctggccggccgttcgcggccgcaggctgcgaccgtcgcgggtacgcaacagctcgagatcgctcacggccgacgggctctgctcgtgacgcaacatctcgaccacccgatgcacgaccgcagcttcgaccgcgtcgcctcgggcagcaagcgcgagcaactccccaaggacgcgcgccgcgaggtccgcatcggcgcccgagatcatcaccccgccgtcgcgcacgacgacgcgcgcctgtccgaccgcctcctcgagcacccggagcagctcgtcgtgggcgccgaagacgatcgccaacagctcaggccgatcaacgtcgacccgcgtcgccgcgagcggcggggtcaggcctgacgagaccgcgctcatcgatgccacccgcccagcacatggctcaagtgcccagaccgacgcgccgagacgagccccgtggacgagcgagcacacgaacccacgacacggggtgcctctcccgaccgcgtgatcgacctcgcggacgtgctcgcacggaccgagcgcgccgaggttcgcctcgtcgacggccgaacgtccaccggcttcgtcgatgcctggtcgtcgaggtgcgtacgcctgatccacccgggcggatcgacgtcgctcatccccaccgacgcggtggccgtgctcgccatctcgacctcacgcgcccctcgcgcgccaacgctcggctccttcgccgtcgagctcgaacgagcgggtctcggggcgaactggaccctgtggttgcgagacggctcgagcctcgcgacgagacgcatcgacgcactcggagaggacatcgcgctcatcgtgagcaccgagggcagatccctcgtcgttgcactccgctccctcgtccttgctcgccgctacgaccgcacggcaccacagtgacggctgttcgcgctgacaccacgcctctggcgccaccacgtttcgaccgtacggcacccctagcttagcaggctctgactcgtcatcgaggaagctccgtgcacgcgtcgactgccgagcgcccctggccgaacccgggccgactcgaggaacgcatcgaggtccgagcgtcggatccgcaagttccggccgatctggtacgccacgatggccccatcgtcgatcaaccgatacagcgttcgcagggagatgccgagctcttcggcggcctcccgagtaccgagccacccgttctccatggacacctccgtcgtcaacgcccatggtagacacacagcgcgatgaatcggcacgaacggcactagctgacattccagcacgaccacgacggttccatccatcgcttgcgcacgaggcgaggtggcgctaacatcgcgggcgcacggaagcaccactgatcaaggagtgatcatgcgcagcacgacgctgctgcgtggcgcgcgccggacctgggatcggccagccgtccggtggccctcgttgggttcctcggcgctacgcatcgtcggatccatcgtcctcgcgggcgtgtcgctggccctgctagtggcatcatggctgggtggcgttcgcaacgccggagcagcggttggcgtggtcgtcacgcgcccgatacctgctggcgcgaccatcgaacgcgccgacctcggcctcgcctcgatcaccgttccccaggcggtacgcgccacgctccttgcggtcgacgacgcggtgggccgcaccgcagccgtgaccatcgcacccggtaccctcttggagcgctcgatggtgctcgggccacgaccacggacgccagtgcgctcgatcaccattgccgtcccgtcgacctcggtcgcctcaggcgtcatcgaacctggtgatcgcgtcgacgtgctcgcaaccacccagagcgcatcgagccccgcaaccctcacgatcgcgacgcagctcctcgtcctcgacgtccaggcttcctcgggcgacgaactcgtgaccgtcgcgaccgacagcctcgaccaagctctcgccatcgcccaagccctcgctaccgccaaggtcgatctcgtgaacgccacgggcgtacccggagacacggtgctatcggtgtacccaccctcgatcgcagggctcgcgacccatggatgagcgtccagtcgtcgtccttcagctcgcgcacgccaacgcggtgcgcgcgctcgccgagctcgcacccgtggcacacgacctgcggttgcgatgggacccgaccggcgacgcgctcgacccggcgaccgtgtcggtgatcgtcacggatcgctccgcggccgtggcgcccggggtccggctcgttcgaacgaccgaccccaactgggtggtctcgcttcgcgaggccgtggccgcacaacggccgcgctcggacatgtgtggcagcgacgtcgaacccaaccgcccccacccactctcacgcgacgagcgcccccggtggtcaggtctcgaccactcggacgacaccgacgtcggcgagcaccaccacgtggcggcggcatccgcctcagacgatgccgtgggcacggcgcccgagcacgacctcgaggtgcgtcgagcgcgtctcgtggtcatcgtcgatctcggctcggcgagctccgtcgccatcgcactcgcagcctgcgccggtcggggcacgctcctcgtcgatgtgcgcgatcggccgacgctctggttcctccatgacctcgccccagagctcacgacgacggcccgcatgccggagcggccctacgagctcgcacccccgcatgggaccctcgccaacgagctcgtcctggcagatccgctcagcgagcgccgaacgcttcgagccgccacccgaagcttcgacctcatcgtggtcgtgaccgatgcccgcgaccacgccgccggcgatgaacgatcgacggcgctgcgatcgctgtggcgcgacgcccaggcgaccgtactggccggagcctgcaggctggaggaccgctaccgcatcctcaccacggccgtcgcactctccgcgctgcgccgtgacctcacggtcgcctgtgtcggcgcacgtggggcctcggcgcacagccacgcgaccgcgatcgtgcgcgcactcagcgagcgtgtcccgcgatcggtcagggtcgacgggttcggtctcgaagagctcggcgaccagatccacgagcgacgccacccgatcccggaccgcctggtgcgccccctccgtcccgtcgtccaagaggctcgctcgaggccaccgttcgacccgggagatccagacctcccgctggcaccgctcgaggggctcagatggctcgtccccgaggcgctcgaggcgatctaccacacctcgtcggacggcaaggaggcgtggtgagggccctccgtcgcgacgagcgctcgcgcccgctcggcgagctccggcgcctcgtgatcgcccagccacacgagcgtcgcgagcgtctgacgcaccgccgcctcggtgacgatgggatcaccgaggtcgccatagatcgtccgcaccagttcgccgaggtcgaggccttcgccgagcgcctcacgcacctgatcgatgcgagtacgtcgatgctcttccaggaacgtcaggaccgccccgatgtgcgcaccttcgaccacaggcccatggccgggcagcaggcggcgcggttcgagcgaggcgacgaccgtgagcgacgcgaagtatgcctcgagggagccctccgggtagatgatcgccgaggtgccccggcccagtacgtggtcaccggtcagcagctgtcgatcgggcgtgacgaaccccacgtggtcggctgcgtgacccggaagcgcgacgacgaccacgtccatcgcctcgagcagcgcttcggcgccgcggccggatgcatggacatcgcagccgagcagcgccgccaagggctccgctgcttcggcgtggtcagggtgggcgtgggtggtgagcacaccccgctgcctcgcgcccgcacgatcgatggcatcggcgatggccccgagatgcgcgtcgatcatggggccgggatcgaccaccacggcgtgggtctgcgtcgagaggatgtaggtgttggtgccctcgagggtcatcggggaagggttcggcgcgaggatccgctcgatgcgcaccggtccgtgccgcgacggccccacgtcagcatcgcgggcgtctcggtgtgcatcggcctcgaccacgactcccacgttaggggacgacgcggtggctgagtacccctggctcgaccgctacctgtcgctgtgcgctcgcctcgagcacgcggtgcgcgccgagctcgatcccgccgccctgcccaccgacgcagcagcgctcgaccagctcgctcgccgccacgccctcgacatcgacgaccttgcggcctcggaacaactcctcggcgccgtcgtacgctacgtcatcttctcgatgcgcgcgctcggtcccctggagccgttgctcgcggaccccgacgtcgaggagatctcgatcaatgccccgagggaggtgtgggtacggcgccgggggcgcttcgcgcgcgcaccgctcggtttctacgaccacgagcacgtgcgacgagcgctcgaacgcctcaccacgaccgctcgcggcgcccaacgccagctcgatccaggccagggcatccaagacttcacgctcgccgatggctctcgcgtccacgtcgtccatcccgaactcaccccgcacggcacctggctcgtgaacatccggcgcccgctggcgaccatcgggcacgccatggccgaggtaccgcccctcctggcgagcgccgtgcgcgtcggcgccacgatcctgatcgcgggcctacctggcgtcggcaagaccacactggcacgagcgctgctcgatggcctcgacgacgccgtgcgagtcgtcgtcgccgaggaggtcggagagactcggctcgcgcgtgggaacgttgcgcacctgcaaacccgccgccaacggccgggggtcgaggcgatctcgctccgtgcgctcgttgcggcgtcgcttcgcatgacgcccgagcgactggtcatcggcgaggtccgagacgaggaggccctgcccttcgtcgtggcggtcgcgagcggcatcccaggactctcgacgatccatgcccgcgagccccgcgcggcgctcgagcgactcgcgacgctcgccgccatcgcaccagaggcgccaggcaccgcgacgctccgccatctcgtggccgacgcgatcgacctcgtcgtgcagctcgcctggcacgacggaccacgagtgaccggactcgtcgccgtcgagggactcagcacccccgatggcatgggccccttcgtcgtcaccaacctgctcgctccggccgctacgcggacctcacgcctcttcagcagattcccacagctcctcgaggcacgcacggagctcgtcggatgagtgcacacttgcgcgacgcgatcgccgggctcttggcactcggcgccatcgctgtgctcgccctacccgcccttgcccggttgcacgcccgtagctccgcaggacgccgaccacgacctgcgaccgtcgcgctcgggcttgccggtgcggcgatgatcacgctgtggcgtctgccggcgatcgccgatctcatcgcggcagcggcgctcggactcgccgtggtggggactcgtcgccgcgacgctcgccgcgagctcaccgcgctcgacgcatggcaccgatggctcagcgagttggcactgcgcgtcggcacgctcggcgaggcgctgtcggaggcgttctgggtcgccgtggagccgatcccaccggatcttgcccttgcgatcgcacgggccagatcgcactttcgcgtcgctcgggacttcgccgcagcgatcggcctcctgggtgagcaggcctcggatgcgacgaccgccaccgtatgccgagcgctgaccaccctcgatggcctcgcgacccacgaggtcactcgcagtctcgaggcgctcgctcgcgacctcgatgcgcaacgagcggtggcccacgaactcgatgcgcggctcgcgggcgcgcggctggcccgcgggctcgtcctcgccgtccccgcactcctcgtcgtcgtcgggatggcgatcgccggaccgagtgcctatgccaccccgctcgccgaacgtatcgaggcggtgagcctggttaccctgctcggctgctggctgtgggcgtcgcacctgctcgtgccggtggttgccgttcgcggccagaaggaggtgccgtgagttccttgatcggccttggtggtgtcgcgctcctcctcgcctcggcgtggttggcgacgaccgtgcgcgagatcgtcccggctcggctcctccgccacctcgagctcccgcccccgtcacgtccggtcgcgcggtgggtcgcacgtcgctccgacgactggctgctggccacaggggtgcagcccgcgaccgatctcgctcgcttcgccgatccggccctcggagcctcaggattggtcggcgccgttggcatcgtgggccacagcgctcccgccgtgtcgggcgccctgatggcaccggtcgtcgtcgtcgcgctccgcgtcgccatggtcatggccaccgcacggcgcgtccgcgagcgcctgcgcgcgacgtggtccagcgagctcggtgagatccgtcatctcgtggccgctggcgcaagcctccccggggccctcacgactcgtcgggacgccgacaccccatggtcgacgcagtggcacggtgccctcgccgagatgggcgagggcaccgacctcgaggtggcgctcgcgcacgtggcggaacgcctgcgcgatgcgaacgtcggggcagcgctacgcctgctggggagctcgtgggcggtcggcgccgtgacccctgcgctcggcgagctcgaacgcgacgcgctcgcacgccgacgcgccgacgcactgcgtctcgccagccgacgtgagcagctcgtctggatccccgtcgcggtcagcgccctcgtacccggcgtcacgttggtcgtcgtcccgctcgccgcgggccttcagaagctcgtcggcctctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtaaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagcccatcgatggcacgggcacgtgacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatttcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagctcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctaggcacgctcaccgagacgagccgagtttcttgcctctttagtcattgtatggtatcctatgatcatccacggaaggaggtcacaatgccgacacggacgttggctccatcgacgcgcgactggttccgccgaaccctcgagcgacgacgacggatcgctcggagtctcgagaggctggtcatcgccatcgtgacacggaacgatcccctccacgaggctggcgagggcgtcgtgtcgaccgcgatcatcgtcgtgatcatggcgttcctcgcggtggggttgtggttcgcgttcaagaccatcatggccaatgccacgacgaccgtctcgaatcaggtcgcgcagctcgggagctgaggatggctcctcactcctggcgagcctcctggccgcggctgggacggtgtggatcctcgcactcgtcgccgccgtcggcagcaccgcgctcgcccaactccagctcaacgagtggtcccaggaggcggtggccgctgccgcggcgacactcgccagcggcccgacggccgcactggccgcaggcgaccaggtcctgcgcgccggaccgaccgtggtccgcgacgcgcacgcgacgtggaccatcacgtcgaccaccgtcgcgatcgacctcacgacccatgccccgagcgcactcgtcggttcggtcacgctcgacgctgcggcctcgcagcgaggaccgtgaacgcggctcgatcgatctcgtcgcactgatcgctgcgctcgccgtcgtcgcatgggtcctcggtccatggctggtggcgatcctgcgcacactcagcgccgaggcgacactgtcacagatcgcgtggtcgctggcgcgcggggccgagaccaccgggcagccaccgccccaggccgtcgcggttcccggcatcggaacggtcacggtgagctggagtggcagtctcggtcgctgcggcatcgcgacggtcacgacgcatgcgaccctcgctgccccacgctttggcgttctcgggccaggcgcgatctcgctcgccgagcgagcgaccgtctcgggcgacgccttcgtcggcggcacgatcgtcggggcgtgtggtgggacgtgagcgagccgaggcgggctcggcgctcgtgctcatcccgatcctcgcactcgcgacctcgatcatgctcctcgtcatcggtgcgatcggtgcgctcggtgtccgccacgcccaactgcgcaacctggccgcgagctgcgcgttgtacgcatcgcgtgccgtgtcgacgacggcctgggaagcgactggccagctcgccatcgacccgacgacggcacgcctggacgcggcgagttgccttggcgcaagcggtgtcgccctgtcgggttggtcgttgaccgtcacgcccccgatgaccgtcaccgtggcgctcgaggaacgcctcgcgatcccagtcgtgagctggctcaccggctcgcccgcactggtgcaggcaaccgcaagcgccacccagtcgtcctccggccccggataggctcgctgtgtgcacgcccttgccgtcgacgcgaccttcgtgcgagccgcatcggtcctcgtcgtcgcacgcgatcgcgtccccggtgccttcgcgagcgcctttcgcccctggggcgacggctcgctcctcgccatcgcgtaccaaggagacgagcccgccccgctcgtgcgcctcgtcgaggacgggaccaccctcgagatcgcgacacgccgtgttcgcctcgatggcgccaccaacttccgcgatgctgggggactccagacgcctcgaggaccgctgccttggcgccgtcgcttccgctccgagaatctcgcacgcctgagcacacgcgactgggacgtcctcgaagcgctcgggatccgcctcgtcatcgacctgcgcgcaccctcggaagccgccatggccccgacgcgagcaccgtcgttcgtcgagcttcgaccgatgccgctcgcagcgccactcgcgggcgccgaggacgccaccgaggccatcctcacgggcaggctccagagagtgacccccgatgacctcatcgtccactacgagcgactcgtcaagcaccacgcgtcggtcctccacgcagccgccgacgtcctcgacaccgcacccgacccgctggtcgtgcactgcaccgccggcaaggaccgcaccggactcgtggtggcgctctggcagctcggcgcgggtgccgacctcaccagcgtgatcgaggatttcgcactctcgaacctcctccgaaccgtgccacgcttcgtcgaactccgagatcgcatcgccgcaaccggcacagatccacgggccgtccagccctacctgagtgccgtcgtccccgcactgctgcacgcgctgtcactgctcggcgtggtcaccgcctgacaccgcgcaccgtccgcgacgaacgtccgggcagcgcaggtgcctcgaaggctcggtgcacgatcgcggaaccatcgtggctcgaaggccggaatgcttgcaggtgcgcgtgcaacaagctactgtcgggtttggccaccacgcaccgtgggggcatggcactcgtcgacacgtcacaagcgccaccagcacagacacgcggacgaaggagggggcatggccgatccaacgatcgaggcgctctacgaagagagcaggctcttccctccaccaccgaacgtgctcgaaggcgcagaggtcacctcgcgcgagatctacgagcgcggccgagatcccatcgcctactgggagcaggaggcatcgcacatccagtggcgcacgccctggacgagcgtgctcgattggtcgaacccgccctttgcgcggtggttcgtcgacgcaacgctcaacgtgaccgagagctgtctcgatcgtcacgccgaggccacgcccgacaaggtcgcctactacttcgagggcgaagagggcgacaccagggtcatcacctatcgccagctcctcgaggatgtctgccgcttggccaacggtcttgcgcagctcggcgtcagcaagggcgaccgcgtcgcgatctacatgggtatgatccccgagttcccgatggcgctgctcgcctgcgctcgcctgggcgcggtccactcggtggtcttcggcggcttctccgccgacgcgctcgccgatcggatcaacgacgcccaagcaagcgtggtcatcacctgcgaccagtcccgtcgcaagggccagaccatcgacctcaagcgcatcaccgaccaggccctcgaacgatgccccagtgtccaccatgtcgtggtcgtcgaacgcacgggcgccgacgttcccatgacgaccggccgagacgtgcgctaccacgacctcgtcgccgaccagccggccgagcggcccgccacggagacctcgagtgaggacccgctctacatcctgtatacctccgggaccaccggcaagcccaagggcatcgtgcacacgacgggtggctacctggtcggggtgtcgagcacgcatcgactggtgttcgatctgcggcccgacgacgtctactggtgcaccgccgacatcggctgggtgaccggccactcctacatcgtctatggcccgctcgccaacgggaccacgagcgtcctctacgagggtgtgccggactaccccgatcgcgaccgctactgggcgatcatcgagaagtaccgcgtgacccagctctacaccgcacccacttcgattcggacgttcatgaagtggggggacgagtaccccggtcgccatgacctgagctcgctccgcgtgatcggcacggtcggcgaaccgatcaaccccgaggcgtggatgtggtaccgcgaggtcatcggccagaatcgttgcccagtggtcgacacctggtggcagaccgagaccggtgcgatggtgatcgcaccgatcccgacggtgacgcccacgaagccaggatcggcgaccatccctctccccggctaccaagccgacatcgtcgacgacaacggcgagtccgtcccgctcggtggcggtggctacctcgtgctcacacacccgtggccgtcgatggcgcgaacgatcttcggcgatccccagcgctacatcgacacctactgggcgcgcttctccgatcgcgagcacaacgtgtggcgctacttcgctggcgacggcgccaagcgcgacaacgacggctacttctggctgctcgggcgggtcgacgacgtgatgaacgtctccggacaccgcatctcgaccctcgaggtcgagtcggcgctcgtcgaccatcccgcggttgccgaggccgcggtgatcggaagggccgaccccatcactggccaagcgatcgcggccttcgtgacgctgcgcgccggcatcgtcggtgacgacgccctcctcgcggccctccgagaccacgtcgccgagcgcatcggcaagatcgcccgaccggcctccatcgtcttcaccgacgagctgccaaagacgcgctccggcaagatcatgcgcaggctcctgcgcgacatctccgagcaacgccagctcggcgacgtgaccaccctggccaatgcggacgtcgtcgccgagatcgctgcgcgcgcccaggcacagcagacaccttccgacgatcgttgagacggaggcacccgatggggtgccacgagcagcacgaaagagcagcagcacccacgtgggtgctgcgaccaatcgcccgacacggccacagcgcccgcacggacgtgtcggggtcagccgcgccacccgcgcgggcagccagcatcgttggctgcagcatcacagggggaaaggaaaccataccgatgaccatgactgacgcccacaccgaggtggaggtctcgtccgtcaaggcgaccgcggacccgggcccgctcgggctcgctggcttcgcactcacgacattcgtactcagcacgatcaacgccgggatcgtatcgggcaccctcgtcggtgtcgttctgcccctcgcgttgttctacggcggtctcgcccaactcctggcggggatgtgggagttcaagcgagcgaacggcttcggcgcggttgcgttcaccacgtacggtgcgttctggatgtcgttcgctgcgtacgcctactacatcttgccgaagctgccagcggcgacggcctaccaagcgaccgggctctacctgctcgcatggaccatcatcacggtgatcctgttcgtcgcgacgctcgggctgacgcccttcttgaagatcctcttcgcactgctggccctgacgttcctcgcgctgaccatcggggcgcttggccagtcgacgtcgatgaccaagatcggcggttacctcggcatcatcaccgcgatcatcgcctggtacggcgtgctcgccaacctcacgaaccaggccttcaagcgccgggttctgccccagtagtaccgcgcgctcgctgagcctgaaacatcgccgccaacggggacggtccgaggacctccccaatggcggcgatggcgcgttcacggcccgccccatcgccagctgccaccgcgtcggcgagctcctcgagcagcgcaggcagcgcgtcgagctcgacgagctgattgagcgtgcggatctggcgagcctcacggcgtaagcccgtcgcatcgtccgctccaagggccaccgctgcgcgctcgatcgcgctcaccaccgtccgctgcttccgtccgtccatcgctcatcctcccgagtgcgagacgacgctccgacgaggccaccctcgccgcgagcctcccgcgccctcgcgcggcccacccatccgtcgccgggtggagcgcttcactgcccacgcgaaccggtgctcgagacgcgctctggccgagcccccgtggtgattccgtcggctgcgcgcttcgatggcgcgctgccacctcgggccaccgtccgcctgagcgccccgacccacgaggtgagcctacgtgggcggatggccgtcgcgacgcgacgatgactcgaggatcgcagcgacgacgagcgcgacctcgcgcacctcgatcgcgaacgccgcgagatcagccaccgaccccgagtggtgtcgtaacgcatcggccaccgcctcacgcatcaccggatcgaggtgacgctcgagcacgtcgaggaggcgttcggtgacggccccctcgtcgtcgagcaccaagccgagcgcttccgcgtcgcgcttcgtcaggcggcccaccgtgcgtaggctagcgctcgtcccagcgagccacgatctcgtcggcgagcagacgaccgcgcaccgtgaggcgacgtcgtccgggcgcgccttcctcgaagaacgcagccgcccaggccgggacggcctcctcgtcgatcccgtcgcgctgacggagggcgaggtaacgagcctcgaggacacgggcgctcgatgaaagcacctcgagcccctccgtcggcacgagacccgcccgcacccgctcacgccacctcggccagctcgccacgttccacgagcgcacaggatcacgaaacgaatgcgcgctcggtccgagcccgagataggcgccaccaccccagtaggtctggttgtgtcgcgactcctggccggggcgggcccagttcgagatctcgtaccacgcataaccagccgccccgaggacggcatcggcgacctcgtagcggcgagcctgtgtctcatcgtcgacccggagcgaccgaaagcgcgtgcccggctcgacggtgagggcgtaggtcgagacgtgcccaatgccgaggtcgacgacgccggccaaggtgcgtcgccacgacgcgtcatcctccagcgggtcaccgaagatgagatcgacgctcaccctgaggtctgcgaacgcctcgacgaccgcacggatccgtccgagcgcatctgctgcgttgtgtccacggccgaggtgggcgagcacgcggtcgtcgagcgactgcagcccaaccgagatgcgcccgacaccggcctcccgccacctcgcaacccgccccacggagagatcctcgggattgacctcgatggtgacctcggcgccggagacggggcgcgcgagccgaatcagcctcgcgaccgcgccgtcatcgaggtaggagggcgtccccccaccgagaaagaccgaggtggcgcagaagcgttcgtcgacgaggccctcctcgacgcggttggcaagctcgcgttcgacgtcgtcgacgaagtcgcggtcgggctcgcgaatcgcgaccgagaagtcgcagtaggcacagcgtcgccgacagaacgggacgtggacgtagagcgccgcctcccggaggggctcgtcgcgaccgtcgacgctcagcgtggctccggcagggccctcagacccaagcggtcgatgtgctcgatcatgccctcgagactcaagccgagcagtgcaccgatgatccgcagatcctcgcggcgcaccgtcatgacgcgaccgttgaagtcctggcgttgcacctggatcatgccgaggtagcgctcgaggagctcacgctcgggcccctcgaggctccgcagccgctggagatcgatggtgcacttctcggtcgtcggcgccgccaccgatgccgcccgctccatctccgcgagatcgatggtgacgcgatcgtcgtcgaggatccgcgcggcacgctccgtggtgctgaccgctggcgtcagctcactcgtcggcctcgggagcagctgctcgacgtcgacccgatagaacgctgccaagcgccgcagccgcggcaccgaaatggacctttccccccgctcgtaggcgccgagcaccgaggccttgaactccttggccgagagcgcctcgaccgcctggaggctgtagcgctgctgcttgcgcaccagccgcaagcggcgaccgacctcacgtgcatacgcgcgctctgcgctgtccatcgcgatcctcctgtccgcaccatggtgagcgcgccctcgctccgctcaacctcaagcgtagccgcccgcacacgcagggtccacaatattgccaccaagggcgacgagcagtgcacccgcgaccacagccgccgtctccacacggaggatcccgcctggcaaacgcacgcgccgcacgtcggcgaggccatcgatccggccggactcaggaccgatgacgatgcagcgtacgtcgcgtcccacgaggccacctcccgccggatctgccacgacgacgccgtctcgcgggagctcgtcgagtgtgccgacgtcgtggatccgcaccacccagggcacctctgcctgctgggccgcttcccgcgcgatgcgctcgagccgaccgagctcgtgcgctgagagcggttcgccaccgcgacggtcgtggggagcgcgcaggagccacagatcggcgatgccgagctcggcgagcttggcgaccatccacgccaggcgctctctcgagggcgcatacgacgcgatcgatacctccggcgtgcgtcgtggctgcgccacgatctccccgcacgcctcgatccgagccgtccgacgccccacctccgcgagcgtcgcggcccgtacgcgaccccgaccgtctccgatccagatcgatgcccgaggcccgagtcggcgagcgcgcaggtgggcagccaaggcatcgtcgacgaccggggcctcgagatcgtcgacgatgaagaacggttcgaggcgtccggttgccccgttggcgtcgcgacccacgcctacttgaaggcggaacgcagcttcgagagcagcgactggtcgtgatgctcgctgaccagctcaccacgcagggcagcgaggcgccgccacagctcgtcctcctcggccgtgagctcgctcgggatcgtcacctggacctcgacgatgaggtcgccgcgcccgcgacgacccgacagcgcaggcacacctctcccccgaacgcgcgtcgcccacccaggctgcgtgccggcggggatctcgatgacctcgagcccatcgagcgtctcgagttcgagcttggtaccgagcaccgcctgcggcgccgagatctggacacgggtgatgagatcgttgccgcgccgctcaaaccgctccgacggctccaccagcacgtggacgtacagcgttcccggctgaccaccacggggcgctgccggccccttgccggagagcttgaggaccaacccattgtcggcaccaggtgggacatcgaccacgaagcggcgctcctgcgtgcgtcgaccctcgcctcggcagtcggggcacgggtcggcgatcaccgttccctcgcctcgacagacgtcgcaggtcgccgtggtcaccatgcgcccgaggaacgactgggtgatccgcctgaccgcaccggttccctggcactgcgagcacacacgcggctgggtgcccggccgggcgcccgagccttggcaggtgccacacaccgcgggcatgcgcagggagatctccttctgcgccccgaagacggcctcttcgaaggtgagccgcacctcggtctcgatgtcctcgccgcgacgctgggccccttggggctgctgcgtgaacccgccgaagacgctctggaacaggtcggagaagtccggcccgaacggcccgccgccgaaggggtctccgggcccgaacggtccgccctgaaccgatcccgtccggtcgtaggttcgacgcttgtccgggtcgctcaggacgtcgtaggcctcggtcacgagcttgaagcgctcctcggcgcctcgatcgccgccgttcacatctgggtgcagctgacgagcgaggcgccgatacgcgcgcttgatctcctcactggaggcgttccgagacacccccaggacttcgtagtagtcgaccacgtcactcctcatcgtcgacgccgcacgcggcgttacccgaccgcctctgccacgccctcgcgcagcgcctcgaccaccaccgacgccccaccgtagtccatgcgcaccggccccaacagaccgatcgacccgacgatggtcccgtcgacctcgcacggagcgacgacgagggagcagtcgtccagagcggcgaccccgctctcgttcccgatcgagaccggctcaccttcgtcgatgaggcggcgcagcacctcgacgagcgacagtcgttgctcgatcgtttcgagcacaccggcgaccttcgagagctgatcgagtgcgctcgcggtcttggcgacctctcgaacccgaagttccggccgctcgcgcacgcggctctcgtcgatcgcggcgagggccgcgaagacgaccgcgtccatctccgcattcccgctcgggaggacggctagtcgctccgacattcggtgcccgcgcaaccgagacgcgaggaagttccctgccgcgacgacgaccgactccggcggggtcggctcgatctcgaacatcgcacgctcgagcgcaccccgcgagccgacgacgaccccaaggatcgtcggtggatccaagggcacgagatggacggcacgcaccacctcgacctccgaggaccacaccgcgatcacggccgtgtactgcgagtgctcgaccgcgagatccagcgtcagctcgaggacgtcgtcccactcaccacgggcagcacgcaggcgacccacaatctctcggcgcagccgctcgatgagcgtcgtatcgacacgcatgagacgatcgacgaagtatcggtagcccttcacgagtgggatccgccccgacgagacgtggggctgtgccaggaagccctcctgctcgagctgggccatctgcgcgcgcacggacgccggcgagagaccgaggtgggtcacatcgagcacgtgcttgctcccgaccgggacaccggtccggacgtactcggccacgaccgccatcaagatggcttcttggcgcggactcagctgctcttcgaccacgatgtgcgcgaacctcccgtgaggatgctcgccctcagtctagccgcgcacgcgcccacgctgggattgcgcccttcggcctggtctcgaggcccaggtcgctcagcctcagtggctaggcctcggtggcgctgcgctctcgattgacggctcgcatgaggcgcgacttgcgacgcgcagcctggttcggatggatgatgcccttcttcgcggccttgtcgagtcgctggatcgcggcacggagatactgctcgccgtcgtccgcggtggcgttctggagcgcacgcttgacgcgcgtcttcaactcgctccgaaccgccttgttccgctcgcgccggcgctcgtcttggcggatgcgcttcagttgtcccttgatgttggccatgactccctctcggcgacgacgctctcgaatccctgcttcgaaatcctgcttcgaatccctgcgctcgcggcgttcccgcgacaccaacccacgagcacacccgcgtacgctcgagagcggtgcagcgcaagccgcagcactcggacgacgaagtctagccgtgaggccagcgcatcctcgcacctaggctggagcgaccatggtggacccggcctcgatccgcaacatctcgatcatcgcacacatcgaccacggcaagtcgacgctctccgatcgcatcctcgaactcaccggcgcggtggacgcccgcaacatgcgcgagcagttcctcgactccctcgagatcgagcgcgagcgtggcatcacgatcaaggctcagaacgtgcgagttcgatggggtggaaccaccatccatctgatcgacacgcccggccacgtcgacttcggctacgaggtgtcgcgttcgctcgccgcctgcgagggggtcgtgctgctcgtggacgcctcgcaaggcatcgaggcacagacgctccacaactgctaccttgcccttgagcacgacctcaccatcgtcgccgccctcaacaagatcgacctgcccgcagccgaccccgatcgaacggccctcgagatcgagacggtgctcggcattcccgcctccgagatcctgcgcatctccgccaagaccggcgaaggcgtccctgcgctcctcgacgccgtcgtggagcgcgtcccagcaccgacgggggacccggatgccccgcttgccgccctcatcttcgactcggtctacgaccaatatcgaggggtcgtcagctcgttgcgggtcgtcaacggcaccgcgcgcgcgggcgcccagattcgcctcatgcaggccggcaccgtgcacaccgccgaggagatcggggtgcggctgcccgcctcgacaccggtcgccgatctcgggccgggcgaggtcggctacctgatcgctgggatcaaggacgtcggcgaggcacgctcgggcgagacggtgacccaggcggatcgtccagccgatgcacccctgccgggctacgagcatcccaagccgatggtgttctgtggtctctacccggtcgacggcgacgacttcgaggacctgcgcgactccctcgagaaactccggctcaacgacgcgagcttcacctacgagccggagacctcggccgctctcggcttcggctttcgctgtggcttcctcggcctcttgcacatggagatcgtgcgagagcggctcgaacgcgagttcgggctcagcctcatcgcaaccgcgcccagcgtgaactaccgcatcaccttgacctccgctacgacgatcgagatcgcaagccccgcagccatgccgccaccgaaccaggtcgctgagatcgccgagccgatgctgcgcatctcgatcatctctcccagcgagtacatcggcacgctcatggatctcgcgtcgacgcgtcgagggtcgctcgtcacgatgacgtacctctctcccgagcgcgtcgagctcatctaccgcattccgctcgccgaggtcgtgatcgacttctacgaccagttgaagagccggacgcgcggctatgcctccctcgactacgagcccgacggctaccaggtcgccgacctcgtcaagctggacatcctcatcaaccaagagcccgtcgacgccttcaccgcgatcgtccaccgcgaccacgcctacgactacggtcgccagctggtgacccgcctccgcgagctcatcccccgtcagctgtttgacgtcccgatccaagcagcgattgggtcgcgcatcatcgcccgcgagacggtcaaggctcgtcgcaaggacgtactcgccaagtgctacgggggtgacatcacgcgcaagcgcaaactcctcgagaagcagaaggaaggaaagaagcgcatgaagcagatcggccgcgtcgaggtaccccaagaggccttcatctccgccctgcgcatcgaccgctaaggcgacacccttcgcccaggtgcgcgagcgtcgctgcatgaggaggggcacgcgcaccatcgccatcgccgcggtcgtcgtgctcgtcggtggagggaccgcattggccatcggcgtgcggagcagccctcccacggtgccccggtcgcgctcccatccctcggcgagcaccgcggcggcgcggacgactcagggggtagcgatcactggcgcgccgacaccggaccacgtctcgacggtgcaagacgtcatctgttcgggggcgacctgcgtcgccgtcggcagctcaccctccggcgaccccctcatgtggtggtcgagcgacggcggcgccaccttccagcccagcgaggccacaatccccgccgacgtcaccctcaacggcgtcacgtgccaagaacagacctgcgtcgcgaccggcctcgcgagcgccccgccccccgcggggacgccggtggcgttcgcctcgaccgatggggggcgctccttcacacccaccacgctgcccgagggcgcgggaggggacgggctcgcctgctcgcgctccctctgcgtgctcgccgagctaccgctcgggacgggcggcgtggggtcagtcctcgtcgcgtcgcatcccctcggaccctggacgcagctctacctgtcgttcgcccctgccgcatcacccacagcaccgaccacgaacatcctgcggtcgagcggcctcgccgcctgtgccgaggacggcccctgcctcgtcgccaacgaggtcaccacgatcatggcccttcgtacgtccccaccgtgtggacactgactggaccacgttcggcacgcgtcgtcgtcgcgacaccctctgccccgctcggcggtggagggctctggtcagggatcacgacctgcgcgatcctcgcgcctcgctcgggcaccacgtactccctcgtcgtcgcgacgacgagggcgagcacgcgcgacgtcgtcaccgatccctcgggatccgcatcctcggaccaggacccattcctcgatccccgcgtcctcacctgcatcaatcgctcctgcatcatcgcatccccgtcgaagttcgcgcccgcagccctgtgggccgagcgcgacgggcgtctcacgaggcttcctaactccctccccgcctggatccagctcggcctctccgggaccgccgagccctcgcgaggcacgctcctcgtccccgcaccggcccacgacggctccatggacgcgacgctcctgcgactctcggtctcgccgacgggcgtcacgcccaagggattcgtcacgctccctccgtcgtagtgggtcagcgtgctgtcgcgccgtacgaagccgagccaaccacgacgaggaccgcggctcacaatgcctcgatgccgatcacacccgcatgaaccgccagccccgaagcaggcatgcacggtgacggtacgcgaggaccgaagctcgccacctctccccgtcatgccgaagcgagcacctcgatcgcaccaccccaacgacgctcgccgccgcgtgtgaccacgtaccaccccaccccggggatggccgagagcgccgccgcgagcgcctcacctgcgacgaggagggccgtcgccaaaccgtcggcgagccacagggtgggcgcgcacacggtggcttggctgagcgcgagctgacccccgggggcacgcacgtgatcgcctcgctccagcgtgccggacgttgcgacgccgccatcttcgacccgaagcacggccacgagggcacctcggacctggggatgtgccaccccgacccgatgatccccgcggagccagacgtccccgcctgccgccaccgaaactcgtgcaccgggcgcgagatcggcgaacgcctcgagcgcggcacgctcgacgatccaccccttggccacgccgtcgagatcgaggccgagcgggccgtggggatcgaacgcaccgtgagtgagcacccgaaggacctcagcgagtgcctcgacctcgcgcagcgccggatcgtcgaccacctcgccgcggcgccgccgtaggagtgccgagtcgtcccgccaggccgacagggatcgctcgagtgcctcgacacgggcgacgagccgctcgcaccgactctccgccgatccatcctccacgccttcgatggcgacgctcacgaccgttcccatcgcctcgaaggtgacctggctcacgtccgagcgcgctcccggtcgagcgcagcctgcaccgaggtcgcgtaggcctccgaggtgtaggtcgcgccggtgacgacctcgatcgggaggccttgtgccgcgagcacctcgtggtcgaggatgccgacggccgcttgctcaagcgcggctgagtagctatcggcggcgacgaagtggatcacttgaatcgattcgagccggtgccgtgcgaacgtcacggcggtctggagttcgccgtagccgtagttgatggtggcgccatcgaccgtggtgggagcgacgggcgcatacgtcgcaacggcgcggtgggccttcgtcgacgacgacgccgtgtgagcggcggcagaggagccgaagacgtcggccgcgagcgcatggagcgatcggagtccaccaccggcaccgacgacgatggcaaagctcgcgaccgccgaggtcaccgagagcgcagctcgccgcatcgcacctcctcagatcgtgtaggggtcaccatggatggcccgtcgcctcgcaccacgctggagtgccaccgcaccgacggcggtgacgaaggcaggcggccccgcgatccacacgtcggcgctccgcagctcgcccaccccctcgaagatggcagacaaaggcacctcgcgtcgcgagcccaccagcacccgcacgctgccgtggcgctcggccaccaacctgcggatctcgtcgccgagcacgagatccgcctcgtcgctcacgcgcacgatgacctgggggcgtgccgctgcatcgaggtcagccaacagggcgagggtcgccgtctgacccgcgcccccggcgacgaggatggcgcgtcgctcgctgcgctcggcgacggtgaacgacccgtagggaccctcgatcctgacacggctcccgaggcccacgttggcgaggtcgtcggtgaagtccccgatccgacgcgcaacgaggcgaagcccaccgggctcacgcccgtgaaggaccgtgaagggatgggcctcgagacgacgcccgggcacatcgagcctccagaggcagtactgaccgccacggaacgagagcggcctcgcgacggcgacctcgacctcgacgtagcgaccgtctccgagggtgcgcacacctgcgactcgcaggtcgagcgcgcgcgagaggcgccacggcttgatgagtcgaaacacgatcacgccgagcgccgcgaggacccacgcaacgatccagacggcacgggccaggggatggcggatgaaggtgggtccgagcgcaagttcgtgggcgacggcgagcacgagcgcgccatagagcgcgagatgcaccgcccaccagcgctctcgggggatccgagagcgcacccacggcacggagatcgcaccgaccacgacgagcaccacggcggcgatggtggcctcgacgaggcccacggacgaggtcaccacctggcccgtcgctccgaagaacgacgtgtgggtcgcgaccgcggccgcaccgatcgcgaggatgacgtgggctgtgatgagtccgatcgcccacggcgccacctggcggtgccagcgcatgacccgaggctgcccgatggcctggtcgagccatggcatccgcgacgcgagcaccaccatgatccaggcgagaaccgaccccacgagtccggtcagcgtggacgctgcaagcagcgaccctccaggggcgtgcacctccgcgagggtcccatcgaccaccggggccgcaagggcgacgccgacggccacaccaaagacgacggcaagcacgtcagcgccggcacgccgaggacgctcacttgcccaggtcgacgactccaccgcagcgctcacgcccacctccttgctgaggagcctacgggcgcgcggctcgcgatggctcgccggcgacggcgagcgatgctgggctagcctcagctccgtgcgcgtgctctggctccgaggcgacctacgctcctacgaccacgccggctggtctgagctcggcatcggcgacgcagcggtcttcgtcctcgacccgggccttgcccgacatgcgtcgcccattcgccgcgcatggctcgccggtgcgctcggcgagatcgacgactggaccgaccaccgactctcgctcctccacgcgcgccacggcgacgagctcgctgcgatctttgccgcgtggggcgcgacggaggtcctcacccatcaaggcgtcgcgccggggatccgccgtcggatcgacgccacccgccgctcgcttgaggcacggggaatcgcactgcgcgtcgtcgacagcgcctacgccgttgcgcccgggtccctgacgcgacccgagggtggcgcctggagggtcttcggcgccttctggcgccagtggcgcccggccgtccacggcctcggccccttcgaggcgaccgcaccgccttcgctcgcggtgaccgagcgccacttcgaacccgccgacctgcgaccccccgatcagccgctgctcaccccgcaacgcacggccctcgagcggctcgagcgcttcgtcgactcgcgacttgcgcactatgccgccgaccgcgaccgacccgccgtggcagccaccagcgagctctctcctgcccttcacatcggcgcgatccatccgcgcaccatcctcgccgccctcggcgacctcgatcgcgcggaccggttcgtccgcgaactcgcctggcgcgagttctacgcgcacgcgctgtggcaccatcccgacctcgtcgatctcgagctggacccgaccctgcgccagatcgcctgggacgagggcgacgaggccgacgctcgattccgggcctggtgcgacggtcgcaccgggttccccatcgtcgacgccgggatgcgcgaactcgccgccaccggctggctccacaaccgcgtccgcatgatcgtcgcctcgctcctggtcaaggacctccacctcgactggcgtcgaggggcggcgtggttcgaagccacgctcgccgacgcggacatcgcttccaatcgtggcaattggcagtgggtggccggcaccggtctcgacgcagctccctacttccgcgtcttcaacccgacactccagggcaagaagttcgaccccgacggccactacgtccgccggtgggtccccgagctccgtgcgtgcccgaccagcctcatccacgagccgtggcgctgggtgggacgagagaacgcgggctaccccctccctatcgtcgaccacgaccgggagcgacgcgaggccctggcgcgctacgacgctgcgcgcgcctcggcaccaggctcgccgcgcgcgcgacgagcaacctgagggtcgtctcgtcgggggcaacggagtcacctcgaagatcgcgtgcagcggtggcgacgagacgcacgagccgacccgcgcgctctggaccgatggcggcagcgagctcgcccagcgctcgcgcggcaaagtctgggcgcggtcgcaggcctgcttcccgcagcgctgcgttcacgccagcaccgtcgcgcgcgcccgtccccgcaaccgcgaagagctcgagaacacgccgctcgatgagcgtgagcagcagcaccgtgggcatctgcgcagcgagcatggcgtcgaggacctcgagcgctcgcgggagatcgccagcctcgatcgcgtcggtgagctcccagggcggacgggcgccgacctcgagcgcgaccgcacccagcgcctcctcgtcgacgcgaccgccctcaccaacgaccccgacgagcgaacgggcgatggatccggctcgcgagacctcctctccgagcgcccaggcgagctgatcgacgaccgctggttctgcactcagaccgacctcacgaaaggcgtcctcgatcgccgcacgccttcgatcactgcgcaggcggcgccgatcttcgacgtggttgtcgacgtgcgcgacgaccgacttcgccggctcccccacgacgacgaagacgacttcgttgggtccaggagcctcgctcgcggccttcacgagctctccggcctcgcgtgccgcgagcgcgccaagcccggtgacgacgatgcgccgacgatcggcgaacatcggcagctgcgagaacgacgttgcgagctcatggacggctgccgcatcgaccatggcgtgcaggaactccacctctgccgccacgccgcgctcgcgttcgacgacccgctggacttcgacctcgtcatcgcaggccacgaggcgaacggaggccatcgctaggcgctcgccgagatcgccgccaatgtgtcgagcgcacgacgcgctccacgcacgtcgtgcatccggaacaggcgcgcgccccgtaggtaggcgatcgcggctgcagcgatggacgcctcgcgtcgctccccgacctcgagcccaagtgtctcgccgacgaagcccttgttcgaggtggcgaccagcaccggatagccgagctcgacgaggcgatcggtggcggcgaggagggcgagcgactgcgacgtggtcttgccgaggtcgaaaccagcgtcgaggatcacctgggatgggccgaggcccgcggcgagcgcccgctccgcccgctcggcaaggaacccaacgaccgtctcgacgagatcgtcgtagtgcggatcggggtcgtcgacgcgtggggcgagacgaatgtgagtcgcgacgacggcggcatcgcccgccgcagcgacttcgagataggcagggtcgccaaagccagagatgtcgttgccgatgtgggcgcccgcctcgagtgacgcccggagcacctcactgtgccacgtgtcgacggagatggtcacgtcaaaacgacgagccacggcctccaccgcaggtaccacccgatcgagttcctcggagaggctcacctcggggccagcgcccgccttgactccaccgatgtccacgatgtccgccccggcctcgacgagcccctccacgtgggcgaggaagcgatcgaaggcgaagtaggacccgtggtcgaagaacgagtcaggggtgcgattggcgatccccatcacgaggggacggctcgcatcgagcacgcgaccgcgtgccacgagcgacggcgccggggcgacggtcatgcctagaacagcgctgaggtcagtcgccggcgccaggtcgagacccgtgggtccccctccggcaagagccggagcaggtcgaggaactcctggcgcgcctcctcgtcgcccttcacacgcccgagcaggtcttcgaggcgcgactcgatggtcgcctcgtcgagggcagcctcgccacgagccgcgagacgcgcccgagccttgagcgcagcgatcggctcggtatcggggaagcgcgcgaggatcgcttcggcctcctcgagctcgccgcggacgagcagcagctccacgagtccgaccgcagcacgctcgttcccgggctcgagctcgagcgcctgacgcagcgagggttcggtaccctcggcgatcagcacgtcgacgaccgtttcggccggggcgagcttcgtcacgaagtcgcgcacggcctgctccggataggcgccgacgaaggagtccacgaccttgccgtcacggatggcgaacaccgccggaatgccctgcacgcgaaaggcctgcgcgatcccggggttctcgtcgacgttgaccttggcgagcaccactcgcccctcggtctcggccaccaccttctcgatgatcgggctcagcgtgcgacacgggccacaccagggcgcccacaggtcgacgaccacaggccgctccttcgacgcctcgagcacgtcgcgttcgaacgtcgcatcggtgacatccatgcactccagtctaggagccacgcccagagggctcgtgagcccaagccctcggcacgaatggcctaggctaccggcatggaacagcgcatgttgggccgcaccggccacgcgtccagcgtggcgatcctcggatgctgcgccttcggcgacggcgacgtcgacgccaccggccactccctcgaggccgcactcgccgctggcgtcaaccacctcgacatcgcaccgtcgtatgggcaggcggaactcgccgtcggggcacacctcccctcgttccgcgaccaggtcttcctcgccgccaagaccatggagcgcaccgccgacggcgcgcgccgcgaactcgagcgcacgctcgagcgcctacgcaccgaccacctcgacctctaccagttccacgccgtgaccagcgacgaggagctcgaccagatcacggctcctggcggggcgctcgagacgttcctcgccgcgcgcgacgagggcacgacgcgcttcctcggcatcaccggccacttcctcgacgccccacgcgtcttccgacgtgccctcgatcgcatgcccctggacaccgtcatgctgcccctcggcatcgcacacttcgtcgacccggcctatcgccgcgacgccgaggccctcctcgaggcggcaaccgagcgcggcgtcggggtcatggccatcaaggcgctcgcacgccgcccgtggcccaagtccacccacgcctacgagacctggtacgagccgttggacgagccctcgcgcgtgcaggtcgccgtcgacttcaccctcagcttgccggtcaccgggttcgcgaccccgtgtgaccgacgcctgctgtccctggcgctgcgtgccgccgaggcctcccagcccctcgacgaggccgagcgggaggcggtcctactcagccaggatctcgcgccgctcggacgggatgcgggcctgtgagcacgacgagccgtcacgtcgagctgcgcgggccgagcgacgcgccggccatcgtcctcttgccctccctcggcacgcaggccgccctctgggacctggtggcgaccgtgctcgaggagcggtggcgcctcgtgctcatcgagcacccggggcatcgacccggcgccggcccgacgccggtcgcggcctcggtggaggcctacggccgcgaggtgctcgaggttctcgacgcactcgggatcgaacgcgcccacgtcgtcggggtctcgatcggtggcgccatcgccctcgccctcgcacgtgaccaccccgaacgcatccggcgcctcggcgtggtcggcgcaccgcgccgcttcggctcggccgaggcctggcacgagcgcgcagctgccgtccgcgccaacggcacagcgagtctcgtcgacggtctgctcgagcgctgggtgccaacgggctggtcggatgccaatccgagcgagcgtgaccaggtcgccgactgggtccgcgcgtgcgacgacgaggcctacgcacgccactgcgaggcgctcgccaagttcttgttcgcccccgaccgtaccgtcgaaacgcccacccttctcgtgacggggcgcgacgatccggtcgcaccgcccgcagccgtgctcgatctcgcggcctcgttcgccgccgccacggtggtcgtgctcgggcgatcacgacacctgccgtgcctgagtgagcctcgcgccctggcgaccctcctcgacgaccacctgagcggccggctcgacgactaggtcgccagagggtgcctcagcgcggcacgcaacctctcgcggccaagtccgaggtcgccgcgcaccaatgggcggttcggctcggcgaggagcggccgcagcaacgcccgcgcctcggccctcgcgaccgcctcgaagccaagcaaggctaggtgggccgtcatccactgtccatcgatgacgccgtagcccgcgtccttggcagcgacgacgagccccaggaacgccactttcgatgcgttcggcaccagcgagaccatggactcaccgacgaagcagcgtccgagcccgagtccgaacaagccgccgacgagacgacctcccagccagcactcgaccgagtgcgcgaggcctcgtgcgtgcagctcgcggtagaagcgccgaaaggtggcgtcgatccacgcacctggtcgagccggatccgcgcacgcctcgagcacggcatcgaaggcggtgtcgatgcgcacggatgcccgatcgacctcgcggagcaccgagcggtgggcaatgcgcgagagatctccctcgaggcgaagaagcgcgcgccacctgggctcgaaccagccgagcaccccttcgtccagccacatgggaaaccgagcgttgcggtagccctcgaggaccctgtccggttcgaagccgaactggacgtccacgaggtcgtcctcgtggggcccgaccacctcggcgagcgtcggcacgcgccctcgctcaggcgaggccgggcccgtcgtcgcgagcgaccaggcgacggaccgacacgggcaccgcgacaccgaacgcgagatccggggcgggctccgcccagcgcgtcggcgccccgacgtggatcacccctgcccatgcgttgcccgtgaggtcatcgggctcgtcgctcggccaaccagcggacaccttgagcgaccactccacgatcggcacgcggagcaccatggtggcgaggagctctcgacggaggggacgacgaacttccgccgttcgaccggggaggagcttgtcggtgatccgatcgagcgcgcgctctcgctccttgccctcgagcaccgtccccgtaccgaagagcaccgcggaacggtagcgaaggctcgagtggaacgcactgcgcgccacgatgagcccgtcgaggtgcgcgacactgatcgcgagcgccccgcccgccttggcatgtcgcatccaccccgacccgaccgacccgtggagcacgagcgcgtcaccgtcgcgagcgaacgccgtcggcaccacgaccggtccgtggtcgcgaacgacggcaacgtgtgcgatcagctcctcgtcgaggagctgatcgagggcggctcgatcgtcggagcgccgatcgcgttcacgggtgaggtcggtacgcaccacgcgctcacgctaccaaggtgcggccagaacgcagcgagactcaaccagccgtcgtcggctcgcccgagggcccgcgctgtccgtcggcgcgctcggcaaccgtgccatggtcgatgacgagcctgcgccgagcgcgaccggcgacggtcgagtcgtgcgtcaccacgatcagcgtgatccctcgatcccgccacaggccctccaagagcgcgacgatgtcgtcgcgcgtctgctcgtcgaggttgccggtcggctcgtcagcgagcagcacctcggggtccttgacaagcgcacgcgcgatcgccacgcgctgctgttggccacccgagagctccgtaggcaggtgctgagcccgatcagcgagtcccagctcttcgagtacccgtgctgcccgcttgtgccgttcctcggtctcgacgtgcagcggcacgagcgccgtctcgacgttctcctgcgccgtcagtgtcggtatgaggttgaaggtctggaagacgaacccgagcgcggtagcgcggagctcggcaagctcggcttcgccgaggtgcgcgagatcgcggccctcgaagcgcaactcaccggcgtctggccgatcgagtgctcccagcagcgtcaagagcgtggtcttgccctggccggtcgggccctgaatggccacgaactccccgcgctcgatcacgagatcgacaccgtcgagtgcgttgacgacggcgccgtggcgtcgaaacgacttacgaacaccacgtagctcgtacagcggctccatgtctcgaatctgtccttcggtcatgctcgactccttctcgtcctgacgcacgcttactgcacactccgaagcgcgtccgccggccggagcgaggaagctcgccaggcaccaaggccaccggccaccagcccgccgatgatggccaggccgaccgcaagtgcaatggtgtcagcctgcaagggggcactcagatgcacgaggacggttcgtacgcccgctgcctggcgcagcccagctcgcacacccgcgaagccgccgccgaagccaccaccgccaaaaccaccaccgaaggccaccgatcgaccgacggtcgctcgaagtgtcggtgacgccgccgagagagcttcggccccagcgatgccgagaacaaggccagcgatgccgccaccgacgccaaggacgagtccttcgctcatgacctgggcaacgatccggcgcgttcgccacccaatcgccttcaaggtgccgaactcacgggtgcgcctcgacacggcagccatcatcaacaaccctgcgaccagcaccgccatcaccagcgccgcgacggagatccacttcccgagacttgagagcagactgctcgtactggccagcgaccccgagacgtcgctggcaagactcgccgaggtcgacaccgtcacacctgggaggatcttggccacctcgcttgcgagcgtgctgacgttgctcgcgctctgcgcgctcacgtagatcgtcgagatgttgcccgcctcgcccgagagctgctgcgcggtggcgagcggcaggaacacgtcggccgtgctcgttggcgtcgtcgcgatgccgatgaccttcaccgacgcgcctccgacgtcgagggtcgagccgacggagagctgctgggacgtcgcatacccgctgctcacgatggcgacgtccttggtggcgtccgccgcggtgaagtacgcgcccttcgtgacctcggaaggagtgagagggccgacgccgctcgacgagatctggactccatccacgctgaaggagttgatactgaacgaaccgccgccaccactgccaaaggtcggaacagtccccgagaacgacgtgtccgtgagctggagaccgccggtcgcacccgcgacgccgcgcaaccgagcaaccttcgagacgtcagcggccggcaacgcggcctgaccacgagtcagatgcaatcggttacctgcgagacgcgcactcctcgcagctcgggggttgaaggctcccgatccaaagccaaagcgctcacccccgaagctcccgggcgttgcggtcttcgagacgatcatgtccgtaccgacgccgtacaagctgtggagcacctcgccatcggccgaacgcacgccagccgttgcagccgagaccgtcacaacgaggccgattcctacagcaagcccggccgacacgaggacggcctgtcgactgcgccgacgcagttcacgcctcacgtaggttgtgatcatcgagagctcctcgtaaccaagcgatcggtgtcaatgctgctggagcgtacggagcatggttggggcacgtctgaggaactggtgtgagcaggcttccgcttcgccggatgccgtgacacatcgctcacatctgcaacgaatcgccctcgaagcccccacgacgacccgttggcgtggcaaaggcccatttcgacgcccggttgcgcccggggattggtggagtggacagtgcccttcccccattcgaggttgacacctgcttgaggaggaagggatgagtcagacaccacgcctacccccggccgccgggaccgaatgacaacacgcagccgcgatcacctcccaccgagcggtgtcactgcactgcctggctggcctcagcccaccacgcaaggctcttcctcggcgggcgaggccagcacgcgagcagcgcggaggggccgagacgtcttcgaggtgcccgccgtgtgtcgtcactcgtggcagtttcgagctcgaccatggactcctctgacaggtcgtgtggctcgaagacgccccatgtgccgtgctggccgagcacgacagcggtgatgaggcgcacgaagccacttcgcgcccgaagaccccgacacgtggtgcgccgctcgatctcatgatgggcccgaccagagcgggttcgtgacgagatcgtgcgcgaggagctctcgggaagctgtgcagacctcctctgtggcctcggcgaccatggcgcgagccgctgggagcctcgtgggtaagcgagtcgatgacctcgtcgtactgggtcgggagtgctgccggggaggcttcgagcaaagatcgtgcggatcttgagccaggaccatctccgtagctccccttctgcgatgcgagcgagcacgtcgcgcatgctgcacgcagcagcgctcacgagttcgcccgacgaaggagctggcgatggcttggtgagcccgccctcgcccatcggagttgcacaggtgcacaccaccgagacacacgatcgctgggctccctcgagcactcgccccgcaaactctcgctctgcccatcgccgacacagcacttccgaagacctcgcacaccccggcgctgtggatgcccgtgatggccacccggatactagagatgacctggtgctcgaggcggcccatgacgccaggtggcatgggcgaagggggagcagaactcgagcgatggcccagcctgtggtgatggaaccttgccatctcctcgtcgagggatgcgacgatgcgggagacctcgccctttgcgatctccgtccgaccgcaggccgcgatgaggtcatcgacgcttcgggtgctgagcccccgagacgttggcctccagaaccacgcacgtgagagagcacgatcgacccggcggcggcgctcgccgatggctgggacgagctccccacacggagctgtgcggattgcggagctccacgtgccgcccttggtgacgagcagacggtcgcgctaaccgttgcgcttcgcgtctggcgtctctcgcctcgttcgtctcggcaagcgccgatgaccgctgctgtctcttccccgatgagggcttggaggatgagctggccccctctcgggagaagtcgatgtctccgcctgctctgatggcgccagggcacgccgggagcgtcggagggggtcagggccacctgagtggctcctctggccatctgttgtctgacacgccagagatcgctcagtggcccgccctcctcgcgtgcaggccgcccggcaatgacaccacgtggtgggatggcactgcgtccagcgcgtcgagcgcgatcctcgcgagcgggatcgaacggcggctccgctgcgtcttgacggcccctcgatgatgtgagaacctgcgacgtggcgcgaagtgcggacgtggagcgtgtcgccctcgacgtcccccagcgcagcccgagcagttcagctcggcgtagtcccgtcacgagcgcgagcacgaacaggtttccgagccgttcggacttcgcctcagcgaggaacctggctacctgctcgggggacagcgggggcagctcgacgcgaggcgcagagcgaatgggttccaccccttgcgtcggatcgttcgcgaggagccctcttgccatgccccagcgcgcagcttggccgagcacgtccctgaagagcttcagggtgcgcggggagaggttggggttgtgcgcgaggagcttttcgacgtggcggaagttcagcccgtcgagcctcacgtggccgatgatgggtgagatcgcgcccacggcgtagggatactgcgcaagcgttgcctcgcgaacgttgcgggaagcgagccaggcatcgagcaagtcggcaaccgtcttgatgcctcgctcgggggcaagcatgcgatcccgctcggctcggaacgcagcgagggtggcttcagcttcgtagcaagtgtcgcagagcttcgaccggtacacctggcggccgtcgagcgtggagcacaacgccgctcggtgcttcccatacgcgggtgtgatggtcccgtaccctcgcgtccgtcgccgtgccatgtcgtccgacgtcgcacgctcgagacgataggtcgcacgataagggcaaaaataaagcccccgagcctctgcactcggtcgtatatggcctctgagctgggcttttggagtggaggtgatgggactcgaacccacgaacctcttgactgccagtcaagcgctctaccagctgagctacacccccgtgctgtcggtagtgtagtgggtggcgtcatgccgctcgtcgatggcccgctgccggtgacggttgctgtcgtggccagcagggcgactgcgatgggggaggcgatggatctctgggtggcgaacacggatcgaaggtggttcgactttctgcgccaggcgggactcgaggaggtgaacttctggtcaccctcaccgtcccctccgagttcggcgatcgcggtcggaaccccgtggatcttccgcctgaagaagcctgattacgcacttgccggattcggatacttcgctcgcttcgagcaactttcggccaggttggcatgggatcggttcggacagggaaacggtttcgcctcgttcgaggagttcctcgatcaggtcgtacggctccgacgcctgctgaggacttcgtatcccgatcgcgacaccaagatcggctgcacgacgctcgtcggcgcctgcttcctcgaggaggatcgttggcttgcgccagtccctgggttcgagcccaatgtcgtgaggggcaagggttactacgtcaactccagtgaaggtgatgcgatctccgaatggctcgcccaacagcaggcggctgcagcactgccggagtcggttgccgcactgcccgtggctgggtacagggaggcgctgactcgcgtgcggctgggtcagtatggcttccaggcgctcgtgcgctcggcttacggggggcgctgcgccatcaccggagaatcgaccgctatcgcgctggaggccgcccacatcgttcccttcgcgctcgagcagcgccacgacgtgcggaatgggttgttgctccgagccgacttccaccgactcttcgacgccgggctcatcggggtggatcccagcgaatggacggttcgcgttagccctgcgatcgcggacccggacgagaatggccagctctacccgacctaccaaggacaactggccttcccccctccaggttgacacctgctataggaggaagggatgagccagacaccgaacccaccaccgggcgacggccccgctggacgacgacgcggccgctacccgagccagttccgcaaggacgcggcagcgttggttctcgaccagcgccgcaccatcgctgacgtcgcccgtgagcttggcatcaacgagcagacccttggtaactgggtccgtcaggaacgcatcgaccgaggtgagcgagagggcctgacgagcgccgagcgcgaggagctgacacggctgcgccgccaggtcaagcagctcaccgtggaacgcgagctgctcaagcgagcgatggccttctgggtgaaggaggggggacagtgagccgctaccactggatctcccgccaggaggccaagggcttctctgtagcggcagcagcacgagtcatcggggtctctcgccaggcctactacgcctggcgacaccgtcgggaccgaggcgaggatcccgagcacctggtgctcgcgagcgagcttcgcgccatctggcacgagagcgacggcacctacggcagcccccgcatcacccacgagctgcgacggcgcgggttctgcgtgaaccacaagcgggtggaacgcctgatgcgcgagctcgagatggcagcgggcccacgccggcgcttcgtagtcacgacgaggcggggagaggacgcagcgctcccggacctcgtccgtcaggacttcgctcctggtgagccgaagcgcaggtatgtgagcgacatcacctacgtccgcaccgatgaggggttctgctatctcgccacggtggcagatcttggctcgaggcgcatcgtgggctggtcacttgggcgtcacatgcccgatgacctggtggtcgaggcgatccgcgaagcactcgggactcggggcagcctggctggggcgatctttcacagcgatcgcggcagccagtacctctcccggaaggtacggagcctgctcgcgacccttggcattcgccagtcggtggggagggtcgcgacctgctacgacaacgccgtggccgagtccttcttcgggagcttgaagcgcgagctggtggctcgctaccgcttcgcgaacctctcaggggctcgctctgccatcgctagctggattcaccgttacaacacggtccgcctgcactcaagcctcgggtacctaccgcccgtcgagtacgagctctcctgggcctgccgggaggtggccgtggcctaaattcagactgtcaagcaaatggggggaagcccaaacctctgaaagtcgttcctcgcgaccggcagtaccagcctgacccggagcgactccgctggcacctctcgcacgtcttcaagggctagcggccctccccgagactcagggccgagatagacgcctcctgcgacacttcgacgcggacggtcgacttcatgtggccttcccccatttgcttagcagtctgaatgtaggccgcggccacctcctcgcatgcccaggagagctcgtactcgacgggcggtaggtacccgaggctcgagtgcagccggaccgtgttgtgacggtggatgtaggcagcgatggctgagcgagcctcagcggattcaacgacatctacggcctcatccaggccgtggaggacggcgcgacggtgcgggtctactacgaggcgaggcttgcgaaggtcgagctgcccgacgaagcacggggagcgctcgatgcggagttcgacgaggtcgccgaggcaatggagacggagtccagggagcgtctcaagacccgttgggcgcgcatcgaggccatcgtgggcgccgagaagcgcatcgccgccgtcgcggccgacatcgtcgagcactgggagaagcgccgcgccgccttgaccggcaagggactcatcgtgtgggcttccccccatttgcttgacagtctgaatttaggccacggccgcctcctcccgggcccaggtgagctcgtactcgattggcggtcggtacccgaggctcgagtgcagccggacggtgttgtagcgatggatccaggctgcgatggctgagcgggcctcggcgaggttcgcgaagcggtagcgagccaccagctcgcgcttcaggctcccgaagaaagactcggccacggcgttgtcgtagcaagtagccaccctgcccaccgactggcgaacgccgagggtcgcgagcaggctccgaaccttccgggagaggtactgattggcgcgatcgctgtggaagatggccccagcgaggctgccccgagtccgctgggctccctcaatcgcctcgatcacctgttttcctggcatgcgacgctggatcgaccagcccacgatgcgcctcgagccaaggtctgccaccgtggcgagggagcagaagccctcgtcggttcggacataggtgatgtcgctcacgtaccggcgcgctggctcacgaggagcgaagtcctgacagacgagatctgggagcggtgtgtcttccccacgcctcgtggtacgcacgaagcgccggggtgggcacgctgccagccccagctcgcgcatcatgcgctccacccgcttgtggttcacgcagtaaccacgtcgtcgcagctcgtgggttactctggggctgccgtaggtgctgtcgctcgcctgccagatggtgcgaagctcgctcgcgagcaccaggtgctctgggtcagggcctcggtcccgacggtgtcgccaggcgtagtaggcctggcgggagaccccgatgactcgcgctggcaccgccacgggcaagccgttggcctcctggctggcaacccagtggtagcggctcactggttgccctccttcaccgagtgggccatcgctcgctttgccagctcgcgttccatcgtgagctgcttgacctgccgacgcagccgggtcagctcctcgcgctcggcgctggtgagaccttcgcgctcgccgcggtcgatgcgttcggagcgcacccagttgccaagggtctgctcgatgaaggcgagctcgcgggcgacgtcggcgatggttcgccgctgatcgaggaccaacgctgcggcgtccttacggaactggctcgggtagcgacctcgtcgacgtcgagctggcccgtcggccggtggtgggttcggtgtctggctcatcccttcctcctatagcaggtgtcaacctggaggggggaaggccagtgtgcatgagtcgccgtatctgcgtagagctctacgaccagatcgtcaagctccgcgccgactggcatgccgacgatgacgccgccggcacgatcaaggtcgtcatcacgggttctgcctcggacggtcctgagctcaactaccacgtgcggagcaaggagcggctcgcagcactcaagcagcgcgcgaaggatcctgacgatcccctcgagctcgtcatcgtgcgcgacatgtggctcacggggttcgactcgccatcgctccacgcgatatacggcgacaagccgatgcgcggagccggtctcatgcaggccatcgctcgcgtcaaccggacctttcgcgacaagcccggagggctcgtcgtcgactacatcggcatcaccgagagcctccgggcggcccttgcggagtacaccgagcgcgatcgagctcgccaggaggtcggcgcacccatcgacgaggccctggccgttcttgaagagcaccacgaggtctgctgcgagctgctctttgggtgcccgtggcgagaggcgctcgagtccgggagcgacaaggcgcgcatcgaggcgatcatggcagctctcgaacacctcctcgccggcgctgacatggagctaccggagcgcttcctgcgccacgtccgcgcagccactcagagcttcgccattgccgtagcctctcccgaggcggcccgctaccgcggcgaccttgccttcttccaagcggtggccgtcgagctgcggcgagcgcgggctgaggagcgggcaaagagcgatgaggtcgagctcgagacggcaatccgtcaggtcgtctccgacgccgtgacggcctccggcgtcatcgacatctacgccgcctctggtttcggcctccgcaccccggctgatgtccactatgacgtgctgaggggctccgagcacgccgggccgaggcgctggaagctgcctggcgtgctcaccccgagcgcttcgtgcgcatgcggcccgaaccaccccggctccctacagccgtctggatcaacccaccggaggaggtgagcacgacgacacagtggaactgaaccggacgtgtcactcagaggttgacaggctccgagaacgccgaagggatcaccaccgagcgcctcgaggatgcgtgccaggtcgtcatcggggatcgccttaccggttgcccgctccccgcgagctggacgggacgcagccgcgacgttgcgctcgacgagccgcgaggtctccacgtaggcaagcatggctcgcaacgtggtgcgcacgaggcgaaccgacgacgtgctgagcccctcgagcgaggcgaggaacctatcgacgtcaggggtcgtgacggcggcgagctcgcgccctccgagcgcctcgacgatccgctccgtggcccatcggtactgcgcgagcgtcgaggggcgcacctcggtcgccttgagcgtgagccaggcttccgcgagctgacccagggtacggatcgtctggcgcgacgcgagcccagcttgggccgtcttgcgaagccccgcgagggcgagcacagcttcggccttggtgtcggccactcgcgagacgtagcgcaagcgcccgttcgggagacgttcggggagcgggtacctcgccatccaccgatccccgtagcggtgaaccgcgccctcacccttggccctgcgcgccttgcccgtccgcacgtgtccaggcaagttcgccaaacccatagccgcaacgatggacgcgatcttagggggttatagtggcgtgcatactgatgcacagatatctaccaggggttttgagtggaggtgatgggactcaaacccacgaacctcttgactgccatcaagcgccctaccagctgagctacacccccatgctgggtcctcatactggggcgcgcccgagtcccgcaggacgccgagcgccctcaaggcgcgccgtaggctggtgggcatggccgaggagtacgacccacccgcgctggagcgctcttggcaggagcgctgggacaacgacgagacctactacgtctccgccgacgatccgcgtcccaagtcgtacgtcctgtgcatgtatccgtacccgtcaggatctgctcatcaaggacacgtacgcaactacgccttcggcgacctcaacgtccgctaccgcaccatgcgcgggcatgcggtgctctctcccttcgggttcgactccttcggactccccgctgagaacgccgcgatcaagactggggtccaccctcgcctgttcacagaggaacggatcgctgaactcaaggcctccgtcaagcgactcggtaccgcctacgactggcgccgcgagatcaagagccatgaccccagctacatccgatggacgcagtatctgttcctgaagctctacgaagctggactcgcctaccaggccgatgcaccagtgaactggtgcccgggttgtcagaccgtgctcgccaacgagcaggtgctccccgacgggacatgcgagcgcagcggtgacgtcgtcgtcaggcgcaatctccgtcagtggttcttcgcgatcacgcgctacgccaatgagctgctcgacaccctcgacgaactggcctggccggaacgtgtcaaggtcatgcagcgcaactggatcggcagaagcgagggggccgagatcgacttcccactcgcggacgatcccacgcgctccatcacggtcttcaccacacgaccggacaccattttcggggtgacctttctcgttctcgcgcccgaacatcccctcgtcgagtcgatcacaccaccagagcgtcgcgacgaggtcgaagcgttccgagccgacgtggcgacacgctccgaactcgaacgccagagcgatgtcgcaagcctcgacaagcgcggactcgcactcggcatctcggtgcgcaaccccatcaccggtgacgaagtgcccgtcttccttgccgactacgtcctcgctcactacgggacgggcgccgtcatgggcgttcccggcgaagacgaacgcgacttccgcttcgccaccgcatacggactgccggtcgtcgaaacggtgacgcgcccgagcgaccatcccggcggcgcatggtcgggtgatggcaccaagatcaactcgggacccttcgatggcctgagcgtagcggcggccaagcgggccgtcatcgaagcgctggagcagcaaggggcgggccggagtcgaaccgtctaccgccttcgcgactggctgatttcccgtcagcgctactggggctgtccaatcccgatcgttcactgctcggcgtgtgggaccgtcccagtacccgaggaccagctacccgtcctcgctcccgacgacgtcgagttcctccccaccggcgagtcgccgcttgctcgccacgcgggcttcgtgaacaccacctgcccacaatgcggcggcccggcacgccgcgagaccgacaccatggacaccttcgtcgactcctcgtggtacttcctgcggttctgcgaccccttcagtgaagatcgcccgttcgatatcgccgcggtcgaagcgtggatgcccgtcgatcagtacatcggaggcatcgagcacgcgatcctccacctgctctacgcacgcttcttcaccaaggccctcagcgatctcggcctcatccccgcgacgcttcgagagcccttccgacagctcttcacccaaggcatgatccgcttccatggctcgaagatgtccaagtcgaagggcaacctcgtcacgccgcagcagtacttcgacaccgtcggtgccgatgcgctccggctgtatcacttcttcgtcggtccgcctgcggacgacgtcgactggaccgaccagaccgacgagatcatcgagggctgcgcccgatacctccaacgcgtctggcggctggccgagcgcattggggtcacggacacaccgacgagcgccccggtggcaaacgacctcgccatcgccatcgagcgcctcacccaacgggtcacggatgcgatcgagcgctggtcctacaacgccgcggtcgcagcgctcatggagctcgcgaacctcctcggcgacgagcgcctcctcgcccagcccgacctcgccgacttcggccttgcgcgcctcctcacgatgctggcgccgttcacaccgcacatcacagcagagctcttcgagcgccgctatgggcgcaacgtgcatcgcgagccctggccaaccgtggatcacgaactcctcgcgagcgcccggactaccctggcggtccaggtgaacggcaagctccgcggcaccatcgaggtcgacccttccatcgaggagtccgaagccatcgacctcgctcgcgccctcccgtccgtcgacgcagcgctcgcaggtcgcgagcccgagcgctgcatcgtacgactccctcgaatcgtcaacttcgtggtccgctaggagtcccctgaacaactcctccacgtagggcggctacgggaagcgcttccctccgcctgtcaagcgccatttgcccagctcagctagactttttgcatgctgggcaccgaatcagaccaggcacacctcaccgcgacggaggccttctgctcctcgctcatcgagccagggtccatctacgccttcctcgccgagcaccgcagagagctcttccccgacgagcgcttccgccatctctacccctccacgaccggcagaccctccatccccgcctcgagggtgctcgcggtcatggtgctccaggtgctcgaggggctctcggacaccgaggcgacagagcaggtccgctacaacctccgctggaagtacgcccttggtcttgatctcgaggacccaggctttcaccccacggtgctcacctactggcgcaggcgcatcgccacctccgagaccccaagactcatcggcgagctcgtggccgaggtgatcggtgccacgggggtgctcaagggcaagacgaagcgcgtcgtcgactccaccgtgctcgccgatgcggttgccacccaagacaccatgacccaacttgtcgcccagatcaaccgggtacgcaggctgatccccgaactacgcgacattcctctgtcaccagcgatcgactacacccgcgcaaagcctgccatcgactatcgggacgaagaggcagtggtgcgcacggtgagtgccctcgtcgccgatgccactgcccacctcgcccatgcagagaagctcgcatccctcaccgagccacagaccgaagcccttggtctccttgggctcgtggcgggccaagacgtggagtgtgtcgatgccaaggaaggtcgctggcgcatcgcgaggcgggtagccacagacagggtcatctccaccgtggaccctgacgctcgccacgtccacaagtcccgtgcccgtgccatcgatggctacaagggccacgtggccgtcgagccagacagtggcatcgtcaccgctgcgaccatcacgaagggcaccgtgccggacgcagcagtggcgagcgagctccttcgtgacgaggacggcccgcgcacggtctatggcgacagcgcctatgccacgagcgaggtctccaacgagctcgccgctcgtggccacgacgaggtgatcaagcctcggccccttgccatggcggtccctggtggctttaccatcgatgacttcgtcgtcgaggagggatgggtcagctgtccccaaggacaccgagtacccatctccgccaagggtcgtgcttcctttgtcaagcactgcaccggctgtccgctccgggatcgctgcacgcgctcgaagcgaggacgggtcctcaccttcacccctgccacctggcacgcaatcagccagcgggcgcactttggggaccctgccgttcgtctcgactatcagcgcacccgaccgaacgtcgagcggatccacgcacagctcaaacgcaagctctccggcgcgaggctgcgctacctggggctcgtgcgcaaccgactccacttcgagctgctctgtgccacctggaacctgaaggtgctccttcgcctggggctcacccgggtgggtggtggctgggtgcttgccacctgagaggcgctcgggtcctctcctcctcgccccacaggaggggcgaggaggagagggtgaggagcgagatgggaacgggtcagctgggctcgttcccgggctgggtgggcgtgctcagccaccaccagggaggggcttgttcagagggctcctagcgcgacccgctctgctcgtgtcgccgaggtgcactcggcttgcgttccggcgtcgatgctgcgctgcgtagacgtcatacgcgcgagcggcccgatccggaggtcatgccacgacggagctgggccgggccgagacgagcggatctccgagcgatccggcaccccgacccaccccggtggcgtgccgtcggggagcacacgaccacggcgctcaccggtctggagcgagcaggccacaccaagcgagcggcctgcctggcccgtgagccgcaggccccaccgctatactgggaggcccgcgcgcctctagctcaacggcagagcaacggactcttaatccgcaggttctgggttcgaatcccagggggcgcaccggccggttgcacgcacgagaggcgtctcgtggccgcgccacacgtgtgctgggctcagctgtgccgagatctcagctgtgccgagatctcagatgtgccgagatctcagatgtgccgagatctcagatgtgccgagatcaagtgtgcagaactcaagtgtgcagagctcggtccgcaccgtgaggcggcctcctccattcgggttccacactcccccgtcggatgtgcccgtccgctgcagtctcggcccagctccccaggcgtcaagggctcggagcgtcactcgccgtgccatcgtcagcggtcgatcacgccgtagcgagcctcacccgcaccggtcatgagtccccagtactgatccccccacgaccagtgccaccactccgtcgggtagttgacgagccccaccgccacgagcaccgagcgcagcacgctccgcatgcgtcgtgcctctcggccaatggtctcggcgtcgaagaagcatcgacctgcgctctcctccggactcgcgttcaccgccgatcccatgtccacttccgcgccgtcggctccgacgagcgtcaggtcgacagccgccccgcagcaatgcggcgggaatccgtccggaggcgctacatagcggctcgccagcagacgagtccgctcgggatctgctccccgattcgcctccaggagctctgcgtagtactcctcgaagtagcgccgctgcagctcgcgggaccggaagccttcgacgaccgcgaggcgcagtccctcgggcagtgcacgcgccgcacgcaccaggcgctccgccaatccctcgcgcacgaaccgatggttgccggtcccatcgtcgagccgatcgtcgatcacgatgagatcgcgctcgccgaggtccaccagcggctcgccgcactcactgacgggaacttgctgcaccgcctggtcgccgatcaagaccacaccaggtggcacgaggctcatcgcacccacctcgagaggacttcttcgtcgtctcccagcaccgtgtgcatcgtggccaccctcatgcgtgatcctcaggcatcggcaggtccgcgaccggcgcgcctccaagcgtgctcgcaccccgacgcgccagtgtgacgacaaccccgacgaccacgatgaccgccgtgatgatgaggtcgcccttcgactgctgactcaacgcgagcacgacgcccccgatcgcaacgacagcaggaactggccacagaggcatacggaagacgccactcgagcgccgctcgcgcaccctggcgacgagtgccgacaccgcaaccagcaggtagatcgtcacgatgatcacgccggtgaaggtgatgaggttgttgagcgacgtgaagatcgcaaggatgccgttgccgacgaagagcaccagaaacccccaagtcggaaccttggtgcgcggtgagacgtgggcaaagaagcggttcagcgccgcaagcggccacatctcgtcacgtccagaggcgtagtagatgcgcgcataggcaaggttacccgcgagaccagtatcgaacatggcgatgatcaccccgacgagcaggatcttcgcccccgtcggacccatgacgcgatcggcaatcaacgagagtggtgacgcgctctgtgccgtgtgcgccagaccgtggatggccaaggtagcagccaccaccgcggcgagttcgaagagcacgctgatgcccacggcaagcagcacggctcgaggcagggcgcgacgatccgtggtctcctcggcaaagtagagcggccagtcatagccgttgtaagcgaacagggccggaacgacggcgatcagcacggcagagagcccgaccgttccgagcacgcccttcgaaccgatcggaacgacgggatggacgagcaggcgccccgggagcgccgggtgcgcaaaggccgcgatcgcaaagacggtgatcaccgcgagctcgagcaccagcatggcggccgtcatccagctggtcggtgagattcgatcgagcgacaagagggtgatgatcgccatcatggcgaacgccgtccagttcaccggcagcgccggtgccaacgattgaagatacgtcgccgcagcaacgaggatcgacgcggtgacgacaaccccgagcacgaggaagagcacgttgaccacgccgccgccgatcgggccgagggctcggcgaacgatcgtgtaggcgccccccgcagagggaaacagcgagcctacctccgcatagcacaacgccatcgcgatggcgatgaccgcgccgatggcgaacgccgcgaccacgccggtacccgcagtcgcgataccggctccgaacaccaagaacaccgacgtcgtcggcgagatcgccgccaccgcgatggcaagcacgttcatgggacgcagtgcacctcgagccaagccctgcccgccccccgtgcgctccctcgtcatcactccccctccttcgtggcacgtgggacgatggtagcaaagcgatggcagaatggtctgacctttcgtccattgttcacgctgccgtgatctgtcaggtgccacgagggcgccgcccgatacgatgatgcgacgtgggccgagagcatcagggggcggttcctcccatcgccgacgtccggggccacctcgatctctcgcgaatcctgcgacctcagagcgcaccagaccagatcgccgatcggatcctcgccgccatcgccgtcggcattctctaccccggcgaccggttgccgcccgaacgcgagctcacctcgcgcctcggcgtctcgcgggccacgctgcgcgaagccatcggccgcctcgccgccttcggtgttctcgagacccgacgagggcgcgggggcgggaccttcgtgactggcgtgcatcgcgagagcgaggaacgcgcagcgctcgaacgagccctcgcgccgatcaagtcaacgctcgaggcactcctcgattaccgcaacgtcgtcgagcaggcgctggcccgtgccgctgccgagcggcgcaccgatgacgatgtggctgcgatgcgcagcgccctcgccgcgtacgaggacgcagcgagcgcccaggcttctcgcgcagccgatcgcgcgctgcacgaggccatcgctcgagcgacccacaaccctctcctcgaacgcgccaacgcagaactgttcgaggggacgaacctgggctttgactcccatccgtactcgccacagctccatgcgaaggctcgccagcaacatcgcgccatcgtggacgcgatcgcacgacgcgacgtcatcgcggcgggcaccctgacacacgagcacttcctcgtgaccggaacgtacccgctcatcgatccggacgagcccgatcacaccgctgcgcgagcctcgacggcctgaggcgctcacctcggggcgcggccaaccccacgctcgcgcgacagccttcccgcgcggcaccgccagcacgggccgtcacgaaggccaacgcgcaccgatcgccccgcgccaacgcgcgcgcgtcacggacacgaccgcgatcgcgcccgagcgcgacgaaggccggctcacccgatggcggcagcgctcgcgggatcgaagaagtagaggcgctcaggatcgatgccgatcccgacctgctgaccgctcttcaccgactggtcggcatcgatcctcgcaatggcctccgcccctccaccgacgagacccgccgcgggttcgagatcttcctcgtcgacctcgaggcgatagggggtcgcgtctacccgaacgtgcacgagctgttcgttcccgagctcctcgaccagctcgaccgttgccgcgagtgagttcggctcgccgacgctgccgaaacggccgagcgcgtcgggtcgcaccccgacgatcaccgcaccaccgacgtgcgccgcgatggccggatgggcggcgagaaaccgttcgtcgaggccgatgcgctgcgaaccgagcatgagagcgacaccgtcgtcacggacgagggatccctgaaagaggttcatcgcgggcgagccgatgaagcccgcgacgaacaggttcgccgggcgctggtagagggtttggggatccgcgtactgctggagctggccgcggtgcaagaccgcgacccgatcgcccatcgtcatcgcctccacctggtcgtgggtgacatagagcgcggcgacaccgatcctgcgctggatgcgaaggacctcggcgcgcatctggacgcgaagcttcgcatccaggttggagagcggctcgtccatgaggaacacattcggctcacgcacgatcgctcgccccatcgcgacgcgctggcgctgaccgcccgacagctgcgacggcttgcggtcgagcaacggctcgagtccgaggacatgcgcggcctcgcgcactcgccgctcacgctcgccgctcggaaccttggccagcttcagtgcgaagccgatgttctcctccaccgtcatatggggatagagcgcgtagttctggaagaccatggcgacatcgcgctccttcggcgacagatcgttgacgacccgatcgccgaagcggatggtgcccgaactcacctcctcgaggcccgccaccatgcgcagcgtcgtggtcttgccacaccccgaggggccgacgagcaccacgaactcgccgtcctcgatcgccagtgacagatcatcgaccgccacgacaccgttcgcatagcgcttcgtgacaccgtcgatcgtgatgcttgccatggaccctcctacgacgcggacgactcgtccagatcgaccacaaccacctcgctcgaggcgagctggagcgtgccccccacgcgctcgctcccgcgtcgccgagttccaacgagcacacgcccgccatccacgtcgacggtccggtcgccgtcggcaaggttgacgtagacctccgtctgcgttcctcgtcgaaagcgaaggacaccctcgggcgcatcgaggaaacgaatcccgccaacgacgaggtcctcacgtgcacgccgcgacgcgatgatcgccttcgtgcgcgcaagcaccgaggtcggatcggcgagctgctcctcgacgctcggatcgtcaccgaagggcagccacggctcgaccgagggcgccgtgaacccggcgccaggtcctggttgccatcggataggggtgcggcaagggtcgcgcgagacgttgccaccatcggcatgctggcccatggggtcgcggacgcgctcgggcggcaccgagccatcgcgcatgccaagttcgtcaccggcgtagagcaacgccgcgcccggcaggaggaggatcagggcgaccagcgcgagcgctcgctctcggtcgccatgagcccagcgggttgcgagcctggagacgtcgtgattcgaacccgtccagagcgggatcgctcccaccggcagcgcggcgatcgtcgtctcgatcacccgacgcagcgaagatgcatctggctcggacgccatgaaccccacgttcaggcacagatcgagttcgggcgcctccgccgagccgtagtagcgagcgagttcgatgggatcgaggacccaggtttcgccgagcaacacgcgggccggttcccacttggccaccagctcatgccaccgacggtagatctcgtgcacctccgggcgattggccgagtagcgcttcagcttccctgcccaggcgatccacggatgcgtgccgggaggggccggaggatcgtcgcgccccaaggcgtccttcacgagcccgtgcgccacgtcgatgcgaaacccgccgacgcctcgctccagccactcctcgaggatcgcttcgaaggcggcgcgtacctcggggttccaccagttgagatcgggctgggtcgggaggaagttgtggaggtagtactggccagaggcgggatcgagcgtccacgcggacgaccctgtggcatcgacccagttgttcggcggcccaccatcggcgcgcggctcggcgaacacgtaccacgcacgtctcgggctcgacggatcagcaagcgcctcttggaaccacggatgctgatcgctggtgtggttcggcacgagatcgatgagcacccgcagacctcctgcctcggcatcggccatgagtccccgaaaggccgcctcaccgccgagtgccgggtcgaccacgtcgtagtcggcgacgtcgtagccccagtcggtccgtgggctcggcatgatcggtgacagccagatcgcatcgaccccgagcgtccggaggtagtcgagtcgctggcgtagaccgccgaggtctccgagaccgtcgccgtcgctgtcggcaaacgaccacacgtacacctgatagagcaggcccccggcccaccagcgtcctccggcccgcgctgccgcgagcgtcgcaccaagttcgtccaccgagtccattcgcgccgatgcctcctaacccttcaccgcgccagccgtcaaccctgagaccacccacttacgaaagacgaacacgaggatcccgatcggtacgatcgccacgacagcggccgcgaagatcgtaccgaagggaatcaccgtcggcgatccgaagagcgcgatgcccaccggaatggtccgatagctgttggagctatcgaaggtgagcgccatgaggaactccgtccagcaggccgtgaaggtgaagatccctgcggtgaagacccctgggagcgcctgcggcaggatcaccgaccagacggtgcgcagcgtggatgcgccgtcgacccgggcagcctcttccatctcatgggggatgccgaggaagtagttccgcaagatccacaccgcaaagggaaggttgaacgccgtgtaggggacgatgagggcctgatagctgttcagccaattgagctggcgcagcaccagatacagcggcggcaccaccgcgatctcggggaagaccgagatcatgagcaggaccacgagcaccaccgcgaccccgcgcatgggcagccgaccgaacgcgtagcccgcgagcgtcccgagcaccagcacgagcgcggtggctcccagcgtgacgatgaccgaattgagcacgtaacgcccgaagccgtagtggacgaacgcactctggtagttcgccagcgagatcggattcgggatgtactgcgtaggcgaagccccgatgttcacgggggtcttcaacgacgatgcgagcagccagtacagcggtgccgcgatcaagaccacgacgagtgccacggtagcccaccgcccgacccgggcgaggggacgttggcgacgagcacccatcacgcctccttcgccgcgccgacttgggcgcggaagactcgcaggaacacgatgcaaccagccagcacgagcgcggtcgtcgtggtcgcaatggccgcacccggtccgaaactcacatcctcgaacatcaccttgtagccgagcagcgcgagcgacgtcgtcgacgtcccaggtcccccgccggtcagcacgaagggaaggtcgaacagcccgaaggcctggagtatacgaaacagcgtcgcgatcgcgagcgtcggccgcaggagcgggaaggtgatgcgccagaacgtcgtccagcccgaagcgccgtcgatctgggccgcctcgaagacgtcctccggcagcatcacgagacccgcgagcacgatgatcccgacgaacggcgtcgtcttccagatgtccgccaccatcatcgagatgatcgcaggagtcggcgtcccgaggaacagcggatggccaagcccgaccgcctggaacaaggcgtcggccacgccgtaagtcccctggtagatgtagccccacagctcggccgagatcaccgtgatcatcgaccagggcaggagcaagagggccatgaagagccctcggcccttcgtcaaccgcgccgccacgagtgcgatcagcgtgccgagcacgacctcgacgaagaccgtgatcacggtgtagccgaccgtgaactcgagggcgtagcgccatacggcagcgtggacgatctcgctgtagttggcgcccgtcgcgccgccgagctggaagcccgcgccggtcacgttgacgttggagagactgagcacgatggagaacacgatcgggaagaccgtgaccgcgccgatgacgacgagcgccggagcagacagccaccaccctgctcgagccaggcctcgacgagcacgatggtcgtccgaccgttgtgcgggtgcggtccgaggcgggaccgcgataccagcgaccatagaactacctccccggcggcaccgatggccgacgatcgacctcacaaacctcgacagcctggcgtcggatgcgccagcgcggatggagctcgcccgggaggcccgagcaacgggaccctcccgggcgaggagcgacgactagatgccgccagcgagcgccgtgttgatctgcgacgccgcagtcttcaaggcagcgctcgggctcatcgaccccgccagggccgcgttcacgttggtgtaaatcgccgaggacacctgcgggtagttcggcgtgcccgcgggccgcggcacgagccgcgtctcggcagccaccttgatcgggggtgcgatcgacgggtccttcgcgagcgcgagccgcaccgactcgaccgtcgggatctccgagtaggtcttgccgaggatgtcctgagcctgtgtcgaggacatccacttgatgaagaccaggtcggcggcgaggttcttcgagtgcgggttgatgtagaggttccagccgccgatgttcgagtacccgggataggactcgccctggaaggtcggcaacggggcgacacccacatcaccgacgaccttcgagtccgatggggtctgggagttggcccacgcatagtcccagttgcgcaggaaggccgcctgacccgagtcgaagaccgccatcgcctgaggctcttcgaaggtcgtgacggccgcaggcgacgcgcccgaggtgatcaagctgcgcatgaacgtgagcgcgcgcaacgccgccggcgagtcgatggtggccttcgtataggagctgttcacgacgctgccgccagcgctcgtgaggtactccatgaagtcacaggtcaacccctcgtagctgttgccctcccagacgaagccgtacttgaccgcgttgtcatggaccagcgtcacagcatcgctctcgagctgctcccaggtcttcgggaccgggagatgatacttggcgagcaggtccttgcggtagtagaggaagccctcgtcctcgaacagtggcgatccgtacaccttgcccttgtaggtcgcgccttgcacgagaccgggggcgaacttcgcccagtagctcgacggcaaatagttcgacagtgggacggcgaagccatgcgccccgaactcggccggccagatgacgtcacccatgaacacgtcgggcgtcgacgcaccaccggaaatggtgttgacgagatccgcacggttggtgtcggtgttggtgggtgcactcaccaagttgacgtgaatcttgggataggccttctcgaaggcgcggatcagcgcggcgcggattcctacctgcgcaatggggctcgcccaccaggtgatcgtgccgtgcgcactggatagattgacgccagacgtcgtcgacgaggtcgacgaggtcgtcgacgacgacccgcaggcagcgagcagcgccatcgaccctgcgagaacgacaccgacggcaccggagcgccgcagtcgccgccgactccgtgtcgtctgctggccctcggtcgccctcgcgaactcgtgtcggttggttccgtgactcatacgtatccccctgtctcactcccggcgcgcggtcgtggccgcgcgccatcctgacacgtcttcctacgtcctcgaaccgctcgtcaccgctcgacgcggcgcggtctgcacacctgcacctcctctccgattgccgttgcgatcgccccggacccgacgatccgcgctcaaccccgacgactcgtcaggcgacacctggcgtcgtactggccccgtcgttccgcgaacgatgacctcgagcggcagccatacacggccgccgtcgacgggctcgccatggagccatgcggcaagtacccctgctgcccaggcaccactcccctcgagcggctgacgaaccgtcgtgagtccgatcacctcggcgagctcgatgtcgtcgaaacccacgatggagaggtcgtcgggcacgcgcaggccgagctccgccgccgtacgaaggacccccatcgcctggacgtccgaggcaaccgagaccgccgtcggcggcgagccgctcgcgagcagcgaccgcacgctcgccgcagcttcggcgacgccgaagggaggatggcgaacccaagcacgccgcaaggtcaagcccgcctcattgaggacctgccgcacgcctcgctcgcgctccgcgctcgcagagaagcccatgccgacggccggccgatccccgacgaagccgatgcgctcgtgaccgagcgagacgaggtgcgaggcagcgagtcgtccaccgagcacgttgtcgatgacgaccgacggccaaccaggggcatcgtggtcgacgctcacgacgagtccaccgcgctcacgcagtcgcgatgaccacgcatcaggcacctcgatcgagatcgccacgatcgcgtcggcgacaccctctccgaccaggaccgcaagggcgcgttcgcgctggtgaggatcggcaacgtccacgaggacggggtcgaggccgagcggtgcgagcgccttgatgaggccacgcacacgctcgacgaccgatgcctgggtcacgccgctcaccagcacgcccacgacgttcgactcacggcgccgcagcgaacgagcggctcgactgggccgaaacccgaggtcacggatcgcgtcctcgacgtggcgacgggtgacgtcggccaccgggccggaaccgttgaccacgcgtgagaccgtcgcgatgccaacgcccgcctgacgggcgacatcgcgaatggtcacgcgatgattccgcgccccgagacgcccaccgcgagcggtggaaccgtttccacgcacacccagattgtgcgtcgcagccatcgcgccgtcaaggaattgcctggctccgcctcaggctgtgctcaggaatcgagccaggcacctgcctcgttcgcccacgcgcccaagtccacggatctgggcgcgcgctgcgcgacaccgaggcgcgaggcctcatccggcctcgccgccaccagagctcgcgacgacgcatgccccacgcgctgcacgacgagtggtgctcgcgcgccgtcgcgcatcggccctctcgacgcaccgggtgcgcgagcacagccgaaccgctttcgcagccgccgatgccccgaccgacgatcaacgatcggccgacaggcccgagatgacgctacccccggtacctcgtggtagcgggggtagccatgcatccgagagggaatggagaaggactagcgccggaagaatccccggccgccggaggaggagccgcattggcaccgatcttccggcggaatgtgtccgagaacctgctcaacatgctggccgcagccagaccaggtcggacgcttgcactgtggacaggtcaccgctctgcacatacccaatagggtatcacgtcttcgaggacatccggccccgataccgcacgattcgcccgcgcggtcgtctcggcgtcagcgcccctcgagcttggccagcacgcgacgcgcacgctcgcgtgccccgatcgagctcacgaccgcgacggacgcgacgagcaccatcacgaccccgagcacgacgaacgcgatgctcggccagcgagcaaggatcacgccggccgcaaccagcacggtgcccacagcagcgccgaaaggcacgggttgcgcgacgacgcgataggcctgctcacgcaccaggggctcgagctcgcgcggcacgggcccacggcgcagcgcaaggagcacggcagctcgctgcgagcggtcgagttgacggaacgactgcagcgccgtccgcagacgcagatcgcggcgagatgtcgtccggagccggacgagatcgacgacgatgcctgcgaagccgacgatggtgaggaccagcccaacgaaaccgacgacccccgtcgccgcgcgagcgaccgctgcgaccatgagcacctcccgttgcgcgaggctagcgctgcggatcgccgcagcactcctacactcacggcgtggcccgggcgaggagaccgtgacgaccgcagcgaccgcactggtcgtcctcgatcttgctcaactcatcgccatctccgtcgtggccgtcaccgcgcgtcccctcggcaacgtgggccgacgggctctcatgctctggcgtgggttcgcctggatcgccctcgccgccgccaccgccatcgccacggcttcactcctcgcgtcgcaccatcgagcagccccgatcggcgtcccgacgctcgccgtcgacgagacgttcgtcgccgcggcgctcgtcgccaccgcaactggtctcgcgccgaaccttcgacggagcgcgacctggctcgccgcactcggagcggctgcaagcgcgggcggcatcctcgccctcgtccctatcccgctacttgtcatctggccggtcgtcaccttcccggtcgccgtcgcgatcgccgcgctctggcgtcttccgcgccgctggccccgaccgctccggggagcgctcgtcgccgtggcggcgatcggcctcgtggtcagcttcctcctgcatccgccccccgtctccctcgagatcgccggaacgccccaacacaccttcacgatcgccgcacccgctgcgcaacgtgcctccatcgagacgctgtcgagcggggtgctgaccgacaccgagcacaccgcccagcgatcggtgacgctgtcgctcgcgggcgtcttcgacgcttctcgaccgaacttccaccaggtcgtgaacgtcgctatccgactcgtcggccgacccgccctgcatctcgtcgtcgacgcagcgggcatcccccaacccaacggcgcactcgcgctcgtgcactcgcgcatctcgctccagaccgggcgccggttcctccgcggcgtcggacacctcacgaccttcgcccccgatgccctcatcggcacactcggcatcgatcatcatgcctggtcgatactcgtcagcctggatcccatcggcgacggtaccactcgagcaaccgtgacgctgtggccctcggtcggcctgcacctctcctgagcgccgccaggtaggctatcgcccactcggtgaccgtagctcagctggttagagcgccagattgtggctctggaggtcgggggttcgaatcccctcggtcaccccatctcgcccgccgacacgatcccccaggacctgcgacgactcacggcgacgtggtcgcgtcgcgcatgccgcaaccgcgggacggcgctcctgcacggggggcgctggtgtgaggcgtcgtctactcccagagcatgtcgctcccagaggatattgttcccagcggatattgttcccagcggatattgttcccagcggatattgttcccagcggatattgttcccagcggatattgttcccagcggatattgttcccagcggatattgttcccagcggatattgttcccagcggatattgcccccagaacgtagggccccgaggcgatgtagcagtcggaccgtgccgcgtgagacaactattgggccgacgttggagcctctctgtgccgatgtccccgaaccgacgaccctcacaagtcgctgcacggtcgcgagcactctcgcgacaccgacctcacccgcgttctggccgcatcgtcctcgggcgctcacgccacacgatctcgagggcgtcagggagctgcgccagctcgaggggacgagctcaaatggagaagtcgatgacgctctcggactgctcggcgagtcccgggagcaccgtgatggtaccctcgggggtcgttccctcgatcgtggaacacaggcgggggtcgcgacggacgacccgcgccggcgcaccgacgacgacggcgtgtgacggcatcgactcgaggaccacggcgtttgcaccgacgtgggtgtcgtggccgatctcgaccggcccgaggatcttcgcgcccgcaccgacgaccacgcgatcgcccagggtcggatgacgcttgccgtgctcgagactacgacccccgagcgtcacaccgtgatacagcgtgacgtcctcgccgacctcggccgtctccccgatgacgacaccggtcgcgtgatcgatgaagaggcctgcaccgatgcgagctgcagggtgaatctcgacacctgtgcgccgccgcagccagtaggacaaccaccgggctccgaaccgatggccgcgctcccagagtcgatgggccaggcgatacccccacaccgcatggacgcctggatagagcaacgcgacttcgatgcgcgaacgagccgcagggtcccggtggagcgccgcgtcgaggtcgcggcgcatctcgttcagcatcacgcgtccgccaagtcggcgaagagcggcgtcgagaggtaccgctccccgaaggacgggatgatgacggcgatgagcttgcccgccgactcgggccgctgtgctacgcgccgcgccgcagccacggctgcgccggacgagatcccgacgagcaggccctcttcgcgcgccatccgccgagccatctcgaaggcctcatcgttcgtcacctggacgacttcgtcgacgaccgttgcgtcataggtcccggggacaaaaccggccccgatcccctggatcgggtgcggtcccttctggccacccgagagcacgggagaagccgcgggttcgacggcgatcagctgcagcgagggtcgccgtggcttgagcgcctgaccgatgccggagatcgttccacccgtgccaacgcccccgaccaccacgtcgatcgcgccgtcagtgtcccgccagagctcctcggcggtcgtggctcgatggatcgcgggattcgccggattctcgaattgctggagcatgacgtagtcagggtgctccttgacgagctgttccgccctggcgatggcgccgcccataccttcgggacccggcgtgagcaccagttcggcgccgaaggcacgcagcagcatcctgcgctcgcgactcatcgtctcgggcatggtcaagatgcaccggtaaccgcgtgcggcggcgaccatggcgagcgcgataccggtattgccactcgtcggctcgacgatggtcgacccgggcttgaggcgcccctcgcgctcggccgcgtcgatcatggccacgccgatgcgatctttcacgctgttggcagggttgtagaactcgagctttgcgacgacggtggcccccgccccgtcgatcacgcggttgagtcgtacgagcggagtattgccgaccagcttggtgacgtcctcagcgatacgcacgcgtccctcctatcgcagagcctgcacatgctctaacgccaagcctagccaataattccgatctgttctatcgactttgtgcgcggtgggtcagcgaggtcgctccgggacccaccaccgttcctgtccgtcggtctcgacgaggccatcggcacgcagccctcgcagcgccgcttcgaggcgatggtcgtcgacacccgagtgtcgctcgaggtcgcgcaggctctggggaccggcgaggagtgctcgcaggacacgggcccgggcctcacgaagcgaaccgacatacggaccctgccgatgccgcgacacccacggatcagtgagtccctctcggtgggttcgacacgaccggcgtagctcgcacgcatcgcactgtggcgccgctcggcaccgcaacgcgccgacgtcgaagactgcctgcgtcagccgatcggcgtcgcatccgttcaccagctcgcacccgacctgctcgaggatcgagtcggatgcgggcgcgccgaggagcgcgcgcaccaggacccgacgcgcgttcgtgtcgatcgggagagcggcgagcccaccgcactgaaccgcaacggcgcgggcgacgtagcgccccaccccaggcaacgcccgcagcgcgtcctctccgacggggcaggcgccggcccacgtctccacgatcaccacggcggcgcgccacaggcgctcggcccgccggtagtagccaagtcgtccccacgactcgagcgcagcgacgagtccgccgtctgcaagcgcgcgtggcgtcgggaagcgctcgatgaaggcgacgaaggtctcttcgaccctcgcaacttgggtctgcaccaacatggtctccgcaaccaagacgtgccacggatcgcacggtcgcgcccgccagggcagcgggcgcaggtcgacctgcccgaggtcccgacgcagggcttcgagccgtgactcgtcgaggctgtctccaggcacaccaaccacggtagaagaagcacggacccgacacgagctcgcacgcgcccgctgacgggtcctcgaggcgcgccgtgtcgctacccgcacggcaggcgtgcctggtgtcctcgatgcacgacgaccgggcctcgtgatggacccgaccccgaaccgagcgacgacgggggcagttcgtcgatccgtcgccggccccgccccaggcccaatccactgcacgctgacagagggcgcgcgtttgggagctcctcgatggcacaacgccccccgcaccgagatttcgcaaggaatctttcgcaaattttgttgcgcaaggattccttcgtaactagcatgggagccatgaccgatgccgccgcgaccccacgacacctccgcgacccacgcgcgttgcgcgcactcgcacacccgttgcgcatcaagctcctcgaagccctggtcacccatggcacgctcaccgcgacgcaagccagtgagctgttctcgacgacgcctgcgagctgctcgttccaccttcgtgaactcgcacgcttcggcttcgtcgagcgcgctgacggtggtcacggacgagaacggccctggagggccgtcgccgcccccctgcacttcgacccccacgccgacgacccggacgaagccatcgcggcgagcgagcttgctcgcgtcctccagggccgctggatcgagcgtttcgaaggctggtcgcaggtggcccacacgtatgcagcaccgtggcgccacgcgctctcgacatctcagttcgtcgtctggctcacccccactgagaccaccgacctgctcgccgaactcgctcgcctgatccaggagcgctacccagaccggctcagcgatccctcgacccgtccccctgacgccatggctgtcgagatcatcctcgatgcgcaccccttcgacctcgaggctggcggagcccagcaccaatgagaccggcggttcccccggcccttcgcgagccgggctttcggctcctcgtcgccggacaactcgcatccacgctcggcgacctcgcctacgcagtcgctctgccttggtacgtcctggcccagcacgacggtccaatcctccttgcggcggtcctcgccgcctacggggtgcctcgcaccgcgttcgtcgcggtgggcggcttcatcgccgaccgagtgcggccctggaccgccatgctcatcgcagacggcacgagaaccgcagccgccgggctgcttgccgccgtcgcactccacggaccggcacaaccagccgtgctcatccccatcgccctcgtcctcggcgcctgcgaggggatctttctcccggcgtccttctcgatcatcccagcgctcatcgcagccgaccaactccaaggagccaacgcgacttcaaccgcggccacccagctcgccacgctgcttggcccggcgttcggcggcctcatcgtggggatcgcaggcccaggtaccggcttcggcatcgatgctgcgacctttgccgtctcggcaggatcgctcgcgctcatcgctcaccatcgcaccgacgacgcggtccactcacacggtccggcctcgacgagcacacggcaagcgggccccgccccctctcctccactcacgcttcggcgcctcctcgtgcacgagccggtgctgctcctcatgatcgcaaccacggtggctgccaatctcggcctcggcggcctcagcgaggtcgctctgcccgtctttgcgcgcaccacgctccacgccgatgccactggctacggcgtcatccttgccagcttcggcgccgggggcctcgtcggtgcgctcgcggcagcgcgcctccctcggctacaccgaccgctcgtcgtcggcggcaccctcctcacaagcgcgaccgtgctcctgcttctcatgcccgcaaccgcatcgctccccatcgccgcgatcgaccttgcgggcttcagcgctctcctcgccgttgcgaacatcgtcatggtgacggccgttcaactctgggccgatccgcgcctgctcgggcgcatcatgagcatgatggtgctcgcctcggtggggctctttccagtctcagttgccatcgccggtttcgcggtacgcgccatcggcgcgtcacgcttcgtcgacgtggccgggctcgccttgctcctcgctgcgctcgccgtgctcgcaacaccagcctcgcgtcgcttcgcttcaccaccagcggcgcccgcgcctgagcttgcggagcccgccgactagcgcgccttggttcacgcgcgccgccacgcctttcccccgcacgcagcctcgacctcagcgcgttccacgcgagcgaacgcgacccgtcgtggcgcctggcaacagcgcctgtccgacacgcgtagctgccacagtctgcactggcgccacggaaacccccgagacggcgagttgcgcctcagaagactgcggcgagacctagcagacgtgacccgcgggcgcgctgcaaccagcaagcacctcgaggtgggcggcggactcgaacgcactcggcgtgccgacgggttcgcctaccacgagccaggagaagtgaccggccaaggggtcgccgaagaaacgaccctcgtagatcagatagtcgcccgctggcaccaccccgccgacgaggtctgtcggctggatcaaccagtagcccttcgcatcgactaccggccacacccgcactggatccggtcggccgccgggaacggccgcttcggccacctgggccgacgctgggaactgaccctgctgggcttgaccgttcaaggcagtcaggtcgggttctgcgcttccaagagcgaagtactccgcggcgaccgccggcatcgaggcaccccagaccagccacggacgccaaaggggactcgtcggcaagctcacctcctcggccacggaaccgtgtctcgtcgtcaccgttacgttgacgccggccgaggagaaggcctcggcctctgcgctactcgtgtacggcaccgagaacacgatgtgctgatcagaccactgtcgcagcgtgccgccgctcgtcgccccgccgaggatcgccgacgcaagatcttgtccgttggctcgagcaaccgtgaacgagtccgcgttcggcgtgtctcccagcctgctcccctcgaccgacaccaccacccccgtcggcaagctcccgtccgggctcggaacgaaggagagctcgatccccgcgatgtccggcggagcagcgctactacttgccgacggtgtcggagttacgacaggagtggtcgtcgagtggctcgcacgctgcggtgcagaggcgtgatgaccgcttgagacgaccgcaccgcacccggccattcccacccccgcgagcacgagcaaggaagaccatcgcgaacgttcgaaccgcactgtcatgcctgccccctctcactcgacccacacgcccacgaccggacggcaggtcttcgggtccacaaccccggtcatctccaacctgcgcgcatcgtgcgacgctgtcaagcgctgcccagggtaggcaccggccttcttgtgacccggggtcagcggtcagagccgacccgcttgcggcacagctgtcgacggtgccggtagagtcatgacactcggcgtcacctcgaccgagcacctgctcgctgacgccgagctcgcgggcgaactcggcgatgttgcggtgctggccgaggacgagcacggccgcgtctctacggaactggtcgaggtcgtggcctcttcccaggcgagcgggtccgttagcgagggctggtggcggtgtccagttcatcccttcccccgtaacaagtgtcaacccatttgggaaggcaatcctcgccggatgcgtggtcgtgccgtacgtcgcccggtcaggcaaacggaggaaagctcgcgcgtcccttgtctggccctgggagacgggtcaataaccgagccgctactcccctgagcaccggggcgtcctctcgagcgacggtccacacgcgctcgacgtttacgtcggcgtaggcgtgaatgaggacgttacgaagggccttgaggcggccccaagggatctcggtgttgctgcggcggaaggcttcgctcagccgacccgccgcctccccgatgatctccaactgtcggatgaccgcactttgcttctcgtcattcgcaaggaaggcgtcgtacgacactccagccaagtaccggtcaatccggtcgcaagcgaccacgatgtggtcaagatacacgctgtctgtgtggcgtgacatagatcgtgcgccgatcggccagcacttgttcccggatgaatcggtgcagcaggtgaggttccacgagatcgacacgccggcgcaacagcgccccgagttcctgctggacctcgatcaggtcgagcaggctccgcaccgggctgtcgggctcgaacgtcacgagcatgtccacgtcgctcgttggcatgaagtcgtcgcgcagcaccgacccgaacagagccagttcttcgatgccgaagcgatcggccaaggccgccaacgcggcgtcgtcgacgctcagcctgggatgctcgcgaatgatcacgctccgcgcctcctgatgcaaggctaccacggcgcgaccgcctcgcctcgaaggcgacaccagctcgtaacgcgatgaccggctccttgtccccgcgcgaaggggccagccagcctcttggcgtcgcttggtggcgcacgcacgacaaggggccttgccgagcacgtcgacccaccgcagctgagcacggtaaccgtcgcgatagcgggtggtcgaacccatccctctggtaggccgcgtgccaacctacccaagagcgtcccacctcagtgggttgggccataggttgctttctaggtagcaggagcacccaagtctgaactatgcagcttcgcacctagcgcctcagtgaggagtgatgctggtcgggctggccggatttgaaccggcgacctcttgacccccagtcaagcgcgctaaccaagctgcgccacagcccgttgccagcgagtctaccgagcgagagtccgggggcctcctagccttggcggccgtcgtcgagaccaaagcgacgagcggcgctcacgacctcacggcgatcagggcgttctcgatcaagcccatgagagcggacgatgtcgtggagccggccggagatctctccgacggcctcttgctgctgatcggtggccgttgcgatctcacccacgcgaccttgcaccgatgcgagcccgtccacgatccccgccacggcagcccgagccgaacccccaagttcgacgctgcgctccgactcttcgagaccttcgctgatcactcgcacggcctcgctgacgccatcgcgcacttcagcgatgccgaccccaatctggtgcgctagctcgcccgcacgacctgccagctgtcgaacctcgtcggcgacgaccgcaaacccccgtcccgcagtccccgcacgagatgcctcgatggcggcgttcagggcgagcagattggtctggtccgcgatccccccgatggccccggcaacggcatcgagcgaacgggtgcgctcggcaagggcggtcagcgcctcggaggtgctccggattcgctccgacaggaccccgaccgcgtcgatcactcgaccgaccgtggcgtccccgtcgcgagcagcctccgatgcgctcgtcgcgagctgtcgcaggtcccctgatgcgcgcgcaacctcggccgcagaggcgcgcagctcctcgaccgcggccgcgatctgggcgacgcccgacgagagctcaccgaacctcgcctcggcacgaaccgcctcctcgcgcgccagttgttcgatcgccgtccggtcgaaccagtgagccaggtaacccacgagccgaccccgatcgtgcaccggacgtacgtgggtctcgaggatgcgatcaccaatccgaatctgggcgctgtgactcccgccgcgcgcccgcagttctccgagcacgcgtcggacgcgctccggatcgcggtggaaccgatggatgctccccccgaatgcatggcgcacgtcggcgccttgcaagccggcgttcagctcgacagcgtgctcggcgaagagggcctcggctgccgggttgacgtagacgatggtctgctctccctccggttcggcgatcatcaccgggatctcgaccgcgtccagtgcagcagcccggagctcgagagaacgaagtgtggacggagcgacgacgcgaagagccatgcacgaggtatcggcccgagatctgattccagttgaggacggggtcacgaccctctgtcgtcctgctcaggcgtggcaggtcagcgggcgtccgccgttgtaggcgatcatatcgccgaaggcagcgagcacatcgacctcgcgcccatcgagctcggcgatcgctcgatgcacgttgccgacgaggcgctctgggtccaaccacgcagcgaactcgccgagatcgacggagcgcgccgcctcgagcgggggcaccccggcctcgtgtgcttcgtgcgcgaggtgccacacgaagcggagatagcgctcgacggcgtcgagatcagccgtcgtcgcaagtgggccgtgccccggcacgatgacgtcggcgtcgaaggttcggagccacgcgatgacctcgatccagccctgcaccgacccgcccagcgcaaagggggtgccgccgacgaacaggaggtcgccagcgaagagcacgcggctctcgggcaaccagaccaccgcgtcgcctcgtgtgtgcgcaggccgacccgccgccctcacctcgatctcgtgatcgtcgaaccgcagggtaagaccgtcgtcgaagagcacgtccggcatgcgcacgtcgatctccccccactccaccggcgtgaacacgcccggcggcggcacgacgatcccggtcgcgagctcctcgggcaccgagcgctgagcgatcatcacctcaggatcgagggttgcggtgccgttcgtgtgatcgccatggtggtgcgtcgccaccagcaggcggcgcgatggtgctccgacgcgtcgagctgcctcgaggagcgcctgggtacgacgcacggttgcggtggtatcgacgtggacgctacgctccccagcgagcacgattcctgcgttcgacaggaaccaggagccatcgggttggaggtaggcgaacacccccggggccagctcctcgagtacgccgtctcgacgcggcgtccatgacgacgagctagacgagctagaggacatggtgcagccacatgatgagctggatgaggcgataggtcaggtagatcaccgtcgcgaccagcagcagcttgaagtgccacggggttcgcttcggcggtgcgatgacggtaccacagctcgggcagtgcccttccttgtccagctccgtggcatcctggaagcgctcgcagctctcgcaccagggcatgcctcaagcctagtggcagcgctcaccgaagtgcggtgctacaccggtggtaccccgtgtcgacgctccgagaaatggcgatccttgaccgccgcacggctgagtcgagcgatcagctccgagcggaggtcctcgggttggacgatggcatccacgacgaggtctgcggcgagccgaacgaggtcgacgtcgcgctcgtactcctcacgacgagcggcgacgaagcgctcacgctcggccggatcgtcgatctcctggatcttgcgatagtaaaccgcgttcactgcaggctctgggcccatgaccgcgatcgacgcccctggcagggcgatcgtcgcctcggggtcaaaggctggaccgcacatcgcatagagccccgcaccgtaggccttgcgaacgatcacgctcaccttcggcaccgtcgcctcggcgaccgcagtgatcatcttggcgccgtgacggatgatcccctggcgctcgacctcggagccgatcatgaaccccggcacgtccgcgaggaacacgagcgggatattgaacgcatcgcagagccaaatgaagcgagcagccttgtccgcggagtccacgaagaggacgccccccttgaccgcagggttgttcgccacgatcccgatgctctggccgtcgaggcgtgcgaagccgatcacgagctccggggcgaacagcggcttgagctcgaagaagctccccgcgtccaccagaccctcgatcacgcgatggatgtcgtagccttgctgtggagcgtctgggatcagtgaccgcacgagcggcacgagcggctctcgaggctcctcacggggaggatcgccctcgaagtcgctcggcagatacgacaggaatgctcgagccgcctcgatcgccccacgatcgtcgacgacgaggttgtccccgcatccagagatcgtcgcgtgcatgcgcgcgccgcccatctcctcgagcgtcacgcgctcaccgatcaccacctctgccatgcggggagagccgaggtacatcgaggcgtgtccctccaccatgaagaccacgtcgcagaaggccgggatgtaggcccctcccgccgccgatgggccaaacagacagcacacctgcgggaccctgcccgagagacgaacctggttcgcaaagatgcgccccgcaccccgtcggcccgggaacagctcgacctgatcggtgatgcgagctcccgccgaatcgaccaggtagatgatcgggagtcgatggcggtaggcgagctcagtgatacgaacgatcttctcgacggtgcgcgcaccccaggagccggccttgacggtctggtcgttcgccatgatcgccaccggacggccgtcgacggtgcccgtaccggtcacgaccccgtcggccgggagcgaggggtcggtggcgttcgcgaacagaccgtcctctcgaaaactgcccgcatcgacgagcagaccgatgcgctcacgcgcgtgcaacttgcccgaggccacgagacgctcctcgaccgagctcggccaggcgtacttcgtggtctcggcgagctcaccgatgcgctcgtactgatccacgcgaccctcctccactcacgccccgcggcgacgcaccctgagcttgatcggcgtcgcatccatctcgaaggcctctcggatccggtgctcgaggaatcgcaggtacggcggcgggaggctgcggttcgcaaagagtgtgaaggtcggcggccgcgtcgccccctgtaccgcgtagaggatgcgcccggcgggcggggggtgctccgactggagctcgttcaagaagcgattgagctggcccgtcggcacgcgacgctcgtagtcggcccgagccgcgaagatcgccggcagcactcgatgcacgccgcggcccgtgagtgccgagatccgaaccggatcgagccccgtcacgaaagccagtcggtcctcgacgtcacgctcgatgcggtccttggcctcggcgtcgagctggtcccacttgttcagcacgacgacgaccggtgagcccgcggcgtcgatgcgctcgacgaggcgctgatcccatccggtgacgccctcggtcgcgtcgatcacgagcagcgacacgtcggccgcatcgatcgccgccagcgtgcgcaccatcgagaagtactcagtgcccgactcgtagcggctgcggcgccggagcccagcggtgtcaacgaagcggatgcgaccctcgtcggtctcgacgaccgtatccaaggtgtcgacggtcgtgcccggctggtcatagacgatggcccgcggctcgccaaccagtcggttgaacaggctcgacttgccgacgttcggccgccccacgatcgcgacggcaacgtcggctgccggcgccgcctccggctcctccgccgcggtgaggtcgagtcgccgtgcaacgagatcgagcagctcgaagacaccacgaccgtgcatcgccgacaccggcaccggctcgccgaccccgagcgccaagtgctcccagatggccggctcatgcccagggctgtccaccttgttcgcgacgaggatcgagggcaccttggcgcggcgcaccacgcgggcgatggctgcgtcctcctcggtggggggcacacgcgcatcgacgaccacgagcgcgagatccgcccgccggagcgccgcctccaccgcagccgacaccgcagcatcgagaccgtctgcgcccgcgaggtagccgccggtgtcgacgatcgccagcggcgccccctcccagtcgatggtcgcctccttcgcatcccgcgtcaccttgggccgttcctcgaccaccgcctctcgtcgtcccaccacgcggttgaacaggctggacttgccgacgttcgggcgcccgacgatcacgacgcgcttcatgctgctctccccacgcggatcgcccaccgcagcgcgctcccgttcgtcgcgacgacctcgagccgcgggtcgagttcatcgagagcgacgccgtcgatgaaccgacccccggacagacacacgtccggcagcaggagccgatcctcaggggcgtctgcgaccgctcgagccacgtcgctgcccgcgaggaggcctgcgacccccacgttgccgccgaaatactcgttcgccacctcgacgacacgaacatcgccgtagccatggcgctcgaggagcgggcgcagcacggctgctccatagctggatgtgacgacggccgttgctgggcctgggcgccgccgacccgagagctcgacgcgcgtcgctcggtagccgagggccggggctccctcgatcgcccgaaagaacccgctcgcgggctccgtcgacggcgacctggcgccgaggaactcggcctcgaaggccctcgcgagcccgataccgttctcgagctgaggcagaccggcgtagtcctcgagcggcgggaactcgacccccccgaccaggtagagctcgtcggcggcccaggcacggggcgcacgccgatcgcgggcccagcggtcgtagcgctcgatgatctcgaccgcccggcgtgcctcgtcgggggtgtgggcacgcaggtgctcgcggctgaagcgcgacacgccgtagggcacgaccccgatgctcgcaaggcccggtgcgaggagcgccagctcggccaaggtcgcctcgagctcgtccgcgtcgttgcgctccggcacgagcacgacctgcgcatgcacctcgacgcccgcctcgacgagcgcgaccagccagcgcagcgacaccgcgccacgcgggttacgcagcatcgacgcccgcagcgcggggttcgtggcatgcaccgagacgtagaggggccccaggcgttcggtgacgacccgttcgaagtccgcctcggtgaaacgcgtgagcgtcgtgaagttgccgtagaggaacgagaggcgatagtcgtcgtccttgacgtacagcgtccgtcgcaagcccttcggcagttggtagatgaagcagaactcgcagtggttgtcgcaggtggtcaccccgtcgaacacggcgtcagagagctccgccccgagcggcatgcccgccgccttgtcgacggccacctcgagcgacacaccgcctcgctcgacctcgagcaccgggtctgcgtcgtcgatgagctggcggtactcgatgacgtcccgaggctccacgccgttcaccgcgaccagcacgtcgccgggcgcgagaccggcgcggcccgcaggcgagtcaggctcgacgaagagcaggtgaggacgaggcacaccgagagcctagtgagcacccagagggcgccttctcgagcgccctagactcacgaaccatggccgtcgacaaggtcctgctcgccgctcctcgtggtttttgtgccggggtcgagcgggccatcggcgccctcggctggatgctgcgcatcttcgaaccgcccgtgtactgctaccacgagatcgtgcacaaccgcctcgtggtcgaggcgttcgaagcagcaggcgtcgtcttcgtcgacgacgtcgagagcgtcccccctggtcgcccggtcatgctgtctgcccacgggaccgcccccgaggtcctcgaggcggcgcgccaacgctgtcccatcgtcgtcgatgccgtctgtccgctcgtcacgaaggtccaccacgagatccgaacgcgagcccagcgcggctaccagatcgtctacgtcggtcatcgtggccacgaggaggccatcggcgccaccgccgaagctcccgaagccgtcaccttcgtcgagacgccagaggaggctcgcgccatcaccctcggcgacgggccggtcgcgctgctcgcccagaccacgctcgccgtgcccgaatgggaggcgatcgccgccatcgtcgccagccagacgcccaacctctggcagccgggccgctccgacctgtgctacgccaccacgaaccgacaggcggccgttcgggcgcttgcagagcgtgtcgacgccatggtcgtggtcggatctgcgaactcctcgaacacccgcgctctcgagcgcgtcgccacgagcgccggcgtgggccacgtcgagcgcgtcaaccgcccgagcgagctcgtcggcccgttcgagggcatcgtgggcgtcaccgccggggcatcggctgcggagtccgtcgtcaaagatgtggtggccgcactcgcgccgcggctgggcgtcgaggagatcagcgtcctcgaggaggacgagttcttcccactccctcccgatctgcgcgacctcatcggtgcgctcgcgggcgtcgtcgcggttgcaacaggcgtctccccagagggcgcactgcccgagcgagagtccgccgaggcgatactcgccgcactcgacactcgccaccgctagtcacgcctacgtcggtcgatccgtcagatcgcctgcgtcccgtcgagacggatcgaacgctcatggaccggagggagcttcggcagctgcgtcggatcagacgccacccgccgcccggaggcgacgatgagggctcgcgagcgtcgagccgcagcgaggagccgattgagctcggactcgagcatctcgctgagctggcggatctcctggcgccgaacgcgcccggcccaggatgcgcgaacttcgccgggccagagggctcgaccaacctcgatcgccacgggagccgggaggatcagtgcagatccagggcgcatcgcccgctccgacccggcgatggccgccggcacgaccggcacgcccgcccgcaaggcgaggtaggccgctccctcctcgatgccctccacgcgctcgccgcgacggcgcgtcccttcggggaacaccacgagcgagcgcccgctgccgagcgccgcgagcgcgagctcgatcgcctcccgatcggtcgcttcgcggtgcaccgggaatccaccgagcagccgcagaagcgcgccgaaacccggtgcctccatgacgccggacttggccatgtaggtcatcggctcgcccgtgatcgagccgatgaagggcgtgtcgagattcgagcgatgcgtcggcgcgaggatgtagggcgccgggggcagcgcctcctcgaacccgaccgcgacagcgaacatggcccgattggccagccggacgagctcgcgcgcgccgcggtagaaggcccgctgggccaacgagccgacctcgatcacgcaggcacctccgagagcgccgccacgagttcgcccacccgcacggcgagtgctgcaacggagacgtccgacgtgtcgacgacgatcgcatcggcggcaggcaacgccggcgccacagcgcggcgtgcgttgacccgatcccgcgcgagcaccgcgacaccctcgtcgtgtctcctcgccacacgcaccgcgtcccgcgcgacgaggaacagcttgagctcggcgtcgggaacgacgaccgtcccgatgtcacgaccctcgacgaccgccgaaccgagcgcgtggatgtcggctcgctcgagcgcgaggacggcgtcacgaaccaggcgatcttgcgtcagcacggcaagcacctcggtgagtgtgggatcgcgcaggcgcgcgccgagcgcttcggcctcgcggtagcgagcgagcgggtcgccgacgcgccggagctcttcggccacctccgccggtgccaacccctcggcctcggcgaggtgcgcagcgaaacggaagtagagccccgtgttgatacaggcaatcttgagatcgtcggcgagccgcaccgcgagagtcgacttaccggtccctgagaggccgtcgatcgcgatcacgagacggcggcgctgggctacggccccatcgtgccgagatctcgcctccacggccaggtaggctagtgaggagcaaccgacgggacgtgcgggtgcgctccgtgcgaattcgagttctgggctcaggtcattctcggattgtccggacacactcacaatgactaggtcggcgtcggatgaaggagttgggtgtgagcagaacgactcgctttgccaaggatcgcgggttgacggcacggatgaccttcaccatcttcctcctcgggctggtgtacgtcctgttcttcggactgctcatcgccgtcggcgtcggcgcgctcaccgtggtcgtcatcgcggcgatcttcctcttcgtgcagtacttctacgccgacaagatcgcgctcttcggcatgcgtggccacctcgtcaccgaggaccaggagccgcagctctaccagatcgtcgagcgactcgccgccctcgctgacatgcccatgccgaagatcgccgtgtcggaactcgacatcccgaacgccttcgccaccggccggagcccgtcgaaggcggtcgtgtgtgtgacgcgcggcctccagcgccgcctctccccccaagagctcgaggcggtcctctcccacgagctcagccacgtcgcccatcgagacgtcgccgtcatgaccatcgcatcgttcatcggcgtgctcgccggcctgctgatccgggtgatgttctactccgagctcttctcgggtgggttgggctacggcgggggacgtggtcgtggggggcagatgcaaggcggcggccaactcgtcgccgtcgagatgctgatcatgctcgtctcggcgatcgtgtacgccatcagcttcctcctcatccgcgcgctcagccgctaccgcgaactggctgccgatcgctccggcgcgatcctcatcgggcgtcccgcgctcctgaagtcggcgctcttgcgcatctcgggcgccatgggacagatcccgacgcgggacctccgaagcgcccaggcgttcaacgcgttcttcttcaccccggcgatcgcacctcgcggtggcatcggcctcggcgagctgttctcgacccatccctcgctcgagaagcgcatcgcccaactggatgcgctcgagcgccaactcggtacggcggagtaggcgtggggttcttcgacaccctcttcggccgcaccaaggtggcccagcccaaggtggacgccctcttcgcgctcccgggggcagcgatcacgctcgaggtcgccgccaacctcacgagcgacggatggggcgcggtggtcttcaagcccgcctcgggagccgccttcgcgaacaccgagcacgagttccgcgacgtgctcgccgagctgaccgacacgacggtcacgcaggccaccgatggcttcggctatcgctgggtcctccttcgcgccgcggatctcgagaccctggtcacggccgtgcacgccgtgaaccggagcctcgaggaccatggattcggccctcagctcctctgctcactgttcgccttccatgacaccacaggcgcccagcccgtcttctgggtctacctctacaagcgcggcaccttctacccattcgtccccaccggccacgaacaacgtgacaacgagcgcgaactgtcactgaaggcggtggtgggctccgatctccccgtcgaagaggacctgacgcgctggttccccctgtgggacatccccgacccgccacctgccgccgcccaagacggcacgggctcgacgacctaatcctcggttcggacgacggcctcgcacaaccgcacgaaatcgtcgacgaagccggggtagctggtcgcgacccactcggcgtcgcgaatgcgcgccccgatgccctgggtggccgcccagacggccgcactcatcgcgatccgatggtcacgcaccgaatccacgaggacgggcccgctggggctcgtcgggccctcgaccacgaagccgtcgtgcgaggtctcgaccgtcgcaccgaaggcctcgagcatccgagccgtcgtctcgatgcggtcggactccttgacgcgtagctccgcagctccctcgatgcgactcgtgccccgagcggcagcaaaggcgacggcgagcacggggacctcgtcgatcaggctcggcacctcgtcggcgacgatcgtcgtcgcgccgagcgcggcgccgcgcacgatcaccgtgtcgcgtccgagcacctcgatctcggcgcccatacgccgcagcacgtcgagatagcccgtcctcgtcggccccaggtaggcaccacgaacctcgagccgtgctcccggggtcgctgccgcggccaccacgaagaaggccgcagccgaggggtcacgcgcgaccacgatgcgctcgacggggcgcggtgtgccgggcaccacgctcacccgatgtcgcccatcggcgagctcctcctcgtcgacctcgagaccgagcagaccgaggagttcttccgtgtgcggacgggtcgcgaccggctcgacgacgctcaccgccgacgccgccccaaggccagccaacagcagggccgacttgacctgggccgaggcgacacgcagctcgatggtcccgcccgcaagccgcgcgccgcgcacggcagcaggcagccagcgagccccccctcgcgcgtcgatcaccgcgccgaggctccgcagcggctcgatcacgcgtgccatcggccgccggcgcaccgacgcatccccgtcgatgaccacgaggccaggcacgagcgtcgcgaccccgagtccgagccgcgcgagggttcccgagttgccgacgtcgatcacgccttcgggctcgacgaggccctcgatgccggggccgtcgatctcgagggtgccgttcgcacgctccgacacgacggccccgaaggcacggatcgcctcgagcgtggcggtgacgtcgagcgcgcgcgagaggccctcgacgatcgtcgttccccgcgcgaggagcgcgccgaggagcgctcgatggctgatggatttgtcgggcggcggctcgagcacgccagagggggcatgtgcacccggccggatgacgaggtccacgctcgtgacctaggccggcaggtcgtctcgcagaccgaccgcgccatggaggtagacgtggtggaaggcgctccggggtcgctcgtcttcgaggtgcatcagcacgcgcacgcaccgctgggttccccccacgatgtcgagctcgcgcgcgcagatcaacggcacgtcaccaaggccgatctcgcgggctgcggtggcaggaaagagcgagtgcagatcgtcggtcgcggtgaagaggatcgagacgagctgctccttgccgatgccgttcgccgccagcatgcggctcacgagctcctggacacgctcgcgcatcgcctcgggcgtgtcctcgtcaagcgtcgtcgctccccgcaacccccgtagcgccatgggccgacaggctagcggccccgatcgcacgacgcaggcgtgcgagctcacgcggctcgagtcggcgcgcgacccccggagggaggtgagggtcgacgagcggaccgatccgcacccgcaccaaccgctcaacgctgagtccgaccgcgcccaccatccgacggatctggcggttgcggccttcggtgaggacgatgcgcaccagcctcggaccgaccgtaccgacggatgaggcacgaaggagctcaccgtcgacctcgaccccttcgcgcagttcccgcccgaggcgtctcggcacgggccgatcgacccacacgaggtattccttgggcacgtgaaaccgcggatgggtcagctggtaggtgagcgggccgtcgttcgtgaggatcaacagaccctcgctgtcgacgtcgagacgccccaccggatacaccctcgacgtggtcgccaccagcgagcgtacggtcgggcgcccctcgggatcgaccaccgacgacaccacgccgcgcggcttgttgaggagccagtactcgcgctgctcctcggtcgcgatctcgaggccatcgaactccacacggtcgacgcccggacgcacccgcgcaccgatcgtggcaacctcgccgttgatccgcacccgaccgtcgcgaatcgcgtcctcgaggacccgacgcgaaccgcagccagctcgcgcgagcaggacgtgcaccttgaccgactcggcgctcacgactggccgcgcacctcggtctcgagctcggccacctcggccgcgctcggcacgtagcgaccgagcggcggcagctcctcgatggagccgagccccgcacgcaccaggaacgccgtcgtcgttcgaaaggcgacagggtcactcgaggggacctcttcgatgaggccacgctcgaggagcgtccgcacgactccgtccgagacgacgccgcggacctcgctcacctgcgcgcgcgtcaccggctgcagatacgcgacgacggcgagcgcctcgagcgcagctcgcgagaggcgccggtccgcgaccccgagcgcccgacgagcgagcgccgcgtactccggcactacctcgaagaccgcaaacccatcccgaacgcgcacgcgtaccccccgagcgggggcggcctcggcggccgcgatctgcgcctcgatctcggcgacgtcgcgctcgaggagctcggcgagttcgccgatcgcgacggacccgcaggcgccgaccaccgcctcgatcgctgcgccgagctcggccggatcggcggcgccaggcgcgcgctcgtcagtcatgcgacgccacgccgatcccaaccaacgcccgtgccgcgtcgtcgtcgacgagtcccacccacagctcgtcgccgacgacctcgagggtgagtgcgccgagcgcgtagccctcgagcacgatcacgaagcccacgacgacctcgagtgctcgccacccgcgtacgacgtcgcggaaggtcgtacgacgacgtgcgcgtaccgaagcgagtacccgctcggcgaccacctcgatccgtaccatctgactcggcagcgtgacggtgccaacggcccgtcgcccgcgaccttccaacccgacgagtgctgcccggagcgacgctggatcgatcggtgcgagcggcggctcgggcaccggaaccgctcgcgcgagcaccgcgtcctgatcgccgagtcgctgcgcgagctgccctgcggcccgcgagatcgcccgctgcagcgcgagcgcgacgagcacccgctcacgacgttcgtcagcgagctcgagcacctcctcgtccggctccgtggtgagcgcgcccaaccatctcgcgagcaaccaactcgcagccaccaacgccccaccgagcacctcggggtcgtcgatgccgacgagggcgctctcgacgagcgcgccgagctcgagcgagctcggatcgagccgttgggccctgacggcctcgaccgcctcagcgaggctcgttggccccatcgaacctcatcaccatcatgacgtgcggaccgacgccgggaacctcgaacgacgccccgacgcccgtgaaaccaagacgttcgtagaagccgagcacccacgctctcgcgtgcaggaacatcccgcgggggccgcgctcctcggccgtcaaccgctccagcgcctcggagacgagcatgcgaccgatcccgcgacgctgcgccgactcgaccaccgccatgccccgcaggcgccaggcccgtccctcaggatcgagcgtccccgcgagcacgtctgccgcagcagggccaggggcctcgaggaccacagtcacgacgccgatggtcgaaccatccgcacgcgaggccgcgaggtggaggctccgaggatcctcgtccccccgaaagcgcgcagcatcggcgggcttgcccggccgcagcacggccgcgcgcacctcgagcacgtcgtcgatcccgacactgcggatcgtgacgtcgctcacctctgcctcctcgccctctccgccgagctcacggcactccggtagcgtaccgtcaccgacgtggcgtcgcgcctcgacgagcagcctcgatcgagcgggcgaccagcgtcaccggatgcacgacgtcgacctctggtccgagcagcgcccgcagctgcagtgtgcagcccgggttcgggcttgcgaccacgctggcggccgtctcggtcaccgcgcgtgccttgcgctcaccgacctgcgtcgagagctcgggctcgaggaggctgtagagtccgccagccccacagcagcgcggcccgccgacgtccaccagctcgagaccggggatctggcggagcagcgcccggggggcatcgacgatcccctgtgcgaaggcgagatggcacgcgtcgtgcaccgcgacacgagcctcgatggctccgcggggggctcggggtgcgtcctcggtgagcaactccgtgatgtcgatggtggcgcgcgcgaccgccgcgccctcctcccccacgatccactcgtagcgacgcaggtgcgccccgcacccagcagaggtcaccacaagccgcaccgactcgtcacgatcggcgagtgctgccatgatgcgccgcgcatgacggcgagcagccgcctcgtcgccagcgtgctcagacagcgcaccacagcacacgctctcgagcacctcgaccgagtagccctcggcctcgagcacgctcaccgcgtcgtcgttcgtggacccgagcgcagccgaggcgacgcatccagcgagcagcaggacgcgtcgacgaggcgatcgggccgaggacgtgatgcgaggttgcccaccgtggcgtcgatcggcgacacggccctcgtcgagcgcgcgcgcaacgcgtcgtccgaacccacccccccgcgccagtgccggacgaagggcgaacaacggccgaccgagcgcgagtgcggctgcgctcgcacgagccgaggggaagagccgggcgagcgaccgacgccacgttcgatcggcgagcggccgccccggctcgacgagtccacgcgcgagatggatgatctcgtcgtagcgcacgccggaagggcacgcaggcacgcaggcttcacagccgatgcagcgatcgatgtgcagtcgaaccctgtcggcgacgacggggccgctcctggtggcctcctcggcgagcaaccagatacgaccacggggcgaatccgcctctgcgcgtgtgaccgcataggtggggcacgcggagaggcagaacccacagtggacgcacgtcgcggcgagctcggcgatccgtgcgcgagacgtcgtgtgggtcgccgtcatcggaaccgcctctcaggatcgagttcgtcggcgagtcgcgtcacgagcggatgtgcgaagcggtcgacgagaccgaaacccaccgcgtcgtccaccccctcggctcggcgcacctcgccgacggcaccctcgcggcgcgcatcgtcgagcagtgccgggagcgcttctgccccgcccggatcggcgacgacgtcgacgagaccggcacccggatagctcgcaaacgagatcccaggaggagccgtcgtgcgctcgagccacgcgagcatccgcgaggcacggccggcgagccgcagcaccacgccctcacgaggcacccggaacgcggcccgcgccgtccgctccgcgtcgagacgcgcagcatcgagctccgtggcggcgatcccgtgtgcacgaagcacccgctcgagccgctcggactgcgcctcgaccccgcgctcggtgccctcgaacaccacgagcgcctcggtcgaggctgcgagccagtcgatcgcgaccggctcaacccgctccgcgagcgacacctcgaggagcgtgcggagctcggcaggaccggacgccaccagcacaccacgctcggcctggggtcgagggtgggcgcgcaacaccacctcgccgacgagtgcgatccgaccccgtgccccgcacacgagcttggcgaggtcgtagcccgcgacgttcttgatcacgtgcccgcccgaatgcgcgacggtaccgtcagccagcagcaacgtcgcgccgatgacgaggtcgcgcaccccgccatagcgccacaccatggcgccgtgagcactcgtcgcgaccatggcgccgacggtaccgtcggccacgggatcgagcgcgatccgcaggcgcgcctcggcgaggacggcgttgagctcggagaggcgtaccccggcaccgacggcgacggtgaggtcgtccacacgggcgtcgatccagtcgagtccggtggtccgaagctcgagggagcccgctacgacaggctcttggttcgttccctcaccgacgatgcgaacgggctgctcgggctcgaggccggcgagcagtcggctcgcctcctcgatcgaggtgggcgccgctaccatcgagtcgccaccccggcctcctcgagcggatgcggccggtaccgacccgcctgctccccgcacaggcgaggggtcggcaacagcttgcccgggttggcgaggccacggggatcgagggcagtcctcacgcgtgcgaagacggacaggtccgtcgcactgaacatctcgggcatcttgcagaccttgtcgaccccgatgccgtgctcgccggtgagcgagccgccctcggcgagacagaggctgaggatcgcggccgcgacctcctcggcgcgcgcctcctcgccggggacggatgggtcgtaggtgacgagagggtgcaggttgccgtcgccggcgtggaagacgttgaggatctcgagccccgactcccgggcgaggtcgccgatggccgccagcacccgcgggagcgacgtgcgcgggatgacgccatcttggacgatgtaggcgggcgcgacgcgaccggccgccgcaaacgccgccttgcgcgcacgccacatgcgctcgcgctcggcctccgtcgtcgcgacccacaccgaacgtgcccccgcggccgcgagcgcctccctgaccgcgacgaagccctcgtccacctcctccgcggggccatcgagctcgacgagcagggcggctccccagtcgagctcgagtccggcgtgcgtcgccgcctcacaggccacgagtgccgggcgatccatcatctcgatcgcggcaggcacgaggccagcccccacgatctccgacaccgcatcccctgcttgcaccgcgtcgtcgaagtaggcgaccagcgtccgacgaagggacggttggttgatgaggcgacagacgatggtcgtggcgatgccgagggtgccctcggatccgatgatgagaccgcggacgtccggccctggcgactcgagggactgcccacccacgaagaccagctcacccgtcgggtcgatgagctcgagaccgagcacgtggttcgtggtgaagccgtacttgaagcagtgggcaccgccggagttctcggcgatgttgccgccgatggtgcaggcgatctgcgaggaggggtcaggggcgaacagcaacccctccccagcgaccgctgccgacaggtcgaggttgacgactcctggctcgaccacggccacccgcgagatgggatcgatctcgagcacacgggtgagccgcgcgagcacgacgaggacgccgtccgtctccggcaacgcgccccccgaaaggccggtaccggcccctctcgctacgaagggaaggccgagacggatgatctcgcgaaccccgacgatgagctcgtcacgactcgagggcacgaagacgagacccggagtggcgcgatggctggtgaggccgtcacagctgtaggcttgccgctcgcgaggatcgtcgatcaccgcatccggaccagcgacggatcgcgcgaacgctgcaaagcgcgcgagcgctgtcgacccgctcatggcggcaagtgtagcccgggtgggtgatccgcccgaggaggaaggagcaacgatgacacagaaggtcgtcatcacgggcgcaacggcggggatcgggctcgccaccgcccgcaccctgcacgcagccggctgggagatcatcgccatcggtcgacgcgacgatcgcctgcgagacctcgccgacgagttcggcggggagcgcatccacaccgtcgcgatggacgtccgcgacggtcaggcgatcggccgtctacgcgccatcgtgggtgtgcccgacgccatcgtcaacaacgccggcggcgcacgaggcctcgaacgggccgacgccgcgcagctcgacgactggctgtggatgatcgagacgaacgtcatcgggctcgtacggctcacgcacctcttcctccccgacatggtggcgcgcgggagcggcacgatcgtgaacgtcggctccgtggcgggcgagtttccctatccgggtgggaacgtctacggcgcgaccaaggcgttcgtgcgccagttcaccttgaacctccgggccgacctcgccgggacgggcgtgcgcgtgaccgacgtcgaaccagggatggtcggtggcaccgagttctcgctcacgcgcttcggcggcgacgagtcccgtgccgcggaggtctacgaaggcatgacacccctcggtcccgacgacgtcgccgaggtcatcgcgttcgtgctctcgcgacctgcgcacgtgaacatcaacacggtcgcgttcatgccgaccgaccagggtttcggacccttcaaggtggcccgccacgacgacgtctgagcgtccacctacgctcgaggccatgacctcgaccctcgggcgtagcgacctcgcagccccttcaccgagccgaagtagccggcgtcgggagggatggctcgcgaccagtggcgggacgctccacccagagggtgtcgtgagcgcccacccagagccgacacgactcgagcgccccgcccctcacgaacgcacggcccgcgaggacctcgaggcgatcagcctcgctccgggcgcgacccgcgccgagggggcgggacgacgagccgtcccagaggctcccgacccgttgcgaacctgcttcgaacgcgaccgcgaccgcatcgtgcactcgagcgcgttccgccgccttgccggcaagacacaggtcttcatcttcccccgcgaccaccagcgcactcgcctcacgcacgcgctcgaggtcgcccaagtcgcacgcgcgatcgcgcgtgggctccgcctgaacgagacgctcgtcgaggccatcgcgctcggccacgactgcggtcacggaccaggagggcacccgagcgagacggcgctcgacccctacctccctgaaggctatgaccacgccgtccagggtgcccgcatggcgctcggctcgctcaacctgtgcgtcgagacgctcgacggcatcgagaaccactcgtggtcacggccgcgacccatgacccccgagggggaggtcgtctccctcgccgaccggatcgcctacctcgcccacgacctcgaagacgccgtccacgcaggcatcgtgaagggagacgagctgccagcgagcgtacgagagctgctcggcgcgcaccgaggcgaccagctcgacgccctcattcgcgacgtgatcgaccagacggtcacgaagggggtgatcgggttctcccccgccgtggctgaagccatggccgacttgcgacgcttcaactacgagcgcatctatgaccgacctgcctcacgccgccaggcggccttcgtcgtcgccctcctgcgctcgctcatggactacctgctcgcgaacccgaccgcagttcccgaggtcgcagcctcgccggagccgacgagggctgccgtcgcctgggtggcaggcatgaccgatcgattcgcgctcgacgtcgccaagacctggctgggctggcgcaccgagccacccagtgcacgaggcgagggcctctaacgatatactcgatatatcgttagaaaggaggatggcatgtgtcacggacaccatcaccatccaggtgaaggagccttcggcgaaggaccgcatcgtggagctcgcggacccttcggcggcggacccttcggaggcgggccattcggcggcgggatgcgacgcggaggacgtgcaccgcgcggacgcattcgagctgagatcctgcggctcctcctcgatgggcccaagcacggctacgagctgatgaacctcatcgccgagcagagtggaggcgcatggcagccgagccccggctccatctaccccacgctccagctcctcgaggatcaaggactcgtggcgagcgccagcgatggcgatcgtcgcgtctaccagctcaccgacgcaggccgtgaggaagccgaacgactccagcacgagcccgggccacacgcaggtccggctggcgcccgactcggtcccgagatcgctcaggtcatgggcgcgctgcgcacgatcgcgatgtcggggacgccagagcagcgtgacgctgcccagagcgccatcgcggagtttcgccgaacgctctaccagatcctcgcgcagtagcgcgagtgctcgagcgcgttcgggcccgagggacgtgaggcccggtcatgagccgggcctcacgcgcgactctgatcgcgctcggacttagacgccgacgacctgatagccggcctcgacgagctcgacgaggacctcgccggccggacgcagaccgactccttgtgcctccaccacggcgtgatccagcccgagctgatcgacgttggcaggacaggcctgaacctcgacctcgccttcgcgaagctcggcgagcaccgcactcacctcggtgtgcgtcccgtcggcgagcgcgacacccggtccgaagaggtacaccttgacgtcctcaccacggcgcgtcttgagacgctccgcaagtcggagtccgctcatcgccttcccgacctgatcgggccctgctgtgatccagaatgcaatcttcgccatggcatcaggctaccccgagcacccccttttcgtgcacatcattacagttgcacgtgcaccgaaatttgccgaccacgtcgctctgggagcagtgctcactcgctccgagcgcgtgcccgagatgaccgggcgcgagaggcgcctctgctcggtcgacgacacgaaaccgttgcgcgagcacaccgtgggtcgctaggctcctgccaaccgaccggtcggtcgggacggacgctgtggttgccaaggggggacatgcacaccgtacgcgatccgctcatgcgcgccgagctcatcgctcgtgacggcaccgccgtcgtgtgtggcgccacgacgctcacctaccgcgacctcgccgaccgcgttcgacgcctcgccaacggcctcgcgggccttggccttgcgtccggcgatcgcgtggcgatcatcgccgacaactgccaccgctacgtggaggcctacctcgcggtaccgggtgcgggtttcgtgctcgtgccactcaacacgcgatcgagcccagccgagatcagcttcgccctcgaggacgccggcgtgcgcatcctgctcaccgatcgcgatccggccgcctacgaccacagcgtcgaacgagtcgtccgcatgcccgacgactacgaggacctcctcgagcgcacccctcctggtccgcttccgaacgcccccaccgagaacgacgtcgccgggctcttctacaccggcggcaccaccggccggtcgaagggcgtcatgcttacgcaccgcaatctcatcgcgaacgccgtcactgcgctcgagtggacgaggatgcgcgccgacgaccgttggctcgtcatggcaccgatgttccacgccgcgggcacctgctgcgtgctgacgtgctgctgggtcggcgcttcgcaggccatgctcccgagctttgacgccgccagcgccctcgatctcatcgaacagactcgagccaccggcaccctggccgtgccgaccatgctgaacgcgatgaacgatctccaggccaccgagccccgtgacgtctcgagcctccgcctcctcagccacggcgcgtcgccggctcccctcgagatcctgaagcgagcccacgtgctgttcccgcaggcagaactgctccatctctatggcaccaccgagaccgcgccgatcgcgacgaccttcgcccacgaggagctccatctcgacgatcgcctcgcaggttcggcgggccagcctgccttcggtgtcaccgtcgtcgcgctcgaccccgacggtcgccccgtgccgccgggcgagatcggggagatcgccgtccgaggcaacaacgtgatggctggctactggcaactccccgaccaatcagccgaggcgctccgaggcggctggtaccacaccggcgatctcggcttcctcaccgacgacggctacctcttcttggtcgatcggctcaaggacatggtcgtcaccggtggcgagaacgtctacaccgtcgaggtcgaagatgcgctctatcgacatccagccgtcgccgaggctgccgtcttcggcatccccgacgaacgctggggcgaagcggtctacgccgtcgtcgtgccccgctcgcctgtgaccgaggacgaactgcgctcgtacctgcgcaccctcatcgcgtcctacaaggtcccgaagcgcatccagttccagagcgacccactcccgaagtcaggcgccggcaagatcttgaagcgcaccctccgcgagcccttctgggcaggacgctcgacgcggatcggctcctagcctacgacccgttgtcatcagtcacctcggcgccgcacgccagcgctccaccgagccagaagggaggggtgcgtgatcatcagcaccatgaacgacctgccgggctacgacgtcaccgccgtcctgggcgaggtcttcggactcacggtacgctcgcgcaatgcagtctcccagtggggggcaggactcaagtcactcgtcggcggtgagctgaagggcatgaccaagaatctcgcgcgaagtcgcgaggaggccacccggcgcttggtagaagaggcggaggcgaagggggccaacgccatcctcgctttccgcttcgacaccagcgagctcggcgacatctggaccgagatctgcgcctacggcaccgccgtcacggtcgtcgcgaagagctgaaccctcgtccccgacgccgtcgggcgacccaccgcgggcattggggccggccgtggccccaacgccggacggacccgcaaacctaacgtgcgttgagcgagcgcgcgcgtcggccactcagtggccccccgagcagcgcggagaacgcgcagatgttgatgaggccggccaggatcggcacgagaccgacgatcgccaccacggttcgcgcggtgccatgggcgagggtaagcgcgagggcgatgatgacgagcccggcgacgacccgacccgcacgccccgctgggcgcgccatctggcatgccatctgggttccaaccttggttgccatgactcctccttgggttcgcctggccatcaaccaggctcacccatccttcggagccgtccacgtccgcggatggatcccgacgccacaccatcgccctagcgtcggcgaacatgccagcgcgcgaggcgagcgtcctcctcgcacggcacgacgtcaggggcgccggagcagggctgcgaccccctggccaacccccacgcacatcgtgacgagggcgtagcgaccgtcgcgagcacggagctcgtgtgccgccgtcagggccagacgagcaccgctcgcgcccagaggatggccgagggcaatggctccaccgttcggattgacgagatcgtcgtcgggatcggtcggcaagccaagttcaccgaggcaagccagcgactgcgccgcgaacgcctcgttcaactccaccacgtcgaggtcggcgacaccgaggccgaagcgctcgagcaagcgcctcgacgcagggaccgggccgatgcccatgatcctcggcggcacgccggccgtctggccgccgacgatctcgcaccacggctcgagtccgtaacgcgcgagggcggcgtcgctcgccacgaccacggcactcgcgccgtcgttgacgccactcgcgttgccggcggtcaccgtgccaccgacacgaaatgccggccgcagtcgtgcgagcgcctcgagcgatgtctcacgcggatgctcgtcgagctcgacgacctcctcggatcgaccgcgcaccacccgtaccggcacgatctcggccgcaaagcgaccagaacgctgcgccgcgagcgcgcgcgtgtgcgaccgcagcgcgaagcggtcttggtcctcgcgggtgaccttgaactcctcggcaacgttctccgccgtctcacccatggagtcgacaccgaagcgctcggcgaggcgcgggttgacgaagcgccacccgatggtggtgtcgtagaccgtggcagagcgggcaaaggccgcctcggccttgggcatcacgaacggtgcccgactcatcgactcgacaccgccagcgaccaccacgtcggcctctccgaccgcgatccgtcgcgccgcatccacgatcgcctcgaggcccgaggcgcagaggcgattgacggtgacggccggcacgccctcgccgaaacccgcgagcagcgtcgacatgcgcgcgacgttgcggttgtcctcacctgcttggttcgcacaccccgccacgacctcgtcgatcgcctcgaccggaatgccgacgcgctcgacggcccccgcgagaacagtcgcgagaaggtcgtccggtcggacggacgccaactgaccgccgtaacgaccaaagggggtacggaccccaccgaccaaccaggcactcattggacacctccacgtcgctcgaggagcggccgacccagcgaacgcgatcgaccccgaaacaccgccacgaccgagccatcacgcgtcacggtgacgtcgtagacaccgctacgccctcgacgcacgacctctcgagcctcggcaacgagacgatcaccgacgtaggcaggttccacgaaactgatgtccgcgccttgcgcgacggtgacgtcgtcgtaggtgttgcacgcgaacgcgaacgccgtgtcggcgagcaggaacaccacgccgccgtgggcgatcccgtgaccattcgtcatggcctcgtcgatctcgagcacgagccgcgcgtaccccggagccaccgcttcgagcgccatcccggccgagcgcgaggcggtgtcgtgctcccacagataggccgcacaggcctcggcgagctcgactggactcacgacctctcctccctgccatcggacccgctcgcgagatgcgccgtcccttggtgcgagcgcagaccggcgaggacgaagtccgccacccagttgccgtactcggcgcgtccgagacgaccatcggcttccttgaaccacgtggggtaccagttcacgatgccgaacacgctcatcgccgcgacgggaagctcgagggggtccatctcgggtgccagctcggcgacgagccgttccatgactcgcacgacgcgccgctcggcgtcgcgcaccgctcgacgctctgcgtcgtcgagacgctcgagatcgttgagctgcacccggtggacgtccgcctcgacctggtagcgctcgacgagccgacagatgagcgcacggaggcgggcctcggccgtaccttccttcgcgccgatcgcctcgacctcctcggcgagatcgagtgcgtagtccagcaggatcgccgcgaggatcgactccttcgtggagaagtaatggtagagcgccggcttggacagcccgaccgccttcgcgagcatcgccatggaggtgccacgaaaaccctcgcgcgcaaagaggatgctcgccgcacgcacgatctcactgcggcgatgctcgtcactcggcaccgtcatcgaccgatgaacctcggatcgcgtcgctcctggaacgcgcgcatcccctcatggaagtcatcggtgccggcgagctggccttgcaggtgcgcctcggcagccaagcctcggcggcgaccttcgccgccgagctcctcgaacagcgcccgggatgccagcagtgcctgcgtcgggccgctggcaacccgtgctgcgaggtcggcgacggcgcgctcgaaggtttcgtcgtcgaccacgagcgacacgagcggcgcaaccctcggatcgtcagccgggaggagttcgccggtcgcgatcaaccacatcgcccgccaacgtccgagcacgcgccagagcgcctcgtgcgcgccagagtcgggcgcggccccgagacgagcgaagggcgacccgaggcgacaggagcgagccgctacgaccaggtcacaggcgagcgcgatcccaagacccgtaccgagcgcagccccatgaatcgccgcgatggtcggtgccgagagtgagcgcagctgttcgaagagcggatggtacgtccctgccagcacaccctcggcatcgtcatggtccgggtcgatctcggtgagatcacgaccggccgagaacgtgcggccgacccctccgatcacgacggctctggccccctccgtccgtcggagcgcctcgccgagcgcctccacgagaggtcccgtggtcgcgttgcgctggcccgggcggttcagccacacccacgcaacgccgtcacggcgttcgtcgacgacgagctcctcgcgcccctcggccacagccggccatcgctcgaccacgacgctcacctcccccccggatcacccgcgccagggcccgtcgatccccgtcgctgtcgttgctcgaggaacgcccccatgcgcgcacgcttctcatcgctctcgaagagcaccgcctgtgcgaggatgtccaccgttcgcgtcgagggccgctcgacgctggcgaggaccagcttcgtgaactcgagtgcgcgcagcgactgggacgccatcgacctcgccagagcgacggcgctccccaccggatcgtcgtcgacgacgtcgacaaggccccactcgtaggcctcggccgcctcgacacgaacgcccgccaggagcatccggcgcgcgcgaccgagcccgacgagatcgaccagacgtcggtgcgcgcccgcaccggcgacaataccgagtccaacctcgggctgacgaaaccagcttcgcgtggaagcgacgcgaaggtcacaggccatcgccagctccaggccgccgccgaccgcagggccgtcgatggcggcgaccgtgggccaacgccacctggcgatccgatcgaacagatcgacgttgatggcccgaagggcatcctcctcgccgcgagcgaggagttctgcgatgtcggcccccgccacgaaccgaccgggcacggcgctcgtcaccacgagcaggtgcggggcatcacgcagatcatcgagcgcacgatggacctcgttgaccagctcgagcgagagggcgttcgccgcctctggtcgatcgatcgccagcgtggccacgagaccgtcgaccgcgacgtgcaggtgcgggtagtcccctaccactcgaagaacccgcgaccactcttacgcccgagctccccgcgcgccaccttgtcgatgaggatctgcggcggctcgaagcgcgaaccgaggtggaccgcaaggtagcgcgcgatctgcagccgcacgtcgaggccgacgaggtcgctgagccggagcggaccgacgggatggcggtagccgagctgcatgcctcgatcgatgtcctcggcgctcgcgacctcctcctcgagcatccgagcagcctcgaggccgagcaagaccccgagccgtgaggtcgcaaaacccggccgatcgcggaccacgatgggctccttcccgaagccccttgcggccgcgacgagggcgtccgtcgttgcctccgaagtcgcgccaccgacgacgacttcgatgagttggctcggcaagacggggttgaagaagtggagccccccgaaccgactcggatcctggacgctggaagcgagatcggcgacctggatcgaggacgtgttcgtcgcgaagatcgcatcgcgacgcgcgatcttcgatgcactgtggaggacctcgcgcttgagctcgacgacctccgggaccgactcgatcacgagatcggcagccacgaccgcatcgagacccgaacgagccgcaaccgcaccgaacgcgctccgctcggcgccatgagcgaccgcctggtcgaggagcctctcgacacgctcgaccgtctggcgagcagctgcgtcagagacctcgacgaccgtgacgtctcggcccgccacgaccgcctgggcggcgatgcccgaccccatggtgccgcccccgatcacgacgatcgtgcgaatggctggcggttgccctagaacaccgggatgatctcgtcccactcgacgtccgacacctcttcccccgtgatgcccacctccgggatcgccgggaacggaatcccgtagcgatcgagaacgcccttgacgttgagcatcgcctgccgccagttctcgcgcttctcatcgtagctcgcgatgccgagtccaccggagcgagcaacctcctcaatcacccgttggttgtcgatgaagtcggagggaagatcccagaagtcgtgcggcggttcgaacaaaacccccgagaggaacacgtaaccggcacggatctgcttcgtcacgatggcgcgatcttcgggcgcgatcttcgggtagtcgcgctccatgagcgcgaggcagatcgccatgtgacgaccctcgtcacgaccgatggcgcggaacgcctcacggaacactgggatacgcgtgtgcgtgtacatgtggtggaacagcgtcgaggaggccacctcccccatcaggaacgaactgaagagcaccgccatcgagtagcgcggtaccgccttttggtacccactccagtagcgcgctccgttgtgatagagccatgccacgttgcgcttggccaggcgcccgatctcggtcttcggctcgtagtcgagtggaccacctggggtgagccgactgatggcctcaccgcagacaatttcatggttctgctcgtcacgggtgatcgagaagaacgcacgccgcaccggatcttcctcgtggatctcgtaggcgtgaatgagcgccgtcgcgaacacgggtggtgcggaggcgtcgaagaccgacaggagcgagaaccagtacgcgatcgcctcgcgctcctcgtcgctcatgcgctcgggctggagcgtgtcccagggcagacgcgcaggatcccagtactctcgctgcgacgacgcccagatctcctcgagtttggccgtgtgacgttcccacgacaaggggaagatgttgggctgctcgatctcgggcggcatcgactgccgttcgtcggtcatggttccctccttgccaccgctggcaccgccatgctagcagatcttcgaccgaccggtcggtcggtcgtcggcctagactcacccttggtgtcgcaaaggagggaaggtggccaccatccgcctctacccgtcgggtcgtgaagtgccgtgcccagagggctcgacagtgctcgcggccctcgaggctgagggctgggccctcccgaacaactgccgcgccggcacctgcggtgagtgcaaggtcaaggtgcgccagggcgagttcgaccaaggtttcgtcctcgacatggcgctctccccggccgagcgagccgagggctacggcgccatgtgcatggccaagccgctgtccgacgtgctcgagatcgagtggggcacgatcgatgcacgtccgctcctcttcccaccccggcgcgacgttcccttcacgctcgtcgacgcgatcgagcgcacccccgccatcaccgaactcgtgctgcgacccgacgaggagccgctgcgttactggccgggccagtacgtgcacctcggcaaccccccggacgcgccgcggcgggcctactcgatcgccaacgccccgcgcgcggacggtgagctgcacttcttcgtcacgcgcgaacgcttcggccgcaccagcgcgtggctgctcgaccgtcggcccggcgacgagctccgcctcgatggaccctacggcgccttcatcggcgacccgtcgatcgccacgcccgtggtctgcctggcggccggctcgggactcgcaccgatcctcgcgctcaccgacgccgcgctccgtcgtgggttcgcccatccggtcacgctcgtgctctccgcacgcaccgaggccgacgtgtacccgcgtggcctgctcgcacacctcgagcggcgctatgggaacttccacttcgtgcgcaccttgacacgcgacgagggcccaccacctcgcggccgcatccctgccatcttggccgatctcgtcggcacgctcgccggggtcgcggtcttcatcgccggtccggaggccttcgtcgaggacacgcgccgggcatgtctcgcgctcggcgccgatccgtcgtcgctgtatcgagagccctacgtcccccaggacgacctcggttccttgtcggtccttgggccgtggtgagcacgtttggtaggctccggccatgactgtctcccaggcacgcatcgaggccatcggtcgtgagctcgcctccgtcgagggtgcgagcggtgtgttcggcatgcacggtctcgctggccggatcatggcccaagccctcgacgatcctggctttcgcgccaacctcttccaactcgtcgacgtgtttcctgccctcgccgacgccgacgacgtcgcagaccacgtccgcgattacctcgcagagcgtgcaccgatgtggatgcgcaccggacagcgcctcgccgaacgcgtcccttcgggccgctggctgctcgagcgcatcacccgcgagaacatcctccagatggcgaggcagttcatcgtggctgaagcgcccgacggcgtcgtcggcggcgtgggcgcgctcgccgccctcggctactcctcgaccgtggatctcctcggcgagaaggtgatcaccgccgaggagtcggcgcgctacctcgacaccatcggcgagatccacgaccacctcgtgcgcgcacgccccgtcctcgaagcccgcggaccgctcatcgggccgacggtctccatctcggtgaagccaagtgccctcagccctcgctggtcgccgctcgcccacgatctcgtcgtcgatgaggtcgtgagccgcctcgaaccgctcctcaagcgcgcccagaccgagggttcgctggtctttctcgacatggagcactacgacacctacgagacgacgctcgcggtcttccggcgcatcatcgccgacccagggctcgccgagctgcagatcgggatcgtcctccaggcctatctccgccgacacctcggcgagctcgagcgactgctcgccgagatcccgagcgccacgcacctgcgcgtctggatccgcctcgtcaagggcgcctactgggacaccgaggtctcccaagccgtcacggagagcgtcgagccgccggtcttcgtcgacaaggccgacaccgatcgcagctacgagcgctcggtggcgatgttgctcgacgccgccgatcgcgtccaccctgcgttcgcctcgcacaacctccgcagcctcgccgtcgtgctcgccgaggcagaggcgcgccgtctcgacccggaccgcttcgagatccagatgctctacggcatggccgaaccgctcgccaccgcggtacgccgctacggcgcagccgtgcgcatctacgctccggtcggctcgctcctgcccgggatgagctatctcgtgcgtcgcctcctcgagaacacctccaactcctcgttcgttcgccatcgcttcggcgatcgagaaggcctggacgagctgctcgctccgccgcgctcccgtccggccaccgtcgtgcccccgagcgtgccgcctggctatcgtcacaccccacagacgcagttccgtcacggcgacgtccgcgccgcccaacgagccacgctcgaagcgctcgccgcacagatcgcggcctcgccacgatcggtcccggctcgcctcggcgcagagcggctcctcggcacgcgcctcgcggggagtcgcaaccccgcccatcgggacgtggtcgtggcgcagtgggccgaccacgaccccaccatcgtcgaggctgcggtcgcaaccgcagagcgcgcggcccgggccctcggcgacctcggcctcgctgggcgcgccgccatctgcgaacgcgccgccgcctacctcgccgaccatcgacgcgagatcgtcgccaccgaagtcctcgaagcggccaagccgtgggtcgaggccgacaacgacgtgggcgaggcgatcgacttcttgcactactacgcccagatggcacggcgcctcgagcgggccgaccgcctcgactccccgccgggcgaacgcaaccgcctgcactatcgtccgcgcggcgtcaccgccgtcatcccgccgtggaactttccgctcgcgatcccgatgggcatgacggccgccgccctcgtgacgggcaacccgacgatcctgaagcccgccgaacagacgcctctcaccgccagcttcatcgccgatgccttcgaggctgcagggctgccgcccggagcgttggtcttcctccctggccgcggcgagaccatcggccaagccctcgtcgagcacccccaggtggcgaccatcgccttcaccggctccaaggccgtcggtctcgacatcgtggcgcgcgccgcaacgctgcgccccggtcagcgcgcgctgaagcgggtcatcgccgagctcggcggcaagaacgccatcatcgtcgatgccgatgcggatctcgaccaagcggttccgggcgtgctccagagcgcgttcggcttcgccggccagaagtgctcggccgcctcgcgggtcgtggtgcaccgacgcatccgtgacgcattcgtccagcgactgatcgaggccgccgcggagctccccatcggcgacccgcgctcctccgcgaccgtggtgcctcccgtgatcgacgatgaggcccaagcgcgcatccgcggcgtcatcgccgacgccgcggatgcggcgacgctcgcgtggcaggcaccgtcgaccccgagcgagggcagctacgtgccaccgaccatcttcgtcgatcccgaccaccgcgcgccgctctggagggacgagatcttcggtcccgtcctcgtcgtcgacaccgccgacgacctcgccgacgccatcgaccgcgcgaacgataccgactacgccctcacgcagggtgtctactcccgctcgccgagctccatccggcgcgtcgtcgaccacgctcgcgccggcaacgtctacgtcaaccgcccgatcaccggcgccatcccgggccgccatcccttcggcggcttcggacactcgggggtcggtttcaaggccggtggtccgagctatctgctccagttcctcgatcagcaggtggtgtcggagaacctgatccgccagggcttcagccccgacatcgcctgagggacgacccagcgcaccaatcgtcgcggtcgatcccgggggcggccggcacgggaagcttccagcggcacgagtggttgcattgtgcaactagcctgtgagcacgccccgctgcgtacgacgagaggaatgaccgtggccacgaagacccgtcagtggagcgagctcctccacaaccgagacgtggccatcatcttcatcgcacggctcgcgatgagcacgtcgcgcgcgatcgccggcatcgccgtgccgctctatctcgtcgcactcggcttcagcggcctcaaactcggtgttctctacctcgcggtcgcgctgtttgcggccatcctctcgcaagtcatcggcctgtccaccaatcgcgtcggcgccaaggtctggatgatcgtcgttcccgccatcaccgtgctggccgccgtggcctacgccgagagccacacgacctggatcttgttcgccttcgccgccgcaggatcgttcggccggggggcgggtgccggggccggcatggtcgggccctaccagccggccgaatccaagctcctcattcgcgcggtgacgccgaccgagcgcaaccgcgccttctccttcgtctccatcgcctccaccgcgggcgccctcgtcggcaccgcgctggcggcgctcctcggccacgcgcacgtcgtcgacagcgccgccaccgctctgtttcgaccatcgatgctggtcgcagcggccttcgccgccatcgcggcgatcgtcgcgctctggatccatgaacccgccacaccggtcgcgaccgaccagccacggcccaagctcttcaccttcccgcgtcgttccgcgtggctcctctggcggctctgggcaaccaacacactgaacggcctcgccgtcgggatgttcggaaccttcgtgacctactggctccatcgtcgctacggagcgagccaagtgacgatcggcgagctctacctcgtcatcaacatcatcacgctggcctccggactcgtcgcccccaggatcgctgcccggttcggcacggtacgcgcgaccgcgatcttgcgtgtcgcccagggactcctcctcgtgccgatggcgctcgcacccaccctggtgatcgcgggagccatctacctcgtccgcatgttcgcccagcgcatcgcccttccgctacgccagtcctacgcgctcgccatggccgaccccgaggagcagagccaggtcgccgcgctctcgaatctgccgagccagctcgcgatggccgccgccccgacactgacgggatacctcttcgacgaggtcagcctgtcgctgccgttcgtcatcggcggcctcatccagaccctgagcgcactcgtgttctgggcgttcttccgcaacctccatccacccgaagagcgccatgcggcgcgcacgagctcgctcccagggatgcacgatggtcctcccatgacctccacagctccgtgacgtagcgttggtcgcacccactcccccacccaccaaccaaggcccgcctctggcgggccttggttgtctgtgccgcgcattgtcgacggcgctcgttgcgtgaggccagcgtgaccaccgatcgtgacttgggcccgcgagccgtcaccatcgatggtggaccagcgccaagcgggtggtgggaggtcaccaactgttcaccatcggagcaccgaacgttctccagcgtgcgactgtcgcgtcaccttggcttcgtagcgtcctcgacgtcggatgacaacccagtcgaaagggacacgatgacacgaagcaagctcacgacgccccggctcttcgccggcgtcgctgcggccagcgccctgctcgccgcctgcggaagcgcgacgaccgcgtcgaccacctccgcccagacctcatcgcccgcctgctgggcaaccgcgaccacgattcaagcgtgcggcggcatgaacgccctcatcaaggccgcccgcgccgaagggcacctgaacgcgatcgccctgccgtcgaactgggccaactacggctcgatcatcgccgccttcgagaagcgctacggcatcaccgtgaacgtcgccaatcccgaaggatcgagcggcgaggagctcgcggcgctgaagacggagaaggggaccgcgaaggagcccgacgtcgtcgatgtcggattgtcgttcgccctccagggccaacaggagcatctcttcgcacccttcaaggtgcccacctggtccgagatcccggccaatcagaaggcagcgaacggcgactggttcgaggactacggcggcctgatcgcggttggctacaacgcaggtgccgtccctcgcccgacctcgctcgcctcgctcacgcagcctgcctacaagggcagcgtctgcctcgacggcaaccctgagagcgcaggcgccgccttctcgggcgtcttcgctgcggccctcgcgaacgggggctcctatgccaacatcgcaccgggcatcgcgtacttccagcgtctgcaccaagccggcaccttcgtgcccaccggcgccaccgccgccagcatcgaggccggccagtgccgcgtgaccctcgactggacctacctccaggcgcagtacgccagccagctggccggcaaggtcacctggaagtcgttcatcccctcgaacgcccacgtcgctgcctactacgtgcaggcgatctcggccaacgcgcccgatccagcggcagcgcgcctgtgggagacctacctctactctcccgctggccagaacggctggctcgagggctatgcctacccggtcgagctcaaggccatgatcgccaacggcacggtcaaccgcgcagcgctcgccaagctgccgccgctcccctcgaatcttgcgttcccaacggcgagcgaactcgcctcggccgcaaagacggtggtcgccgagtggccaacggtctagcggtcgcctccaccaccacccgagcagcgtcccccaccgctgctcgggtggcccgcctgacaccgctcgtcggcctcgtgccgatgatcgcctacctggccatcttcctcgtcgtgcccgctgccggcgtgctcgaaggcgccttcacgggcgcgcacggcgtgagcctggcggcgctcaagggggctaccagcggcgcctttctccacgcgctcgtcgtgagcgtcgaactctccgccaccgcgtccgtggtggccgcggtcctcggcaccgcagccgcggcggccatcgtctcgctcggctccgagcgcctcaaccgcatcaccgcctccgtcgctgcggtcctcgccaacaccggcggggtcccgctcgcgttcgcgttcgtggcgaccctcgggaacttcggggtcgtcacgctggcgctcgcccacctcggcttcgacccgtacgcgcatggcttcacgctctactcggtgacggggctcgtgatcgtctatcagtacttcctcctccccctcatggtgctgatcatggtccccgccattcgagggttgcggcgtgagtggtcggaggccacctggaccctcggcggacgtccgtcccacttctggcgccacgtcgcggccccgctgctggccccgaccgtcctcgccggcctcctcgtcctctttgccgacgcgttcgcggcctacgccaccgccgccgccctcgcaggcggcgtcatcccgctcatcccgctcgagatcggcaacctcatcgacgggaacgtcgtcgcgaaccaggccaacgtcggtgacgccctcggcctcgagatgatcgtgctcgtcgcgctggtctcggtggtctacgcgctcgcccaacgtcgccaaaccaggtgggcccggtgagccgcgcacgcctgctcgcgcttgccgtggtcgtgctggtcgcggcctacgtcctcgtgccactcgtcgcatcagggcgcttcagcctggacggaccccacggaaccctgaccatgtccgcgtacgcagccatcgtccgcaccggcgcattctggagctcgctctggctctccgtacgcgtgggcgtcgcgacggcgatcctcgagctgatcctcgtcacctggacctcgctctgggtgcgcctccgcgccccgcgcctcgccccgctcgtcgacacgctcgtgctgatcccgatcatggtgccggtcgtggtcatcgtgctcggtgtcacctcgtcgctgcggttcctgccgtcgctcatcaccgggaccccggcgatcctcgtcgccgagtacgtggtcctcgcgatgccctacagctaccgcatcgtcgatgcgggcgtcgccgccctcgacctgcgcaccctcaccgaggcggctggctccctcggagcgcgctggagcgcgacgatgcggctcgtcctcgtccccagccttcgagggcccctgctcgccgccgccgccatggcctttgctctctcgctcggggagtacgtcatggcgagtctgctctcgttcacgaccttccccgtgtggctccagaccatcggagccacccaagcaaccgaggcggtcgcggtgtcgacgctcgcgctggtcggcaccgtcgtcctgctcgcggtcgtcgtcgtcgccgctggccgcgagcgaacccgagtcgcggatcgacaagcctgaggagcgccatggacgttctcgaacccgttaccgacacccgcacgaccgtcgcgcgatcacacggcgtcgaggtacgcctcgagggcctcgtgcgcgcgttcggtccgacacgggcgctcgacgacgtctcgatcaccgtcaaccccggcgaactcgtcgccctcctcggcccgtcgggaagcgggaagaccaccgcactcagagtcctcgccggcctcgagcgccccgaccaggggagggtcgtcatcgacggcgaggacgtcactcgcgtgagcgcccatcgacgcggcatcggcatggtgttccaggcctacagcctcttccccaccatgaccgccctcgagaacgtcgccttcggcctccgcctccgcaggatgcgtcgccccgcccgcacggctcgcgcacacgagctcctcgagctcgtcgggctcggccaactcgccgatcgtcgaccccaccagctctcggggggtcaagcccaacgggtcgcgctcgctcgcgcactcgcgatcgagccccgcgtcctgctcctcgacgaaccgctgagcgcgctcgatgccgccgtgcgtgtgcgcctgcgcgaggagatccgtcgcattcagctcgaactcggcaccacgaccgtcttcgtcacgcacgaccaagaggaagccctcagcatcgccgaccgagtcgcggtgctgagggcgggccgactcgagcagctcgacaccccgacacagatctaccatcggccggcgacgcccttcgtcgcgtccttcatcggccgagccaatcgcatcccggcccagatgaccgagaacgggcggctcctcgtgctcggacacgagatcgacgcgcctaccgccgacctcgcccccggcacccggcacgtcgcactcatgcggcccgaatcgctcaccatcacacccgcaccggacggtacgggccgcatcctcggcctcgtgttccgaggtgcaagcaccgacgtcaccgtggcgtggccgacgctgcccgatccgctcgtcgtgaccctcgctggcgagccaaccgccgacctcgcccccggcgcccgcgtcgaggtcgtcccccgcggcacggtgctcttcgtcgagcgtgccgaggagcgtccatgacgaccgatcgcaccatcgcgacgacgggccccgagcccttcgtgacgactgctccggcgcccggtgagccgcaccgtcgcctcggcgagcgtggctccctccacgagcacgccaacggcgcaccgatcgttctcggcaccctctggcacctcaccgacctccacgtcaccgacccttcgagcccgatccgcgcgccattcctcaaccacctcggcgaaccgaacggtccgctgcgtacgcgcatcggccgcgtcggcacctatcgaccccacgaggcggcgagtgcccacgtcctcgccgcgatggtccgccaactcggatccatcacccgtgcgcccgtgttcggtggtgccgtcgacctcgtcgtcgcgagcggcgacctcgccgacaatgcccaggccaacgaggttgcagcggcgagcgcgctcctcagcggccgtgaggggacgcttagggctccgggcctcgccgatcccttcgaagggccgggcgggctcgacgacgatccgcactactggcacccagagggtgagcccttcgacgagtggcgcacgaggcgcggctttccgcagatcgaagggtggtggtcggcactggcggcgcccatcccgctcgccacgcacgatctgccggtcctcttcgtcgccggcaaccacgacctcctcctccaaggcaccgtcccagcatcgccccgccttgcccgagccgcgatgggggggctcgcacccactggcgtcgcagccgacctcgatctcgcgcacgccctcgccgaccacgagcggacggcaccggacccctggcgactcgtggtcggggctccacaccgttgcgtcgctccgctcgccgagcgcgcaccactcgccgccatcacgaacgactaccccttgcctcgcaggatcgacgtcggcgcgctccgtctgctggtactcgacacgaccaacccgtggggtggctggcaaggctcgctcgacgcggcgtcggttcgctggctcgtcgacgaactcgacagcgcccacgaacgacggctcgacgacgaaggccgctgggtacccgcaggaggctccgacgtcgcggtcgtgctcgtcacgcatcatccgatcgagactctggtcaacacgaccgtcccagaggaggagcggccacgagtcggcggatcgtccctcgctgcgctgctggatcactacccgaacgtcatcgcctggctggccgggcacacccaccgacaccgggtacggtgggtgcgatcgaggctcggcccctacgggatgctccacgtgacgacggcgtcactcatcgactggccccagcaaggcaggatcatcgaggtggccttcgaccctcgagcgcagcgcctcgtcgtcgcgacgacggtcgtcgaccacgctggtgccgtcggcataccagtgtcgacaccggcttcgatcaccgagatcgccgggatcgcccgcatgctcgccgcgaacgaccccgagcgcctcggagagcgcgaaccaccaggacgcggtaccccgaacgaccgtaacgccatctggacactcccgatccctccagggctcgcgcgccagctcgcgcgtcgcggcgacggatggaccgcgttcgccccggccacaccgagcatgccgccagcggctccctaactgccgagatctgcgaggctcgcccggagcgcgctacggagggtcgcgacgaagcgctcgtcgacggctcgagcctcctgccacaaccgatcgagtgtcgccggctcgagactcgagcgccgtcgctcgatcgccacgaggcgggtgtggagctcttcgtgcacctggcggaggagcgagcgcgcaccctcgtcaccgatcagtcgcttagcatcgctagccaaccaccgacccaggtggcagtcgtcgaggctcgcggccatccacgtcgcgccctcgtcgtcgcgctcgtcgacgacggcggcctcgaggcgacccatcagcgcgtggtggacgctgagcagcggaccgagcccagcgcgctggaagagcgggtcctctgctcgcgggcggtcgtgccaccgtgacccctcgaggtcgagccatcgggcaacggcctcggccggcatcggcctggcgagatggaagccctggagactcacctcgccgagggagcgtgccacgcgctcgaggtacgcatcctcgacgccctcgatgacgatccgacgaccgaggaacagggcggcttgcacgctggagacgacgatgccgaagtccgccgcggacgtcagcatgccgcgcacgaagctctggtcgatcttgaccgtctgcgcaggcagctcccgcaggtaccggagcgaggcatggccgaccccgaagtcgtcgatggcgatggtgagtccgagttcggcgatcgcctcgaggacgtcgtcgactgcacgggtgtcgccgagtgccgccgtctcggtgatctcgagttcgacgagcctcgtcggcaccggaccaaggcgctcgagcgcgctcgccacatcgtcgacgaagcgaggatcgagcaggtgctgcggcgagatgttcaccgagaccccgaaggtgaacccggactcgtgccacgtggcgagctgcgcgagggcctcctcgagcacccaccgaccgacacgacgcgccagcgccggatgatcgagcgccgctccgaagaccgccggcccgatacgtccacggtcggggtcgtcgatacggatgagcgcctccatcgcctccaccgccccatcggcgctcacgatgggctggtagtcgagtgagacccgtccgcgctcgagcgcgacgaccaccatggtgcgggcctcgtcggcacgccgagccgccacctccatcgccggaacgaacaccgaagctcgatcaccaccgtgggccttcgcgtcgtagagcgcgagctctgcatgacgcaccagcccctcgaccgtagcccggtcggctgggaagctcgtgatcccgacgctcccgctcagctggggcaccccgagacgatcccagtcgaggtcacggatcgcaccgatccagcgctccgcctccgccgcgagcgatgcccgacccgatcgccccggcagcaccagcgcgaactcgtcgccacccatccgcacgacgaggtcaccctcgcgcgcgacccctgcgagcgcgtgcgccaccactcgcaggacccgatcgcccgtctcgtgtccgacgaggtcgttcacctccttgaagcgatcgagatcgagcaaggcgaccgcaaccgggtcctcggtggatcgcgatgaccgacacagcgtctcgaggcgaggcgtcagcacgctgcggttcgcgagtccggtgagcagatctcgctcggcgacgtgcagcaagttcaacgcgagtacacctgcctcttggagcggttcgaagtagtcgagtccgacgcggcgcgcaaagcccgacgccgtgaccacgacaccgagaccgcgggccggacccgccgcaaaggggacgagcaccacctcgccgaacggaaggttccggacgctgtcccagcgcggtacgaggcgatcgcccacgtcgagcacgatcggctcagacgaccggcgcccctcgagcaccgactcgaggggcgcgtcgacgacggtcgtcggtagctcgcgtcgtagtgccgcagcgagcccccctcccgcggcagccagcgtccagtgcccgctcgccggatcacgcagcacataggccacgagcacgatctccctcgagcgctcagacacgagtcgacacaacgtttcgagcatcgcaccgaccagcgaattcgtctggtcgatcgcattcgcgctcccgacacgagccgcggcctccacgagcgcgtcgaagacggccacacgatctcgaaccgtcgccttggccgcgcgcgcgaagccctcgagctggagcatcagatcggcgatgacgatgcgtgccaacgcgtcgaggagggggacgcgatcggcgatgggcacctggtgttcgacgagcgtgccccagtgctgccagtagacgacgtagccggcggccaaccacgccggatcgacgtgccacgtgaagtgtcgtcggcccagctcctcggtgcctcggcgccaggcctcatcgaagcgacgatcgagaagctgggtcgcgtgttgggcctggaggtcgatgagacgctggatggtcggcaccgagaagcccgcgaagaccgcacgggtctcgggatgcgcgagcacgaggtcgtagaaagccgcagcgagtgccggagcctcggacgccaacagatcacggtagcgctcgacgagcctccaatcctcctcaccgagatcgatgagctcggtgagggtcgtgcgtcgtcgggtgtcggcgatgaaccgcctccgcgggatccgacggtcgccgagaccgccgaccacccaggcaccgtacgaacgtcgctctggcatgtaccacacctgcccgcgccgaaatccccacagcgcactcacgtgctgggggcatcgaccacctcgcggtcacccgtaccgttggcacgccccgcgccgcacgcggacgccacgcacacctcgtgctggagcctaccatgaacgtcgacgaaggctcggagacaccaccgcgcccagcgggagctgcacaatcctcggacgagcctcgtcgcaggccatggccgcaaccgacggacccgccccagcacaaccacgacggacgagaggacgggctcagcccggaacccgcagaaccgaccttcggtcgcacgccgacgacgtggcatcacgtcgcccaccgtgggccgccggggtctcgaaccccgcaccttgggattaaaagtcccctgctctaccggatgagctagcggcccatggccatcagcctacctgcgcagttgccgtgcgccaggaaccacgagcaccgcgagcgcgactcgagccctccgccaccgggccgacacgcatcgccgagatctcgaagggccgtcgcgttctcgacgtgcgagctagaatcccgtcggctcggacagaaggaacgacaccatgggcacgacgagaggacgcacgacgaccgtgcggccgagaggtaccacgatgcggatcgccgctctggcggcgaccgccgcggcgatgctcgctggctgtggtgccacgacggccacgtccacgacgtcgacggccgcatcctcgagccccaagccgcagcccatcgcggcgacgcacctccccgacccctgttcgctggtgacgaccagcgaagcgagtgcggctctccaggtgccccttcgccagacacaggacgaatccacggcgggataccgcagctgcgactgggtcaacacgacgagcagcctgagcgcgggtcgcggctcgacgatgaacctctacttctatccgggcccgacgatctcgcaggccagcgactaccgcgccctggaggcgcaagggcacttcgcccctaccgagatcgacggctatccggccatcgtggcgggcgccgagtacgaggtcgacctcggcagcgtgctcgtcaccggtgtcgcgttctcgacggtgtcgccgcaggcatcgagcggcgccgaacgcaccaccatcgcgacggcgatccgacgcctctgcacactcgtccgctgcgtggcctgagcgcgtctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtaaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgggacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttatctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatgtcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagctcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagcagtcgcactgtcgatgtgttgatctgcttgtcgtcaacctcgagcgtccggccttcgacagcgagccctaagggcgttggcttcaggccgtagctcgacttcaccgacgcgagcgctagaacgtcgccgtgggagccgagaagaagcacggatcgggcggcggcggggaaggccctggagccgagcagacggtccagcggtgcggccccactcgccttggtcaagtgaccgatcccgacgatggttgccccggcgtcacaggcgatgctacgcaaccggccgagcaccgcccgaacgtccgcgtcacggtgcgtgtcaaccctcccaccgagcgcacccgacagcggctcgacgatgaccaagcgagcatgattgtcgagcactgtccgccgcagcctctcgaaatcggcagggaaactgacggggactgtcgtgaagccgagcatgcgcggatcgccgcccgccgccaggtaccggggccccagcacactcgtcgcgttatcttcgctggaagcgtcgagcgtgacggcgggctggccgaacagggcacccggcagttccccgcgacacagccgggccgccagctgcagcagagcctgttgcatgaacctccgcggcgatctgcaaactccctggtagcacgcgtgtgagatccaccatctcaacaggctcgatggcgaggattgggcccgtggcctacaacctgctcacctcagagcgccaccagctttacctgttgccggcgtcgatggcggactggctgcctgaggaccatttggcgtggttcgtgctggacgctttggaggagatggaccttttcgccttctacgccgattaccgagccgatggctggggcggcgcagcgcacgatacggccacgatggagacgctgttgctctacgcctactgcgtcggggtccgctcgtcgcgccaggtcgagcgtgcgtgccacgtcgacgtcgccttccgggtgatctgcgccgggctactcctcgaccacacgacgatcgcccggttctgccatcgtcacgaagaggccttggagacgatcttcaccgcctcgcttcgtctgtgtgcgaaggcagggatggcctgggtcggcctcgtggcgctcgatcggacgacgatggccgctctcgcatccctgcagcgcaacgtgatcaaggacacgatcgacgaggccgtcgagaagatgttcgccgaggcgaaggacatcgacgaagccgaagacgccacttttggcgaggcccgcggcgacgagccccctgccgttcttcgtggacgccgggaccggcgctgacgcttcaaggcggccaaggaggtcctcgacaaagaactggcagccgagcgcacggcccacgaggcccatctggccaagcgggtggacgaggaggaacgacggggcaagaagctgcggggccgaaagcccaagacgccgaaggacaaggccggcgcgaaggaggagaaggtcaacacgaccgacccgcagtccaaggtcatgtcgacgaagaacggcttcctccagggcttcaacgcgtaggcggtcgccaacaaagaccaggtcatcctcgcagcctcggtcaccgacgagcagaacgacaaggccccactccacccgatgatcgaggcgatcagcgagtcgctcgacaaggcagggatcgatgagcggcccggaaagctcctcgcggatgccagctacgcgtcggaggagaacttcgccgcccttgggccagacgaccccgacagctacgtggccgttcgcaacatgaggaagaacccaacccggcgcaccggccggcgcggaccgctcaggaggaacgcgaccttcctcgacaagatggaccccaaggtgtcgaacaactcggggcgggacctctacaagcgacgccaggcgatcatcgagccgatcttcggccagatcaaagacgtccgcaagattcgctcgttcatgcggaagggcaagtccgcagcggactcggagtaaaagctcatctgcggcacccacaacctcttgaagctctcccggcgcgcccttgccacgccgggcaccgtgccattcagccggctggcgatgacgacagccagatgaaggccaagtagcaagagctcagcggccctccgtggccatcattcccgcgttcaccaacgatcagccgtccctgccgtcgccctggtggaacctgccgaggcggagcccgccgagaggagcagagttcacgcaacagcctcatctgcccccaataggccgtttcagaaccctatgatgcgtgtcatgccttccaacaccatcacaagacgccgtgcgggggcgagccccggcggtttgcgccgtctcgtctccctccaacagcgtgttaccggcagccgccaggctgccgcggtccgcaaccagctggtcgccgagcttcacgcccaaggggtgcccacacgggtgctcgccgaacagttagggatgagcgtgccgggcgtgcagcgcatcatccacctccacacccgcgccggcggctaacctgcagcgtcggtgagcgaaaggttaccgcctgcccccccgcatggggggaacctccctgaccaagcagccccccgccgtaatggcggggggcctttccgcgtcaacagcagctcaacggcggctcaggcgtaacaccaggaacgtgacaccgaggatcacgtcgaccgccacccacaaagcgatcacgatccctgccccgatcgtcgtgcccacatcggcggcagcctggcaggtttgggtggtgagcgtcccgcagtgggtggcgtgcgaccccgagtggattcccaccaccaagcacacgatgaagatggcttagacggcgaggaacacccagcggaagattcgccgtcgccggcgcggggttgtcggcgtctcagactgttgcatcggtttgcctccccctccttcaccgggagcgtggcccccgcagcggtcactatagccccgcgacgctggcagcgcccgcatcgaggtaggatcggccctccatcgccaagcgcaaacgacgactggctctaccggtggttgcgacactccgaccatgatggtcggtggacaggtagcaaccaccggtggtgggttttagcatgccaggtcgacgcctcgggttggaagagtgggaggagatccgggtcgggttggtgcgaggcgagtcgctgcgggtgatcgcccggcggctcgggcggccggtgtcgacgatcgctcgcgcagtggaccgcaacggcggttggatacgctatgtggcggcttgtgcgcagcgtcgagcgaaacgctgtgctcgtcggcccaagccaccgcggctggtggaagacgctgcgctggctcggcgtgtcactcggcgcttggtggaggaccaggagtcgccgatgacgatcgctcgagccaaggacgtaagtcatgagacgatctaccaggcgagctacccaggagaccgcgggctcgatccagggctgtggcgtcatctgcaccaccagcgccgccctcgctggcggtgaggcttccctggggagcaaagacgcttcgtgctgggccagttccagccgatccaccagcgcccagcggccgccgctcgccgcacgcagatcgggcatctcgaaggtgacctgatcatcggcgcgaaaaacgcctcgccggtcgtcacgatcatcgaccgcaccacacgcttctgcctgcttggggcattgcccgacggctacgacgcagcatctttggcgtcgtgtgtcatacggctgctgcgctcgatccctgaggcaggccagcgcaccctcacttgggatcagggccgagagatgacgctgtgagcggacatcgaacatgttctcggcacccccctctacttcgctgatccccacgccccctggcagcgtcccgtcaacgagaacttcaacggcctcgtgcgccgctggctggcgaagagcaccgacctgtccatctactcccaagccgacgtcgacgccatcgcccgccgcatcaaccacatgccacgccgctccctcaactagggccacgcccatcgccactactacgatgccctcgtcgcgatgaccgattgaaccggccctgcgttggagcgaacgcttcactctcggataaatagatcatcaaccgaactcgctactttgtactgtgccgggttctcgcgatccttgagcgcctcgaaatgcgccttgccgcagtcaatcttcgccttttccttgccacgcaagtcgtcggcgaccacactgcccttggtctcaacgacaaagtaaaagtagaggcgctcctcgccttcctgctcgacgaccaccgcccagtcagggttgtatccgcccagcggcgtcggcacggtgaaccagcccgggagttttgcgtagaccttgatatcacggttgtactcgagctgctgggcaaacgttagctcggtgtcggagtcgtagaccacctgctcatagaccgacttcttggcctcgaagagattcttcaggtagccggtcagctcctcactttcgaacagctcccgcgcgtagtagtgctcgtcacccaggcgctggtatttgatgccatcaaccatcgccttccgcttgcagcggttaatagtctctgccgccagctcgatgaaccgctggggattgcgcttgaagtcggccagacgcctactttccgtcaggacgcggtaaatcgtgcggcgcgtgagttgggtccggtcttgaagctcggtaagcaggtccggcagatcgatgtccgtttcctcgagccctacgggcgccccacgctcgcgctcggcggctaccacgccggccttgccgatggcgatatccgcctttcgccactggaggctcaccttcgggatcgccggcatttctttgagcgctttgatgcacgcctccacgagcgcttcgttgtcgaatttcacccggtatgtggttttgtccttgatgcggtcccacagcgccttgaactcatcactgatatggacctccccgcgaacacgcacctgccgacgctcgtcggcgttcttgatctcaagccgcccggccgccttcttgaggacatccgtgatttggtcacgctgcgcggcgaactcctcgggcacttccacggtgccgtccctgagtgcccttctgagtgaatcctgcacccgtcctttggcgtcgatgtagccataggccttgaaggactcccacaacgccttcgaccgttcgatgccgagcggcgaggctttgccattcgcatcggtgaccacgatgtgagcgaactggtccgcctcgacaatgccgaaccggatgccggtatcctcctcgatttccttctgcaagttctcggcgaagtcctcgtagctctccgtagcgatcacggtcagtgtattgacatcgaagccccgcacacgctcgccgtactgattcacgcacaaacgcaagccgcgcccgatggtttgccgccgttcgcgctccgtacggatgtctcgcagggtgcagatttgaaagacgttggggttgtcccagccttcgcgcagcgccgagtgcgagaaaataaacttgatcggcgtctcgagggagaggagcttttccttgtccttcatgatgaggttgtaggcccgctcggcgttgtcgcggcccgcctcgttgttctcggcagtatccgtccagccgcctttcttgtcgatggaaaagtagccgttgtgaaccttctcggcttcgcggctcacatccacccctttgaagagcggttcatactctggcaggttggcagctcgtcggtactcttcctcgaagatgcgggcgtaatcacctttcacggggttcccggccgcgtcatactggcgatacttggcgacttcgtcgataaaaaagagcgacagcaccttgatgccctttggtagcaggcgcatctccttgtccaggtgctcgcgaatggttcggcgaatcagctggcgctgaacggccagcatgtccacgtctccccaggcctgccccggcttgaggaagtgctcgccgccggggacgcgcagctccatgtactcatttcccttttcgacccggatttcgccgatacggtagccggcgtagatcgcgcggccggcgatctcttccaggtcgtcgccgtcctgaaccttcacctcccgccgcttgaccccaccgctgtcggtcttcacgtccagctcgaccttcgctgaaatgatgccgcgcttgttcgacaccgaaaccaggcgcacgtagggcttgttgtgggcatgttcgaccgtggccgaggccacctcgatctgcttgaccagccgcttctcgtaggcgtccacagcgtccagccggtagaccatgtggtgcttatccacgtgggtggccgagtaacgcagggtgcaaagcggattcatggcgtcgagcgcttccttgccgcgcccctgaaggccgccgtccacgctctgaggctcatcgacgatcacaatgggccgggtggccttgatcaggtcgatgggcttttcaccgcctgtcttctcgctttccttgtagaggttgttgacgtctttcttgttgatggccccgacggtcatcaccatgatctggatgttcgcgctggtggcgaagttgcgcacctgcccgagtttggaggagtcgtagaggaaatagtcgaaaggcacgccggagtacaggctcttgaaatggtcttcggtgatctgaagcgtcttgtacacaccctccttgatggcaatcgacggcaccacgatgacgaacttggtaaagccgtagcgtttgttcagctcgaaaatggtgcgcagatacacataggtcttgccggtgccggtctccatctccacagtgaagtcacctgatgcgagtgattccgagggcggcaggccgttgcggagttggatgtcgttcaggttcttgagcagctcgtcgtcgagcaacatcagacggttgccgatgccaagctcgttctgcgcaacgccgaggcgcatctgggtgtccgcgggatcgcgcgtgaccgtgaactcggtgcggcagatctcctgcccgcggaacagatcgcacacagcctctatggcctgccactggtagtcgaggttcggttcaaagtgcagtttcatcacaagctccgcacgttagcgatgccgttctggttgaggatggcggcgaggttcgtcttggcctcgtcgtcggcaaaggcgctgtcccggaagacgcaggtggtctcgcccgccggggcgagttccttgcgccacccgacgatgccctggccaagcgcctccacgtcgtcgaccgcaatctcctcggacaggcaagcgatcagcacgccatagcctacggcataaaccgtgtatttcttcccttctgtcccctgactcttgacttctttctcctgtatcggcacgcacagatcgaggccaagcttgagcagcagttcgtaaaggatgtccgcctcgctgcggccttcgacaatgtgatcctggtgcgcaaacagctccgcctcaaggtcatcaggcttggggttccaggcgcggatgttggatgtgtccagcttgaacacgcgaaaaccgaggtcgcccgcaaactgcgggttctcatcctggatcttcctggcggcacggcggagacgttccttggtcagctcagcgatgttgcgcggctttccgagcttgtcgcagaagtctgcggcgaccttctgttccttgttctctgggtcgacaggctccgggagttggacaaggatatagcgacggttgccgccgtcggcggcgttctgtgccatgaccgcatggccggtggttccggagccggcgaagaaatccaggacaagttctttctccttcaccccagctgctgatgccaagtactcgattaacccccgcggctttggattgttgaagaccgttgcctcgaaaagttgctgaagctcttcagaccccttttcgttgtagcacgtattatcgtcaagaaggtcgttcagtaactttgcttgatctagctcctcagggagcattgttcgacggagccctaagttgcgcgttacaaagagcgtcctatcaagggtttcttgattgattctccacggacccctgatgcgcacatccctcgcgactctcccatccgtaaccttaaggtcgtcaagcaattcaaacgagaggctgcgggccgcgtaggtgcccgcattgtacgttccatcgccacacttggcaatagcaccggaacgtagcactcgcacgcttactgtgttgccttcgttgaacacggggcgtgtcccatcggatacttgacccgcactaagtggggcggcggcatctgagcgaacgtatgcgacaacgtaatcgcacatgtcggtcattcgcttcctcaggaaagcggtcttccttgccgcgcgacgcttgataacgccgcagaagttttccgcaccgaacacttcgtcacacagagtgcggaggtgtccgatttccccatcgtcaatgctgataaagagcactccatcttcccgcaataggttcctcgccagcttcagcctcggatacatcatgttcaaccagtcggtatgaaaccgcccgctggcttcggtgttgctgctgatcttccgcccgccctccacctgccccgtcagctcgaggtagttcttgatgctgtcctggaagttgtccggatacacgaagtccttccccgtgttgtacggcgggtcgatgtagatgagcttcaccttgcccgcgtagctcttttgcaggagcttgagcacttcgaggttgtcgccttcaatcacgaggttctgcgtggtgtcccagtccacgctgtcttcgggcgccgggcgcagcgtcccggtcgagggcgtgagcgcgagctgtcgagcctggcgtttgccgtgccagttgaggccgtacttttcatcgcagtcggtgacggtggcatcacccacgagctgcttgagcacgtcaacgttgaccgccgcgccgttgggtccctcggtgatgagctcagggaacaacgccttgagcttggcgacgttctccgccaccaggtcgtcggaacgggcttcggggtcggcgggcgtcagtttcttcattgtctcctcctttatagtctttcgcgagcggccgcgcgggccgcttcggcgcgcttgagttccaggttcagttccacccgccgggacatctgtttctccctggcggcagcagtgcccaggcgggcgatctcggcgtccagtcgggcgcattcgcgcaacgcctcctgccgcgcggcggcgtgatcggcatcagaggcaaggacgaagacgcccgtcacgcgggccgccttgagcgcgagcagggtatccatccagccctgatagagggcgtaaagggcggttctcggttgccgccccagcgccaacgcggcggaaaaggcgggccagggcccggcgtcgcgctcgggactcagttccgcgacaaccaactcgccgtcgagcaccgtcttgcccgcctcgttctgcgcccaacgcttgtgggcggcggaaaggtcggcctgcgcgccgagttcggtgatcagcagcaacggatagggcacggcccgatgcaccagctccaccaggcgctgcaccttggccccggcgcgcagggtcaagcgaagcacggcgatttccaggtactcgcgtatggcgtcccgatattcggccacgccgatggtcgcgggcttgagcgccgcaacccagaccaactcctcgatgctctcgttgatctgccgcttgtcggcgcccgtgggcgcgccgttttcaaggagcagcgtcttgggcacgcgccggtccacgcggcaactcgcgggaaggtcgagggcggccaggatcgcgtcagcgttcattcgcccgcctcgggcaagatcacaagataggccgccacctcgaagtcgttgatgccggcaaattcgcctttgagcgcgtgcgtcccgcccggagaaaaaaggctggcgacggcccgctcctcgttcttgcgcaccaccgaggcgacggcggcggccagcagccgttgcgcggagcgcatgtcttcgccttgcttggtggcccggtcgaaacgggcgcaggctccgacatcgggcagatcgcgcccggcgcagaggcgcttcagccgatcgaggatttgcttggcctgggtgtggggaagcagtacggtgccgtcctcgcccacgtgaacgaggtagtgcggagccagtggatagcccgcctcgaccgttcgcttcgccgcctcaccctcagcccgcaggcagaagatgatgccgggcggtatctcggcctcggtcgtcgtcgtgaccgcgtaggtgccgagcggcaggttctccagcacgccggggtgcgccttgcggaactccgcgaggtcgatgcgaaagtcggtcagcgtgagatcggcgatcgagacaccggtcgagaggtcctccaggtcgatgaccgcatcctggagcttgaggagctgcttgcggcggtactctaggtcgttcatctggttgccggactgctgctcgatgaggttttcctcgccggtcgccgagatgtcgaggagcaccatgcggccgctcacgcgctgctccaggttgatgtactcctctagctccatgttgggccagaagttgacgagctgaatgcgctcgttgggcgagccgatgcggtcgatccggccgaaccgctggataatgcgcaccgggttccagtggatgtcgtagttgatgagccagtcacagtcctggaggttctggccctcggagatacagtcggtggcgatcaggaggtcgagttcgccttcgtcggccaagtcttccggccgttccttggagcgcggcgaaaaggccgtgaggatggaggcgagatccttgcggagcttgggcagggtggtctggttgtagccggtgccggtgaccagggcggtgtcgatgtcgagccgctttttggcccacggggcgagctggtcgtagaggtagcgggccgtgtccgcgaaggccgtaaagacgatcaacttccggttgccggggttgatggggttttcggccttctgctcgatcattttccgaagcgcggcgagcttggcgtcacgcgaagcgtccacctgcccagcggcggtatggagtttgactagccggttgcggtcttcgatcaggtcctgcttccaacggataagatccaggtccttgaggaggaccttgaccttgcggccgaccaggagactctcgaaggcggggtcgtcgacatccaggtcttcgatgtcaatttcctccatctcctcggcgtggttctcgatccgttccagcgtcgcctccacgtctcggagctgccgctcgacggtcagggcgaacgacggcacggcgctttccatgcgcttaagtacgttcacgcgcaagagatggatcaggctctcttcgcggtccacctgccggaagaagcccgtgccacccttgacctcggtgctgtacttcttgtcgtaggcttcctgcttgtgcggaagcacgtaccgcaacggcgcgtaggcggacagattcaggcggcggatttcgaggttgatgtcgcggatgggcgggaacttgcccgccaggtccacgtcggccttgatgttgatcggcttcaagcggtccgggaatcgtcccgtctcggcgatgccgtagtatttttcgatgtgcttgcgcgaccgggcgatggtcagcaggtccaggagcgtgaagtagtcgaaacccagcatctcgatcaaccgcgacggcgtgcgctcggactcgtccaggttgagccagcggttgaactgttgctgcgccaggcgggtggtgctgtcgatgcttccgacaccgtggtcgcgcagggccgtgtcgtcgccctcggtggcaaaggcaatctggttgcgcaggtcggccatgcggttgttgaccggagtggcggaaagcatgaggacgcgggtcttcacgccctctttgatgatcttgcgcatgagtcggtcgtagcgcgtctcaccgcccttctgcggtgtgcgcttgttgcggaagttgtgcgactcgtcgatcacaacgaggtcgtagtttccccagttcacgtccgcgagatcgatatcgccggagagtccgctatcgcgcgacagatccgtgtggttcagaacgtcgtagttgaagcggtccggggccaggaagttgcggcggtcgttggccttgtagagcgtccagttgtcgcgcaggcgcttggggcagagcacgagcacgcgatcgttgcgcagctcgtggtacttgatgatcgctagtgcctcaaaggtcttcccaaggccgacactgtcggcgatgatgcagccgccgaaacggttgagcttgtcgatggctccgatcacgccgtcacgctgaaacttgaaaagcttcttccagaccaccgtgttgcggataccagtcgcggtcttgaccacgcgctcctcgtcgagttcttctcctcggtcccggaagatgtggtgcaggatcaaagcatagacgagaagcgggtcccggttcccggccagttctttcaagctgtcgatcaatgcggtcttcgaggcagggtcggccgcaagggcggaccactgtgcatcgaaccactcgcttagtaacgtggcctcttcgagtgtctcggatgcctggatcaggttcatcggattgcccggcgtcaggccgaggccgtccgtgctgaacgccagcgaaccgaggagcgcctgtacggggcggccgtttgagttgcggatgacgaacgcgccttgcgggatggggctcaacgcgcggcggacttccgccttgttctcgatccactggagcaagcgcttcgccagccagcgggattgcaggcggttgcgagcgggacggtcggcagccgtacccagcatcgcaagatcggaaccgttcggcggcaacaccaggcggcagccttccagttcccgcgcctcgcgattgacctccgcgaatgcgaagagcgacaaggcgggcgtgagcacgtcgagccgatgactgcgcccgatccccagacggatcagatcgatcacgcggtccgtgccggtgttgcggatgaacttcatgccgctcttacccctcgtccacaatagagtaactggctctaccggtggttgcgacactccgaccatgatggtcggtggacaggtagcaaccaccggtgggggttttagcatgccaggtcgacgcctcgggttggaagagtgggaggagatccgggtcgggttggtgcgaggcgagtcgctgcgggtgatcgcccggcggctcgggcggccggtgtcgacgatcgctcgcgcagtggaccgcaacggcggttggatacgctatgtggcggcttgtgcgcagcgtcgagcgaaacgctgtgctcgtcggcccaagccaccgcggctggtggaagacgctgcgctggctcggcgtgtcactcggcgcttggtggaggaccaggagtcgccgatgacgatcgctcgagccaaggacgtaagtcatgagacgatctaccaggcgagctacccaggagaccgcgggctcgatccagggctgtggcgtcatctgcaccaccagcgccgccgtcgctggcggtgaggcttccctggggagcaaagacgcttcgtgctgggccagttccagccgatccaccagcgcccagcggccgccgctcgccgcacgcagatcgggcatctcgaaggtgacctgatcatcggcgcgaaaaacgcctcggcggtcgtcacgatcatcgaccgcaccacacgcttctgcctgcttggggcattgcccgacggctacgacgcagcatctttggcgtcgtgtgtcatacggctgctgcgctcgatccctgaggcaggccagcgcaccctcacttgggatcagggccgagagatgacgttgtgagcggacatcgaacatgttctcggcacccccctctacttcgctgatccccacgccccctggcagcgtcccgtcaacgagaacttcaacggcctcgtgcgccgctggctggcgaagagcaccgacctgtccatctactcccaagccgacgtcgacgccatcgcccgccgcatcaaccacatgccacgccgctccctcaagtagggccacgcccatcgccactactacgatgccctcgtcgcaatgaccgatcgaaccggccgcctcacgcgcgttccccagcaccgcgcgcagcgctaccagcgccccctccaggcggtaaaccgtcgcagccggcgccaccagctcgccggccctgaccctcttgagcaagactgcaacctcatcggccagcttctcgacttcagccttcgtcacatcgccaccttcagggtcacttcactccaccgcggtcgtcgagtgccaacccacccccaccccagctgctacccatcagtagtcaacccaccccaccccagctgctacccatacgtagcaacacggctgaggggcgcaaaagttaccaacgagtaactatcagggtaactatcagggacgcgcttggtgcccgagatcgtgggtcgcgcgcacgggcctcgtcacggctccccggcgagggcgtggtacgcagcctggataataggagccgccccttggcccgctaccgccgccagcgggtcaggctgggcctcgcagtacggcctcggcctcatcgagcacctcgtcctcgctggcccactcgtcggggtcgaggtcccacggcgcgggctgcgggaacggctcgctcgggtcgggcggcggggccaggtcgagcacccggtcgggtacgtccggtggtccgtcgtcccacggctcggggggctccaactcgactggctcgccgccaagaggatcatccgcacttgatcctcttagagttgatcctcttagagttgatcctcttagagttgatcctcttagagttgatcctcttagagttgatcctcttagagttgcgtcagtcgcgggctcggggtcgccgccctcgccgtgaaggaccgacaaaacggggcgatcccgggcctcatcgaggccccaccaccactcgcccgcccggcggatcgagcgaacccggagggcgctcttggctcgctttaaggtgaccagcgagtaccccgcgtgcgcggccaggttggccacctcctgcgctcgcatcggcccctcggccagctggtctcggagccacatctcagccgaccgcagccggccgcccccgtgttcgccaccggccttcggcagaaggtcgaccgggtcaacgtcgaccggccctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtaaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgggacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatgtcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagttcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagcccgctgctggtgtataggacgcgcttcccgtctgcggcaagacctccacccaggtgcggccaggatcgagcggaatgatcgatccgttcgaactccgcagcaccgtgggactcgcgagcgacgcccgcgaccacgttcctcggatcagctcgccgttgcgaaggacccagacgttgccgctcccgatgacctcggagtgaaccccgagcgagttcggaccgctctcgttgtagggccccggcaccgattgcacgaactgcaccacgacgttcgtcgcgctctgcacggcacccgacgcgccgtaggcaggtacgcctgcgtaggagcgatcgaagagcccagtcgcagcgttccacgtccactcgacaggctcgaccgccgagaacgtcaccgcgaccgacgacaccggaatgccaccgtgcggcacggtggacgagaaggtaaagatcggcgagggcgcggtcgtcggacccacgagcgaccagatccccgccgggttgccgtagaggttctcgggaggcacgcgcgtcgtggtgcgctcgaacggtgtcccgctgtagtccaaggcgtcgacgcgatgcagccaggtctgagccgccagttcctgccggtcggggatgatccctcccgcgtagacgaggatcggatggccgaactgcccgaggacgtgccagtcgacccagcgcagcgaccgaatcggacccacttcggcaggcgagccgcactggaagatggcgatgaatcgcgtgatcccaccctcggcctggacctcgtagaccatgtcggcttcgttgagaccgctctgaggacgagcgcccggatcgttgccgaccttgatcgccagtgccgcacgatcaggaacgacgccgccaggtgccgcacgaccggtcagcgggcatgtggctgacgcaggtgcggccgacgacgacaccggcgtctggctcgtgctcgtcgagtcggcgtgcgaggagggtgttcgggagtgatcgagggcgagcgccgcgcctgcgccaacgaccaccaccacgacggcggccccgagcaccacgcctcggcgtcgacggacacgcttcgaggtgcggtgcgccatcactcctcctcaaacgttgaacgcagcgagcttagggccctcatcgcccgaccccatcgtctccgagagcgtggggctcgcgtcccgaacgcgccgaggacgccggcgcatcggcgaggtcacggtagcgaacccagccgaccctgaggcgaccagcaacgacgacaccgagcgcatccggctcgacgagccccacgcggccgaagcgcgcccgcgccagtgcgagcgagctatcggcgtcgatgctcaccactggggccgcgggcggcgcgccgcgccggacgcgctcgagcaggccacccgccatcgtggcaccgagaccacgatgagccaggaagccctgccatgcatcgcagccaaggtcgcgagcccatcgaagctgatcgggccgctccacgcccaccgcgaccacgatcgcgccgagctcgtgggcggccgtcgtggtcacctcggcgatcaagcgcgcgcgctcgcgcgtcgaggcggcgacgatgctccggtcgaccttgaccacgtcgggctcgagtatcgcgaggcgctcgagaccggcgaaccccgcccccgcgtgatccagcgcgaccagcaagccagcgtgccggagcggttcgagcgcgcgcgctaccacctcgggcgatggaccgcccgcgagctcggagacctcgacgacgaggcgcgacgctcggggctccaagatgcgcagcacggcatcgaggaccaccaccgacggcgacaggttcacgctcagccgcacgcccgactcgaactccggggcgtcgagaagttcgagcacgcgagccagtgcgacgagctcgagatgcaggtcgagccccaatgcggtcgccgagctgaagagctcgtccgcctcacactcgtcgtctcgaaccaacccttcccacgcgatcggtcggttggtctcgatgccgcggatcgcctcgagacgaggggcgagccgttcagggcaccccaagacccgctcgatggcgccccgggacacgctcatcgccgatccgaacccgtgtcgtgatcgtcgaggacgacaccgaggacgtggcgccactcgtcgacgacgagcaccgcctcgaccccaccatcgagtgcgcgacgcacgccatcccagccctcgacgagatcgacctcggccgcgcgaagcggtgctcgatcctgatcggcgacccacacggctcgacccaagccgtcgacgcccactcgcagatcagtgccgagcaacgggctgcgcgcaggaacgatgcgcgcgacggccagtcgttgagcgagttcggcgccaaagagcacccgacgatccgaccgaacgactcccgcgatgcactccgggtcgacccgagggaagccctctgctggacgagccagccaatagccctgcgcggcatcgattcccaaccggacgcacgcgtcgagggtgaggcgatcctcgactccttctgcaatcacgcgggctccgagacgatgcgccgtctcgacgagcgtggtcacgacgccagctcgaccggcgtggtgagcgaggcccttgacgagtcgggcgtcgagcttgacgatgtcgggacgcacgcccatcagcagatcgagaccgccaaagcccgatcccgcgtcatccactgcgaccaacgctcccgcacatcgcaggtcagcgagtgatcgctcgagcacggcgacgtctcgcgccggcacgtgttccgtgagctcgatcacaacccgatcaagacgggcgtgcaggagcacgtcgcgcacgcagggcgcatcgatgacgctcggggcgacgttgacgtgcaggcgccagcctcgcgcaaggcgcctcgttgcagccagcgcacgctccagcacgcgagcctcgagatcggcgccgatcccgagcagctgaccatggaggaacactgcttgcgtggctcgtacaccctcgaaccgtgcgagcgcctcgtagccgacgacactgcccccgtcgagcccgacgattggctggtggaccatcgtcaagccgcgaccactccgcacgacctgcgctgcgcaggtcgtggcccgaagttcgtcgctcatcggatccacgctgatcggatccagctcggcaggatccgtcaccaccgcaatcccttcgctctccacgctcgttgacctcggcgcgttccggtcgcgacttgacgcactacgtccgatgatcgcggctcgatgcctgagccctgtcattgcgaacggtcgccggttccatgacgtggctcgagcctgcatggagagagcgaacctcggcgtgatcgacgatgcgcactctcgccagaggtgggcccgtgcgcaccacccgatgatcgacgggtgggcacaaccgcagctcggccgccggatccctgggtccaacagacgtcggtgcgcagccagcccgccacctcgccaagacccaagggttgtcgtcgccgcatcgcagttcatcgcgttcgccgcggccaacccgccaggtaacaacgacacgtcgtgaccaacgtcacctcccccagggaccattggctcctgcacgccacacgcgcccggcgtagcttcagaggtgtcgagagtctcgggcgaagggaggcacgatgaacgagacgaccatggagtcggcgggcgagaccagcgcaacgaccggcggcaagctcgccatcatcgcctacagcggcaccgcggacaagctcattccgctgggagtgctcgcgcaagcggccgcggcgatgggctttgccgtggagatcttcgtgacgggcttctcgctccttgccttcacgaaggaacgtcacgagctgccctttgccgcggagtacgcagcgatggctccccagctcgccgaaagcctctcggccaacaagatcgccccgtgggacgagatgctgcgccaggccaaggagctcggagctcgggtgcacgcatgctcgatgatgtcgacggtgatggggctcggtccggacgacttcggcgatctcgtcgatgacgtcgtcggagccgcaaccttcgttgctgcagctgaaggcgcagagacattcttcatctgagcccgttgcgaggcgaccatggcatccaaggagaccacatcgaggaggtgcacagcatgaccgaacagccatcggagcagacgacacgaacgatcgtcgattcgcggggatctgcttgccccggaccgatcacggacctcgcactcgcctaccgcaaagccaaggtcggcgacgagatcgagctgctcgcaacggatcccggcgtcaaggctgacgtgaccgcttgggcggccaagacacataacgaggttctcgctatcgaagagggggtcgatggtgtgatcacgacccggatcaagatcgtgagccggtgagatgacacgccgcgtgctgatcgtcggtggaggcgacgggggcacgatcctcgcaaactcgctcgatccccgccgcttcgacgtgaccgtgctgaccgcctcacttgaacatgtcttccagcgcggttacctcggcgtcgccttccaggggcggcgtcgcaacctcgtgcgcgacgagcacagcttgctgcgctcgcacatcacactgatccacgacaccgcagtgcgcatcgacctggttgaccacgaggtcgagaccgcgaccggcaggcgtctcggttacgacgacctcgtcatcgcgaccggtgtgcgcaccgatccgtcccagatccccggtctctgggagatcaatgagcgcatcggcgacttccactcgacgaccgcgaatgcgcgtcgcttgtggcgcaacctcaacgccttctccggaggcaccgtggcactcggacaagcgagcccgatcatcaagtgtccaccctcgcccgtggagggaatcctcggcgtcgacgcacgactacgggctcggagggtacgggaggcggcgaagctcgtgctgttcaccccgtacccacgcgcgtaccccgcagagcccatcaacgaggtgatcacgccgattctcgaggagcgaggtatcgaggtcatgccgttcttcgacgtggatcggatcgatcccgcgaccgggaccatcacttcgctcgagggcgacgaagtcaaggcagacctgcccatcgtcgtacccccgttcgttggagcgccgatcgtctacgagcccgcggacgtcgtcgacgacaatggactcgtgaagacgaacaaggagacgctcgccgtcgagggggtcgagcatgcgtggtgcatcggtgatgccaacaacgtgccgacgtccaaggcgggcgtgggcgcgcacctcgaggcgaaggtggtcgcgcggacactggcaggtcacccgacgcgcttcgatgggcgcaccaactgctccctcgagatcgtaggagatcggcgcttgaccttcgtcattggatctttcgacgctccggtcgagaagctccggccgacacgagtcaagtacctcgaggagtggttgctcggcgagacgttcttctggggccttcggggctggctggacccggtcttcgacgcctacttccgactgaccgagccaaaacctcggcgagtcgccgcctgagagccccgaggtctcgtcactcaccttctctcgtcaagggttactcctcggtctcgtcgtcgagccccttgacaggcccggctcgtgcattggcctgggacacacccgtcgaggaacgattggagaccacgatggtgcacgacctcggcatcgagacgagcaacgcctccgcggtcaccgaggatcgtgtgcgatcgatgtcgccccgacgcgcgagcggacaacaccacgaccatgcgtcgtcgcaggccacgggacccgggttcgtcgctgctcgggcgagaggccgatggcgcacggcacctgctcgagaggacttcagccaactgccacaccagtccacgatcgtcgtggcgacgaggggcagaggcgcatgacgctcaggacccagtcatcggccatgcgtcatctcatgccatcggtcgtgtcgggagcgccctgacaccggaaacttcagtcaggggccttccgtctcgaggaggccggtccacgaggaacccccgtcaaggaactccgccaaggcagccgtgcgcacggaggaccggatgcctcgaccgcgagccgctgggcgctcgcgcactcctcgaccgtgcgcagcatgcaatcccaactccacaggagacgaacccagcgggtgctcaacctggtgtgcactcgagcgcgatcgaagccccgtccgcgggtcgtacgccctcaccttgcgcgagctcagacagacgcttccacccggaggtcaccgcgccgagagcgactagggtgctccgcaccaggggcgcttagctcagtcggttagagcgcagccttcacacggctgaggtcggaggttcgagtcctctagcgcccaccggaaccgcgacgccgtggacccgacgcgatagacccgacgcgatggacagcgccaaggggctcggaccgcgctcgtccttcgcaaccacgacacggagcgcaacatcgaggcccgtctcgcccgcgcatcgcgacgcacggcctgacacgaccgcgtccctttggagcgagtgatcgagtccgcaacggaggcggtcgacaggcctgaccagacgaacacgtcgccactcgccgaccccactatcagctcgatcgatgcccagtgatcgatgcccagttcgggcgggggccatgttgactggcgctcggccacgcggaccgcactaccccgacggtggctcttggctgcagcacccgacgcgcacgcatcagcgtcgtgccctgtcacctcgaccaccaccactcgcacccgctcgcgtcgccgacgcacgaaggatgcgaggaactaccagtctcgtcaggactcacccgtcccggttcggccggaccaccacagtcgtcccgaccgcgtcggccaccaccgaagcgaggactgacgcgccagagcgctcgacgtcacgcgtcgcggtcaacacgaccagctcgtcatcgaccgcccaccggacgaggtcggcgaactgcgtgcccgtcatctgatgctcgagttcggccagatagcgacggcgaaactcgggccagcgctccggctcgtgaccgtaccaccgccgcagctcgtcggtgggagcgagctcgcggcaccagcaggcgaacggagcatccgcacgccggagcccacggggccagaggcggtcgacgagcacccaatggccaggcggccatgggcgctcgtagacacgccagagcacgactcccacgagagacccccgcgagcgggtctagccgtggtgatgacgctggcggatcatgttgagtgcgctccctgcgcggaaccaggcgatctggtcctccgagaacgtgtgacgcagttcgagatcgaagctggtgccgtctggtcgatggaccactgcgcgaatgggttggtcaggcgcgagctcatcgagaccgacgaggtccactcggtcatcacgctcgatgcgctcgtagtcggcaggatcggtgaacgtcagcgggagcatcccttgcttcttcagattggtctcgtggatcctcgcgaacgaacgcgcgatgatcgcacgggcgccgaggtagcgaggctccatcgccgcgtgctccctcgacgaaccctcgccgtagttctcgtctccgatcatgacccatccctggccggcgtctcggtagtggcgtgcgatctcgggcaacggctcgtcagcctggtggatctggcaccaaccatggccgggctccgcggcgaaggcgttctggaccccgaggaacaggttgcgtgagatgttgtcgaggtgaccgcggtagcggagccagggaccggccgccgaaatgtggtcggtggtgcacttgccgaccgccttggccaacacgacgagcccgacgagatcaccaccctcgaagggctcgaacggagtcagcacctggagacgctccgacgccggatcgatgcggacctcgatcgcagaaccgtcggcgggcggtgcgacgaagccgcgaacttcgcgcgcgaggccagcactcgggagttcgagcccctccggctccgggagccgctccccggcgagctcgtcggtgagggggttgaagtcgagggtacccgcgagcgcgtaggcaacgacgacctcgggcgaggcgatgaacgccaacgtcgccgcgttgccgtcgttacgacgcggaaagttgcggttgtaggacgtgatgatggagttggtcgtcccaggctcgatatccgtgcgatgccactgcccgatgcacggaccgcaggcgttcgcgagcacggtcgccccgatcgcctcgaggtcacgcaacaatccgtcacgctcgatggtcgcacggatgcgctcggagcccggggtcacgaggagcggcgtgcgcacccgtagacctctggcgctcgcccaacgagcgacgctcgccgcacgtgcgatgtcctcataggaggagttggtgcacgaaccgacgagggcgctcgagagctcgagcggccacccatgctcgcgcgcctctcgaccgatcgacccgaccccacgtccgagatccggagtcgcaggcccgacgatctggggctcgagcgtgtcgagatcgatctcgatcacctggtcgaagtagcgagccggatcctcctcgacctcggggtcggcctcgagcgacccgaggcgggcttcgacgagcgcagcgatctcgtcgcgacccgtggcccgaaggtaggcaaccgcatggtcgtcggcagggaacaacgagcacgtcgcgccgatctcggctcccatgttgcagatcgtcgctttgccggtcgtcgagagcgcacgggcgcctgggccgaagtactcgaccaccgcgcccgtaccgcccttcacggtgaggatctcggccacccggagaatcacgtccttcgcgctcgtccagccgttcgggcgtccggtgagccgcaccccgatgagacgcggcatgcgaaccgtgaacgggtcgccgaccatcacgtcaacggcgtcggcccctccgacgccgatcgcgaccatgccgagacctccggcgttcggggtgtgcgagtcggtcccgatgatcatgccgcccggaaacgcgtactgctcgagcacgacctgatggatgatgccggcaccaggctcccagaagccgatgccgtagcgagccgacaccgacgacaggaagtcgtagacctcacggttcgtgacgcgagcggccgcgaggtcgtcatcggcgccgcgctccgcctggatgagatggtcgcagtggaccgtcgtcggcacccgaacctcggggaggtcggcaaccatgaactgcagcagcgccatctgcgcggtcgcgtcctgcatggccacccgatccgggtcgagctcgatccagctcacaccgcgctcgagttcggcgcgctcagggtggcgtaggtgcgcgtagagcaccttctcggcgaaggtgagcggtcggcccaaccgctctcgcaggaccgacgcaacctcctcgtagcgtgcgagcgccttggcgacgagcgccgccggcgttgtatcgcgaacctctgccatggtggtacctctctccctctcgaatcccccgaagaggaccgatcgttgtcacgcagcgctagcgtagacaagcataggacaagttcgcattccccgctacctcgccatcgcagagcgcctccgcgcttcgatcggcgatggccgcacgagcgaaggtgacctccttccttcggaggccgagctgtgcgcacgctacggcgcgtcacgcatcaccattcgccgtgccctcgagacgctccgagacgaggggctcgtcgagtctcgccagggccttggctggatcgtgacgagggtgcccgtcgcgcagtcgctcgggcgctttacgaccatcgaacagcagctccgagaactcggacgcacacccgaacggcggatcctgtcgtcgatcatcaagcccgcgaccgggccgatcgaagccgttctcgggggcggtgacgtccgcgaagtccgacgtttgaacctcgccgaccaggagcccttcgcgaccgtgaccgtgtggatccccgcgcacctcgcagagcgcttcacggtcaccgaactcgaacgttcgtcgttctacgagctcctgtccgcgagcggccagctgctcagaccgctcgcctgggcgcaccaagtgatccgagcggccgctatcgacgagcacgacgctgcggtcctcaacgtgcccgcggaatccgtcggcttgaccgtggaacgcacgacctacgacaccgccgacgtcgccatcctccactcccggttcgtgttccccgcaagccgcgtgttcttcgaggtcgacctcgtcgatgaggtcagctccatcggtccgagcggcctccgcctcgtcacctgaaccgcttgacaggattcattcagagacctacgatgctgtatcgagctatgcagtagcacggctcgctgcacgtcgaggggggaccatgagctcggcaccgatgttcgaggcgcgttcgatcgagcagattcccgaccacgaacgccatggtcggccactgtcgctgctcacgctgtggttcgcctccaacttccagatcaacggcctggtcaccggcgcgatcgccatcgccgtcggcttgagcgtgccccaagcccttctcgccctcgtgatcggcaatctgctcggtggtctgttcatggcctaccactccgcccaaggccccaagctcggactcgcgcagatgatccagtctcgggcccagttcggcttcgtcggtgccatcgtgccctatgcggtcgtggtcatcatgtacctcggcttcgcggtcgcagggggcctcgtcgcgggaccggccatcgcgagtgcgctcggcaccacgagagatgtcggcatcgtcgtctacaacgtggtcgtcctcgcggtcgcggtgttcggctatcggctgatccacgcgatctcgcgagcgatctcgctcctctcgctcgtcgccttcgtggtgatcgcggtcgcggtgctcggtcgccttcacctccacgcggcgccgtcagcaggtgccggggccttcctcctggcggtctcgatcgccgcatcgtggcagatcacctgggccccgtacgtctccgactattcccgctacctgccggcgagcactcggacctcgacgacggtcgcgttcacctacgtcggctcggcgatcggtggcgcgctcatcatggcgatcggcgccctcgccgccgcgctcaacgcgaacgccgtgaacgccaacccgatcggctttctcgccggacaggtctcgccgatccacgaagcgctcgtcgccctcctcctgctcagcctcgtgccggcgagcgcggagagcccgtatggcgcattcctgaccgcgctcgcggccgtgacaccccggggactcgtctcctcgacacgcaccgcgcgcacgatcttcgtcgtggccttcacagtggtgagcctcgtcctcacgctcgccctcccagcgacgatcctcacggactttgagaacgtgatcttgttcctcctctatctcctcgtgccgtggacggccatcaacctgaccgactactacctcgttcggcgtgggcgctacgacgtcgccggcatcctcgacgcgaacggcccctatggccgcctgcaagctgggccgctcgccatctacgtcgtcacgatcctcgtcgagctccccttcgtgaactcggcgctctacgagggaccgatcgcccgagcgctcgacggcgccgacatctcgtggatcgtgggcctcgtcgtcgccacgatcgcctacctcgcctgggctcgcgcacgcggcctcctcgtcgccagggccccggggacggcgccggcgtgaccgcacgcgccgaccgtctcgccgcgctgcgcgacctcgtcgggacgaaccgcttgactccggttcagcgtcggatcgtccagaccatcgccgagcacctcgacgacgcggacacgttctcgagcgccgagcttgcggcgattgcgggggtctcgcaaccgtcggtcacgcgccttgcgtccgcactcggctttgcctcctatccagagctccgccaggcgctgcgcgctctcgtgcgcgacgactcccaacctgtcgagtcgacgccccgactcgacgcggtgcgcgacgagatcgccaacctgacctggatggagcgacagctcacctcagaaccccttctcgccgaggccggtcgtcgactggcgggctccgtaccgctcctcgtcatcggccttcgtgcctccgcgccactcgcggcgtacctgagcttctacgcccgcaaggtacaccctgccgtgatcacggtcgaccgcgccggctcagagggcatcgatgcgatcgccgaggcacacgcgcgtggcgccaacgcagcgctcgtcctcgcgctgcccaggtggccgagagaactcctcaccctcgtcgaggtcgctggcgacctcggcatcgacctcgtcaccatcgccgaccgcgcccacgggcccatccaggcgcgcgcacgcgtgtcgctcgtcgctccggtcggaacgagccttctctacgacacccacgcaagcgccttcgtgctcgcgcagctgctcgtgcaggcgatcgccgacgccgcgccgctcagcgcgaaggcatcgatggaggcattcgaagaacgtgcctcgcgctatcgctacttcctccgaggagaggcatgaccgcactgctcgtcgacctcttggagcgtgcacgcccgatcggtcggcacgccgacggtggctggacgcgtctcgggttcagccccgaggagaccgctctcggcgacctcgtcatcgccgaggcgagccggatcgggctcgacacctcccgcgaccgggctcagaacctctgggcatggctgggtgcgccgggccccgacgcactggtgctcggctcccacctcgactccgtcccccgtggcggcgaactcgacggtccgctcggcgtcttcactgcgatcgcagccctcgacgccctgctcgctcgcggctggcgcccacggcgcccgctcgccgtcgtcgcctttcgcgacgaggaaggcggtcgcttcggacgcgcctgtctcggctcgcgcctgctcgccggcgaacttgcgcccgccgatctcgcgaccctgcgcgatgggcacggacggagctttgccgaggtgctcagagacctcgagctcgagccggcgcgcgtcgggcccgatccccaacgcatcgcagcgatcggcacctacgtcgaactccacatcgaacagggtcgccagctcgcacccctcggcgcaccggtggggatcgccaccgggatctggccccacgcacgagcgctcgcgaccctgcccggtgaggcgaaccacgccggcacgacgcccctcgatgaccgtcgggatccggtggtcaccctggctcgcctcgtcctcgccacgcgagaccaggcagcactcaggggagcactcgccacgatcggccgcatcgacgtcgaccccaacgcccccaacgcggtagccggctccgccgcggcgtggctcgacgtacgggcaccccaggcgacgatcctcgatcagctcctcgacgatctcgcacgcctggtggtcgagctcggcgggacgttcgacctccgctcgatgacgccagcgaccatcttcgatacccagctcgccagcgagctctccgcgctcctcggtggtgccccacggatcgccaccggagcggggcacgacgcgggtatcctcgccgaccacggcgtacgagccgggatgctcttcgtgcgcaacccgaccggcgtgtcccacgcccccggggaacaggcaacacccgccgatcttgccgcagggcagcacgcactcgagcgagtcatcgaggcactcgcatgaggatcgcggccgacttcgcgctgctctcaccgaccgagctcgccaccgacgtggtcgtcgaggttcacggcgagcgcatcaccgcgatcgagcacggccgagcgggcgcgtgcgacagcgccgtcgagctcctcgtgcccgggttcgcgaacgtccacggtcacgcgttccaccgcgccctgcgcggtcgggccagcctcggcgctgacttctgggactggcgatcgagcatgctggccgtcgccgagatcctcgacccggatcgctaccgagacctcgcaaccctggtctaccgcgaactcctcctcggcggctacaccacggttggtgagtttcactaccttcaccacacacgagacggctccccctatcgagatccgaacgccatgggcgtcgccctcgtcgaggccgcccgggccgcggggtgccgctacaccctgatcgacgcggcctacctccaccaggctcccgaccacggcgagtgggcaccgaccgagggcgtccttcgtcgcttcgccgacgcaacggtcgatgcctacctcgcgcggaccgaagagctctccgagggcgcaacccatcgcgtgcaactcgccgggcattcgctgcgcacgtgcacgcccagcgagctcgtcaccattgcgcaggccgcacggcgtggctggcacctccacctcgccgagcaacacctggaggtggagatcgtcgaggcggcactcggcgcacgaccggtcgcgctcctcgagcacgccggcctcctcggccccgagctcgtggcggtgcacgcgaacgcggcgacggccgaggaactcggcacgctcgcacgccacgacgtggtcctctgcgcatgcccgagcaccgaggaggatctcggtgacggaccatcgcctgcggcgaacttccatgggctcggtggacgcctcgcgatcggctccgacgagcacgtactcgccgacgggctcgtcgaggcgtcgcgcctcgaggcccatgcccgactcgcgagccgccgacgtcgcggtctcgatgtcgccgcgctctggaccgcgctcaccgcccaccacgcccttggttggcccgaggcgggcaggatcgctcccggttggctggccgacctcgtcgccatcgacctccacgacgtctcgctcgctggggtcacgcccgaggcgatcatccagatcacgacgccggcacgggttgtgcgagtctgggttggcggcacggagatcgtgcacgacgccgccgtcgaacgtcgcgaactcgccccccgtctcgaccacctcatccgcaccatctggaaggagatcccatgagcacgcgtcacgacgagagccgaaccatccgtgcgccacgagggagcgagctctcctgccggagctggctcaccgaagccccgtaccgcatgatccagaacaacctcgatcgagaggtcgccgagcatccggaggacctcgtggtctacggcggaatcggccgagctgcccgcgactgggagagcttcgaccagatcctcgacaccctgcggaccctcggtgacgacgagacactcctcgtccaaagcggcaagccggtcgcggtcctgccgacgcatccggatgcacctcgcgtcctcatcgccaactccaacttggtcccgcactgggccacgtgggagcacttcgacgagctcgaccgtcgggggctcatgatgttcggtcagatgacggcggggtcgtggatctacatcggctcgcagggcatcgtccaggggacctacgagaccttcgccgcggtcgcgaagacgcacttcgacgacgacgtggctgggcgctgggtcctcaccgcgggtctcggaggcatgggcggtgcccagcccttggcggcgaccatggcagggttctccatcctcgccgtcgagtgcgacccgagtcgcatcgagctccgcctccagaccggctatctcgagcaccgcgcgctgtcgctcgacgatgccctcgcgatcctcgagcgggcccgtcgagacggacgaccgacctccgtcggcctgctcggcaacgccgccgaggtcctccccgatctcgtcgagcgcggcatcatccccgacgtcgtcaccgaccagacgagcgcccacgaccctctccggggttacctaccactcgactacagcctggaggagtggcgggcggcccgcgaacccgagcgccaggtcgcagacgccaaggcagccatggcccgtcacgtgcgcgccatcatcgccatgcgcgatcgtggtgcggtcgccttcgactacggcaacaacctccgccagggagcgctcgaggcgggcgtcgacgatgcgttctcgtatcccggcttcgttcctgcctacattcggccactgttctgccgtggctacggaccgttccgctgggttgcactctcgggcaaccccgaggacatctaccgcaccgacgaggtcgttgccgagctcgtcgacgatccgcacctgcaccactggctccagatggctcgcgagcgcatccacttccagggcctccctgcccgtatctgctggctcgggctcgcggatcgcgcccgagtcggactcgccttcaacgagctggttcgtcgaggagaggtaggcgccccgatcgtcatcggacgcgaccacctcgacacgggttctgtggcgagcccgtaccgcgagaccgaggcgatggccgatggctcggacgccgtcagcgactggcccttcctgaacgcgatggtcaacgtggcttccggagcgacctgggtctcgatccatcatggcggtggcgtaggcatgggcttctcgcagcacgccggccaggtcatcgtggccgacggcaccgatgctgccgcacgacggctcgcacgggtgctccacaacgatccggcgatcggcgtcgtgcgccacgcggacgcgggctatgcggacgccatcgacgaagcccgacggcgaggactgcagatcccgtggctcgcctaggggagggccccgtcgactggctgctcacgaacgccgtactcgccgacgtcgacggacacggcagccttcggatcgaggaaggctggctgcacgttcgaggcgagcgcatctgcgcgcgaggcaccggtcgacccccagccgacctcccacacgtggatgctggcggggcggtcgtcacgccggcgttcgtcgagtgccacagtcatctgctctttgcggggaaccgtctcggcgactggatgcgacgccagggactcgaacccgacgacccccgcctcggcaccggcggcatcgccgccaccgcgaaggccacgtcggcgctcgacgacgctcagctcgtcgcgacgacgctcgcacgccttgcacccctcgcgcgctccggcgtcggcacggtcgagatcaagaccggctatggcctgagcgcgcccgccgagcttcggctcgcacgcctcgccctcgaggtggccgagcgggcccgccacgacatcggactcgacgtcgtggtgacgttcctgggcctgcatgcactgccgacagcccctgcccacgagcgacgtcacatcgtcgacgacatgatcggtgccctcgacgaacttcccgctggcgtccgcaccgtcgatgctttcgtcgatccggctggggtgagtgccgaggaggcacgacccttcctggaagcagcgcgagcacgcgggttcgacctccgccttcacgtcgaccaattcgccgacgcgaacggtgcggccctcgcggcgtcactgggcgccctgagtgcggaccacctcgacgccacgggccccgagggcatcgcggccctcgcggctgctggcacggtgggcgtgctcacaccgatcgcgaccgtgctctcgggaacgcgactgcgccctccggtgatggccctgcgagacgccggggtcggcctcgcggtctccgccgacgccaatccgggcacctcgccatctgccgacctgcgcctcgcggcgctcctcgcggtcaccgagctcggccttcgacccgacgaagccttcgccggcatcacgctccacgcagcccgcgcgctcggcctcgcggaccgcggcaccctcgaagctggggcgcgcgccgacctcgtcgcctggcccgtttcccaccccttcgaactcgtcctgagccacctgccgctcgaaccatggcgcccgctgcctgactgagcgtgctccagctcggaaccggccccttcccacaacaagcccccacctgcccacgacccctgaatccatggagcgccacgcgcggcgacacgcctggccgctccgacccgcagcacaatgcgctcgcccatctcgagggcccgaaccgcaccatcacgctcgagctccgcgagcccgacgcccgatgggcatcgtgagctctcgagcgacgtcacgagccgttggccggccccacgcgtccggtgacggacgatcccgagtggacggccgatgttggcaaccacgtccgatcgaacgatccgtcaacgcgcaagggcctacgcggatgcgctgggccagatacgtcgcccagcgacctcgacctggaaggcgaccgacaccggcaactcatcgcgcacgagccgcacgaaatcggagtcatcgagccatcccgtggaggcgacctggatgcgaacgaacggagaggaggccggatcgtcctggtgtcggcgtacgccgccggtctcggtgaggatcacgggcccgccggtcaccgcctcgagaatggtcgtcagccctcgccgcgtcccgcgccaggccagcgcctccccgaggctacgaacggcccgccgctgcgtggcttccgggagcgaaccatcgagccaggacacgccgagccacgctcccaaccacgccagcatcggcaccggggtgacggtcgggtcgacgatgtgctcgatcgtgtcggcgtcctcgagcagtgtcgacgcgacctcctgaaagatcgacacgaatcgaacgaagaaatcatcgtccgtcatccccatcgggagttgctgcaggagccatccgtcacgtcgcatggtgagccctagcggacgacgacctggtgacggaacgagaggaacagcgacaacggatcgagcgccaagacctcccgtccgcgtccttgacgctcgccggtgcgcagatcagcctcgaacaggagcacctcctcgaccgcctcgatgccgtcgacggtctcgagtcgttcggccacaccggctgcggtcaaatctgcgtcgaacggccaaccgtcaccggcggggccaccgaccagcggatggacgtattgatagagcacatcgagggcacgctggcgcacgatggcactcgggcgcccggggatggcccgcacgagtgcagcgaccgtggcgccccgatagtacggggtggagacgtcgaccgtggtaccaatcagtcgtcgcggttcgaggtagccgatgacctgctcgacgagcgcgtccgagagttcgaagtcgtcgagctggtgatcctcgcagcgccctcggaccctcggcacgacgagcaagcgcaccggatcaccgacgaggttcggcgccacgcagcggacccgtgcgacctcgggcgaggcttcgagcgtgagccgctcgaaatccgatgcgctcacggcccgctgaccggagcgcaacgtcatcggcccgcgaagcttggcgttcgcgaccgattcgggatcgaccccgcccgaggcagggaatgggttcgtgactcgatcgatgtaggccaccgaactgcgcaagacggtgagcgtctcggcgccgacgttgccgacggaaccgcccccgtagcggtacgacgagagcatgatcgccgcaccgtcgggggggatcgcgccgtgctgacggacggtgccgtcggcgtaacgcacgcgcggaccgaagcgaaccgttccggtcgctccatcgagcacgaagtgtcggtcctcacccgtcgacgatgcaaagtccgcacgcggctcccacgtccagaccacgccgtctggggtcgtcgtcgtgagcacctcgtcgtcacggagagccaacaccggggcgtgactcagctgaaactcctgtccgggtgagccatcgctccgaccaagacgctcgggccctgtggtcgcagcgtgctcggcagccaccgttccgccgaggacgttcacggtcaccgacgacagggatggtgaggctcgatagggaggttggccagggcgtgccgcgagaagacggacgcgcagccacgtcgcgcgaacaccaccgagcgtcaggggcgagagcgcgcgcgggcacacgagcacgatctccccatcgcgattgagcccacccgttgtgtctcgatgcacgggcatcgctacccatgactctccgacgaacgcctcccacgcgagtggcggatcggtcggatcgacaccgatcccctcgatcgaggctcccacgttgaggcgaatgacggcacccggagcgagtccctcgaatccgaagtacgtcgcgtcaccgggtgcaagcgggtccgaggtgaagcatcgcacgaccccgccctcgaagcggaggtcatcccacacgtcgcgaacctggccaccgccgtcggctgtggcggtcatcgcgccaatcagggtcggggggcgaatgacgagatcgtcgatggtggagaagagcacctccggctgccccggtacgggggcggtggcgacctgggtcccctttggcacgacgacgtcgtgctcgagaacggtcgagagccaaaagaccaggtcggcatgggctggcgccggtgggaatgggctgatgccaacgaggtcgaggaacttcgtgtagagccggtctggcacctgattgatgcggtagagcacggtctcgctcatccaggcgaacagctcgatgagcgcaaccccgggatcggagacgttgtggttggtccactcgggacagtagcgcgggatcaaacgcttggcttcgtcgacgatgtcctgaaagcggcgatcgtcgagttcgggagtcggcagccccactacccctcctctcgtgggatggtgtagaacggatagacgagattgcggcgatcattcgtcgcacgaagacggtaggtcacggtgatgtgcaccaggctcgcatcgttgtcgtcctgcgccacggcgacgttctcgacgtcgatccgcggctcccactgtgccagtgcctcacgcaccgcctgagccatcaaccccatcgtgttggcgttcaccggctcgaacaacagatcccagatgcggcacccgaacgccggacgcatgacccgctcacccggcgccgtggagatcacgacccgaatcgcggtatcggtggagccggttccgtcggacagcgcgatgcctccgcggacatcgacccgcatcggaaacgcgaagccacggccgacgaagccggggtcgctgacgctggcgtccgtcggatgctcacgcgtcgccacggcgcaccgtcgatctcatcacgcgagcacctagaggacgtcgggtcggtgacgcaacccgcgcgcatcgagttcgcgcgcgagacgccgctcgacctgctcgaccaaccagtcgaggaactcctcggcctgaggagcgctcgacggtcgaaccggtcccgcctcctcgaccatgcgaccacctcctatctcgatccctgaaccctcgccacctcgccgccgtgtggaccccggggattcggacgcggccatcatcgccggcgcagctcgcgtcgcgactcgggcatccgacgacccttgggacactgatgacgaccctcggggcaacgacgtcgatcgtgcatagagcgcctgaaggtcagcgagcaccgcgtcatgctcccgagaagcgagtacgtcgccaccgggtcccatgggtggcgcgagtaccggggtcaaccccgtgcccgacggctcagggttgtgcgcacgagaaccacgcggtggcggcggcatcgccgcgagcagacgccgctcgtgctccccatcacccgcctcatcgccgaccagtgcacgcaccaagcttcccactcgcctcgcgtgccgctcctcgtcatcgaggtgcggatcgtcgaacagtcggggggcgcgtcccgtgtcacccgaggccacgtgcacaagttcgtgcgcaatgacgccgagtgcacccggcgagcggtccacggggcgctcgagaaagatcgtctgcccgaccgtcgcggcaaccgtcccgagggcgcgcaggctccgacgagtgagcgggccgctctgcacctccaccggtccgcggacgcccagcgcgctggcgaggggttccagcacggccggaagcggctgaacggcctctcccggctcctgcgaacgctcccgagggccctgccaattcgacctgaccggtctcgatcctcggcgcgacccgacatcggccatgaccgcgtcggatgcgctcgcgaagagccgaccgtcggactcgactccgcgccccgcgacctgcgatggtcgaagctcgcggccccgaggtcgtgacggccctgaccagccaaggcccctcgtcgcgaccaccccatcactgagcgcacgtggcatcgagccgagcactgagagtccctgcgcgacccatccactcgatgcaagcgtggccacaccacgttcccaccgacgacgaccgcgcgacgccatggtcggccacgacccgagcgctcggcgaaccccaccgtgccttcggacggcctcgtcgtcgccgacgaccgagccgtccccagtcggagcagctggctcgccgatcggcacatcgaccctcacgcccctcgaagcgtcgacgcgacgcagttggcctctcccgcggaccgcatcgattgcgtgtcgacgagcggcgagtccgccatcggacagcccgatccccgagctccccgcccgtcccgccgacgtgcgaacgtcgctccgtcgaccgccggactcaaccatcgaacgcctcgcgctcggcacgcgagcgcccgtgctcctcgcctgggactcctcgtcgaatccgatcgaacgcagccagggggtgcgccgacggaccgggcgcagcggccgaccgggaggcgcgccgcgctcgcggccccgacgaaactcagaccgaggaaaccgcgacgtgtactgccagagcggccctcgctcgcccgccctctcgctgccgtgccgagccagtgcggcgtaggtctcctggcgtacgagaccgtcgagaatgaccgcagccgcctcccaaccagccgccagcgactcgccgaacgtcatagcgtggctcgccccgtccgaggttgcccctcccgccccaacggcttctcgatccgtgacggtgcgaccagctgtcacggcgtccaggagcccgaccgccgatctcggcggccgatcgcctccttcacgtggtgccccaggagctccccgtccttccaggccaggctcagggggcgatgctccatcgcgatgctgctggcgttgtgccccctgttcggcctggtgtcgctgcggcgacgcccctgccggagtcgtggccgtcggcgtcgaaggatccgagctcgatgcgggctccgcggacgcgccactgcccgccccggcctccccatccctcgcgctcccccgcgatcctcctcgacgagagggtgccacacgcggcgcacggtacgcactgcgcgatggcgaaggcctcgccgccgcgcgcggacgtcctcgctcccgatccgacaccacggtaccgacagctgcgacatcgggcacgagccgaaccggcaagacctcgcgtcggagcctcgccaagcctccccctggtgcgtagggggtctgctgccgagccgtgacgcgaggaaggcggcccgcgtgcgccccaaccgcatccgccagcgccgacgcgtcgtcctggccctgaccagcaagccacagccgcaggaacggatggccgagcggacgaaccgggcgatcaccggtacccgccccaatcggcaacgaagggccaatcgccgaccgcagcgagagaggccgaccgacgatcgttgcgtggcgcaccgaccgcagtgcgagggcgccaaccgacggtcgaggccgacgcacgagcgaacgatgccacccgaaccgtcgctcaatgccggccacgaacgtcgacacggtggcgtcgtggccgctcatgatgcgaacgtcttcgacgtgaagccctggtgagcgacctcgatctcctccatggcaggaatcccatgcgcgtcgaccgccaacttcggaccgacccaccgcacggcgaatgcccccgtgatctcccaggagcgcagccgacgaccgtcggaagcgatcagcgtgatcgcagccgtcgatcgctgcagcttgttctggttcgccgcgaacgccggccccgaggaccgacgaacccaatcgaacagtgcgtccgagcgacaaatccctcgccgcagcacgatattcggccaatggatctggcccgggaacttgtgtgtgaagccgttctgtccgccttcggcgaactcggcgacctcgacggtcatctcgagtcccgacacctcagcgaacatgccgatctcggtgccatcgacctcaagaaggaagctggaggagtcgggaatatgcccatcaaagcctgactgcgtggtcacgagagctgtcgtacctcctcccatgctcgtgcgttcagcgcggcgaccccttggacgagcctcacacggtcctgatgctccagatcgagcagatcgtcaagatcccagtgcaggtggtacgccaggtagatcacctcttgccagaggacgtcgatcggatagtgcttcatcgcccgttctgcggcacctcctcgatcgctgcgcgccgcccaccagcaggtggtcgcggaggcgactccgatcccgcggcagccgtcggaggcgtcgtctcggacgccgtagtctcgggtcgaggactcgtctgcgactcggctcgctcctgcgcggccaagagcgcctcgatgtcctcttcggaaccaaagttgatcacgccgtagaagtcctgcaaatacgcgaggtcgaccgcgaagaggtcttggatctcgttgggtgtcacgagctcgagatccccaagccgctccaccacgcgcgccaagaccagaatggtcaggcgcggatcgtccgggccgctgatcgtgggatcacggagcggctcgagctcgtcgcgagccgtcgcaaggcgcatcacgccacggcgacgaacgaccccttggtcgtcgatgtagcctctcggcagaacaaactcgtagcgcgtccgcacggcctacttcttgcgctcgagcttctcgtactgcaaggtgatggtctcggtggcgacgtcgttcgccgaggcctcgaggctggcgaactcgatcttcgagggccaggcgtcgtagaagttccagcgggccgtctccgagagcgccgaatcgtagacgacgatggagccgtggcggcgaggcttgttgcggttctggacccccatgcccttcgtgcgcaggtcgttgaaccacttccagatgtcgtcgtcggcgacgttcagcggggcgacgcgcttcatggtgagctcgccgttccacttcggcttgctcatgaccttgtgctggacgagctgggcgcccttcgtacgctcgttgaagtcggcgacctcgatctcgacgctcaggccgtcgatgctcgtgacgttggtgacgtaggcaccgtcgatctcgacgaagaagttcgtcgtggtgagcggatcgttcttgatcaggttgaactgggccatggtgctcctttctccttagccagcgagctgcttgtgctggctgatgcggaagacgacgaactcggcgggcttcaccggggcgatgcccacctccacgacgagacgaccctcgtcgatgacggcgggagggttggtctcggcgtcgcacttgacgtagaacgcctcttcgggcgaggcgccaaagagtgccccgtcttgccagaggccgccgaggaaggcggtgagggttcgggtgatgccctcccagagggtgacgtcgttcggctcgaacaccgcgaactgcgtgccgtcgaggatggtggtctccaccatgttgaacagacgccgcacgttgatgtagcgccagtcgctgtcggaggagagggtgcgtgccccccagatgcggatcccgcgcgtgccgaaggggcggatgcagttgatcccgatggggttcaagagtgcctgctcgttcttcgtgatggagcgctcgacgtccaagcacccgcggatggtgtcgttggccggggccttccacacgccacgggtgtcgtcggtccgcgaccacaccccggcgatgtgaccgctcggcgggatgagcacctcgctctggccgttggtgccgacggggttctccactcggatccacgggtagtacatggccgcgaaggccgagtcgtacatggcgacgtcgctgcgccactcgcgcacctgctggggggtcatgccgggcggggcgtcgaggatcgccatgcggttgccctggcgctcgcagtggccgatgagggcggtctggacggccttccacatggcgaggtcgatggtgccgtcgggacgggtcgccgccgtcacgaggtcggggacgatcaccatggtgacgtcgtcggcgatggtgaggccattgatgccggtgcgggcactctcggagcctgcgaagcgcttggggctcacagggacggggtgcggggccggtgccacgaggggataggtcccgggacgcatcacctcgagcagcgacgagaggtcgacggcgtcggcgaggtccacgcgcacgcgcacggtgtgggaggcggcgttgacgaccgtggcgacgttgcgctcggagtcgtcgagggtgaggttggtgaacgactcgatggtcgtgccgtcagggccgacgatgtcgaggtcgaagggagccgggccgtcggcgtcggcgtccaccgtgcgcacgactacctggagcggagcgccttgttccaggctctcgacgtgcaccggggagccgagggcacgatcggccgcagggagggaggccgtcgagggggcgtcagcgggctcggtgttcgggatccgaacgatgtaggcgatcgtgccaccgttctggaagaagccgtagacgctgagcggcagcatggccccgggggtgaagctgccgtagagctcctcgaactgcgtccagctcgtgacgagacgagggcgggtgccctcgggatcgctcgggtcgtcgttcggggcacgctcggtgaagcccacgaaggccgcgatcgcggtcggggcaggcgtcaggctcttctgcgcagagggcatttcctccacgtagaccccaggagcggcgtacgtcggcacgatggttcccctttccctcgccctcgagctgtcctcgaggaggttcactcactccagacactcactcacagcactcgcgaacgacacggcacgcatgcccgggggccaccaccgcaggccatctgcgagctcgcgtcagagcgacctggtgacgtccggcccgcaccatccgacgtcaacgaaacgcttcgacgccatcggtccgacagggcgttgccacaagaccactcagcgtggccgataccctccacacacacgtacttgccacgtgacgttatcagagtgtgcgggggtggtcaacagggggttgtgaactgctccagcatgagtctgtcatacaccaagtacgtgtgtgttagtgatacagtggcgccgtgaacctcaccgagtgggcacgccgccagggtatccaccctcagaccgcctacaaccggttccatgcaggcacacttccggtgcctgcggtgagagtgaagcagcggaccatcctggcccagccagacgctgccaccactaccccgagggacatggtaggtctctctgcccgcgtctcttcgtatgaccagcgaggtgatctcgaccgtcaggtcgcacggctgaccgagtgggcagcgaaggtcggcctgccgagagcccgggtggaagcagaggtcggctcggggatgaacgggtctcgacccaagcttcgacgcctcctcgctgatccgcaggtcaccatcatcgtcgtggagcacctgaccgcctggctcgcatgaatgtagaactcgtcgaagcagcacgctcggcccatggccgcaggctcgtcgtgatcgacgacggcgaggtggacgacgacctggtgcgggacatgaccgaggtgctcacgagcttctgccccagactctacggacgcaggtccgctcgtagccgagcagagaaggccctgcgatgtgctacccaggacatggggccaaagccccctccaagaaggcaatgccatcgcgggcgtctcacctgaaggagcagagcaagccgtgagcaagcggcttcgcgcgatctctccgccgttcgtggtagcgccacccacaggtgttcgtgtgcgcaccaggcttcaggtgactgacgtcgatgcagcggtcctcatggcccttggtacctacctcggctcccttgcatcgaatgacctggctgagcgctgccgccaaggagagctcgatgccaagggcaagactgagtctcgtcgtgagcgcaaacgagcgctgacggccctcacgtcctctcggtgggcgggaacgatcaccagaacgagcgaggatgccttccaactcgccatgggcaacctcgaagccgaacaacggagcctccgggctcggatcgcccagattcgccgtcgtctcgcggtgcctgcgggaacacgacgtggacgttcttacgggtatcccactcaggccgagcggttccagaagcaacgccgtctccagatcctcgaacaccgcctcgaggtggtcgaggcccgcctggagagcgggcgggtgtccatctgtcgtggtgggaagcacctggccaacgtccatcaccacctggacgaagccggactgactgacgatgcctggcgagagcgctggcgagctgagcgctggtttctcaccgcggacggggagaaggacaagtaccttggcaacctcacgatccggtggcacccagatgagcagtggctcgacatcgcccttcctagggcgcttgcccacctcgccaaccggtcccgaaaccgctaccgactctcatgcccgatcagcttcccctacagaggggatgaggtcgcagctcaggccgtgaatggggccgtgcgctacgacattgtgttcctgccgcagaaggggcgatggtatctcgacgcatcctggagataccccgaccgtcagccactcaccatcgagcaggtccgagagcatcgggtcatggccgtcgatctgaacgccggacaccttgcaaccgtcctcctcgacccgtcgggcaaccctgtcgggcgaccggccaccatccccattgtcctcgacgggctgccagccaccacccgagacggccacctgcgtcaagcgatctctgacgtactcaccatggcgaagaccggcggtgctcgggccatcgtgatcgagaacctggacttcgccgagtccagggacataggtcgagaactgcatggcaaccgaccatcgcgtggcaagcggggcagacgctttcgccgcctcatcgcaggcatccctacggcgaagttccgtaacctgctcatccagatggccgcgaacaccggaatcacggttgtcgccgtcgatccggcctacaccagtaggtggggcgccgaacactggctcggcgccctccaggaaaccttcatcgatatctcgggccaccatgcggcggccctggtcatcggaagacgtggacttggacagcgagcacgacgaaagacgaggtgtgacttgacccgagcagagcatcgggaagagagagctacccgcccggtcgtgggggccacgggtgacgggggaccatcactcctgtccaggcagcgcatgaggggacttgggacccgagaggccagagggcagccacagacgtggcagaagacccgaagggccgaccggaccaccccggttacccaggtggcccaagaccgttcggggccacccacgaagcgggacagagtttcgctgagtgtctaggaacggtgaggagatgttcacgatgaacagcccgcactggcatcatcacagcaccacggtggggagcacactcgacggctttctcgtgactccacccccgcctgaaggcgggggcttcgggtgcgctgttcacgcacctgcggttcctaccatggcaggaaccttcgcggaaacgccgaccgccttgcgacgatcgcgaacactcgaaccttgctagagtcagtggtcactggccaccttggccgatgctgcggcgcgcggccgcagaagggggttggcgatgccttcctggtttccatggcttcggcgtcggcggcccgccgcaccgcaagtatccgcacagacatcccgtcctcagtggcagcgtgtgggcacaccctcaaccgatgggcgtgcctcgcgaccgtcaccacaacaggtgctcgccctccaacggcagctcggcaatcgcacgacgagcatgcttgtcgacaactccggatcggcgccgggtgggaactacaacaacaccgagaaccagcctctctacgaggacctacgccatgtggtcggcgaggggcaacagcacgaggcgccgggtgggaactacaacaacaccgagaaccagcctctctacgaggacctacgccatgtggtcggcgaggggcaacagcacgaggcgccgggtgggaactacaacaacacccaatcgtcaccttcgcagtcccgcgcaccaagctacggcaatgacatcaacgagttgctcgcaacagtatcaagcaggccgccgtcggtggaggcccaagagaaggcaacctccctatgggcccttgacgcacacctgcgtgccaagcacggcctcgcaccagctttcccctcgacgaagcagctcgccatgcgcgagttcaccacgacgaagtacctcacgccgctcgagtcgcagtcgaagaccctcgcgtttcgcggtggcctgctcatgcgccgtgtcgccccgggccccgaccagccaccgggtaagtggcaactcgagccctatgacaccacggacatccagaacacgatgcatggcaacgagtctgagcgaggccaagccctctacgtcctctcccaaggtggcacgctgctctcggcaccgggcaaggtacaggagacgcatcactccacgctcctcgcaggcactgaggtggcaggggctggcatgatgcgagtcgagaacggcaagatccgctcgatctccaacgcgagcgggcactaccgtcccacggccgactacttgcgcaacgttttcaaggtattcgagcgcaaccacgtcaatctcgacgagatcgaagtcgaggaagccctcaactccacctgcaatcgatctcacctgaacggtcatcgccgcaactgggcatcggcgacggaatggctcgccttccacgacgaaccggccgaggacacgcaaggtccaccgccacagtcgatcggttaccagtcgtccgcaccgccctcagacgagtagacccggctacagctcggggctgtcgccgtccacggtgcgcgagccgaagttacgcggccagagacgctcgcgttcgtcccgatgacggtgagcgctccgctgccagagctcgatccagctccgtccttctggaacgaacgtacccttcgtccggcgcgcttcccagaaatccgttgcagcctcgcgaccggcaagcgcgagagcatcggcgatccgagcggtgaacgcaccgggacgctctccctcgcgcgccgtgagtggttctccaacgacgatggtcgtcgagcccggtcgcaggcggcgttgtcccttgccgaggatctcccacgtgccatcgatgaacaacggcacgaccggtcgtcctgttcgcagcgccacttgtgctgctccagccttcggctcctgtggcaggccatcgggagttctcccgccctcggggaacagaaggagattccagccctcctcgacgagctgctcggcgagttcggctgagcgccgagagactcgctgccgctcgatggggatcgcaccgagcaccagggcggaggcgaacgccttcgagggacgatcgaagaagtagtccgctcccgcacccacgacggtccgatgccgcaccctcgccggcagaaccgacagcacgaccggggtgtcgaggtgactctggtggttcgccacgaacacgaccggctcatccaaggcgtcgagaacctcgcccgcaatgagacgaggacgcgcgatggctcgcaccccaggtaacaccaccccatcgagcaagacggcgcgagcgacccgcaccgagtcccgccgggcaaaggacgtgtcgaactccacgcccgtccgcgcagttcgatcaaacggaagctgcccaggcgggctcggagctcgtacgacgaagcggacggaagcgggcagcttcaccgctgtccctccgatacgtcggccatgaccagcggcggactgtgcaggtgggtgatcgatgggttggggccgacgatcgaccgcgccatctccagagcatcgtcgagggtgctcgccgcctggaaaccgaggcgacgagctgtcttcggatcaccgccgagaatgatcacgccgccaaggtggtcgagggcatgtgcgccccaataccacatgtagaacgggtgcacgccgtggtaggcgttctgcgtccgatacaaatggatgtaccaggggtcccgcgcaaagctctcctcgtactttgcctcgatcacgaggggatccgtcgtctcggagagcacctggtcatagaagtcgatgtagctcgggtggaacgctggatcgaactcgggcctcgtcggatgcgccatgatcaagactccgccacgacgaaccaagggacggcctcgatacatgttgaagagatagccaagtcctaggcagtagacgaggatggggttcatgatcgagttcacgttgtagggcccgacgaagggaaggcccatggtcaagatgtcagcctgcccctcgacgggcacgagctgctggcgatagacccgctcgatggtctgctcgtgcaccgcctcgacctcaccggcggcgacgcccgtcaaaccgtagggcgatcgaacgcgatggaagatctcccgcgcgagatgcggcggagtgcgtcgcaaggactcggcgacggcgacgtagctcgctcgatcgcgaaggtcccactcccactcccgtcgattgaggaaccgaaacgacgatggaaaggtgttggtgttcagcgtggtctcgatctggaaaatacgtatgccgctacgggcgatgagacggcccatgcgccagttggaggagtgcagctgggagttgtgtcggtccatgaacgaccgcgagtgcaccatcgtcgtgacgttgtgatgatggcggatggagtcgtagctcgcaagcccagttgcaacactcttgtggcccccatccatggagacgaggttgatattgacgtacacgagcaagtcgctctcgaccgcacggcgattgagctcgaccagctctccctcgtcggtatggccgacgacgaccatgttggccttgtcttcggcatcgtgctgggtgatcatcccacgcggtgcaagcgcatcgtagacccgacgaccgagggcatgtcgaagttccgactccgtcatacgccgatgcaaggccagagccgcgacgagctggatatcctcgacccccttggcggcggcgagctcgagaacctcctcaatgacgaggctgcggacatcgggggcagccatctgcggcagcgggagcgacacgtcgtcgaaggcgatcgtcagtcgcatccccggaaagagcagcgcttcgagcggctcggcatcgatcgggtgcgccagcgcatcgcgaatcgccgcacgagcgtctcgaactgccggcagcggatccggaggatacaccacccgtgatcccgcagggagccgctccagccggaaaccctccccataccagaacagggtcgggggcgtcgctcggtctacttcgagtacgaagccaggtcgatatgccacttagcgtgccttcctttggtgaagatcgaagacgaccttgattgcatcggcgcgacccccttcccgagccttcgcgatggccgtgacgtagtcgcgcaggccatagcgatgggtcacgagtcgtccgaggccaaggtccgcggcgagacccatcgccagatcgaacgtgcgtaccggaccggcgactcgtcccaaggactgggcgatgtcgggttcgagcacctcggtgccgtaggcgtatgcgccgatcagtcgcacctcccggtgccacaagggtgcgagatcgagacgttggggcgacggcatgcccgccacgatcacctcgccacccggtcggaccgactcgatcgcgagctggatcgaactggcagagcccaccgcatcgatgacggcatcgaaaccgtcgccgaggaagcgccctgctcgcagtgttcctcgcagacgacgtgcccgctctggtagctcgcgctcagtcacgacacgatccgcaccgaacgcgctcgcgagctcacgttggagcgggtagcgtgcgacgctcgtcacgctggcaaagctctgcagccgagcggcgacggccgtcgcgacaaggcccacggtgccagcaccgatcaccgccacatgcccgtcacgccgaccgacgctcaagacggtatggagaccacacgccagtggctcgaccatcacggcgtccgcatcgtcgacctcgtcaggaaccgcgtgcaacgtggcctcgtgcgccacgaactcgctcgcccaaccacccccggtcgaggcacagtagccggtctggatgcccggctcgagatcgccgaccgcgatcgacgcacagcgctgcgtttcacctcgttggcacgcgtcacacagcggcacgccccgcacggcacacgtcaacgccggctcgacgacccaccgacccgatcgaccctccgcgtcaacgacgacttcgtgccccgggatgaagggcagcgagacgagaggctcgaagtagcgcgacgtctcgaagaacaccgatgcgaggtctgacccacagatcccggcaagccggggccgtacgcgcacccagttgggcccaggaagctccggcgggtcgacgtcaaccaacgcgagtgggccgctctcgatcgcccgtcgcgtcgaggatccagcgagcagacgagccgccgcgaaccgcgctggccgacgttcgacctgcaacgccctcatcgacgacctccgatgggcagcatgagcgacgggaacccagaggcacgttcccactcctcgatgagccaaccccgccgcttggcaagcgcgcgcagcttcgcatccggattcaccgcgaccgccgtacccgctgcttcgagcatgggcagatcactggtggagtctgcgtaggcgatcgtgtcagcgagcgggatctcgtagcgggccgcgagctgacgcacgaggtcggctcgtgcctccccaatgggcagcgtcccgggcaccgtaccacttaagcggccgttcctctcaggcatgtccagggcgatgagctcgtcgaacagcgggcggaacggctccatcgcaaagcgcagcgcaccggtgacgccgaccgtcacatgaccggcggcacgatgttgccgcactctggcgaggccctccgggaacgtcttgcgcaggaggtagcccgtcatgagatccggagccagcttggcaagctcggcaggatccgcatcgcggtaacgacgatagaagtaccggaggaagtcggagcggtcgcggccgtcgagccgcaacagcttcggcgcctcggcgagcaggctcgcgacgagcccgaaccgatccacggggcgcagcgcactggtcgcgacgaaggcgaacgagtccaccacgttcgctgcgaccaaggtgttctcgagatcgaacacggccaggcgtcgcccgcgcagcagaccctcgcgtaggcggtcgtctcgggagcgtcgcggaccgcgccggggattcgtgcgcgcgcgagcgtgctcgaccacgctcggcaggtggacgtcgaggatgaagtgccgccaatcgatggccgccggatcgacgagcacgccgtcgtcagcgctcgcgagggagacgagttctacgagccgttcggacccgtacatcgcctcgcactcggcgtaggcaccgtagagctcgacgtaggaacgagcccgctcgagggcgtcctgcgtctcgacgagaccatcttgggccgagagcatgggaccgcgaagcggcagccgccccaggaggccgagcaccgccccgacggcccgcctggtgcgctcgagacggcgttcgacctcccctctggctgggtaggtccacgaaggtatcgcgatggcttggcccttgtcgtcgtagagcgggtgttcggcgaagtactgccggatgagcgagaccatcacctcgtaacgaagcgggttcctcgtgcccgaggccgcgtggtagtacgccatcgcccgggggggatgagcagcggcgacgagaaccgcgccgacgacgaagtccacggggatcacgtcgaccaccgtctcggccgacccagggaaatcgcgcagcagcccccgcgcgaacgagatgatgatgggctccgccatgcggaaccctcgaatccaacccggtcgcggctcggcgtagctcgactcgatgatcgaggggcgcacgaccgacaccggggtgcgctgacggcgctcctccaggacgcgttccccgagcgccttcgtcatggcgtaggcgtccggccatcccaggctctgcgctcgcgcccgacccagttcgaccatacgctcatggacccagtcgcgtcgaaagcgctcggtgcgttcggccacgatcgcgacccccgcagccccgagctccgccagcgccttgcgacggaacgtttcgagccgctccggctcgcgagaacgatgctccgtctctcgacgcagagccctggcagcctcgacctccgcacgccaatccacgtccggatagtgcggctgcgtgcggagcgacgcctcgggtgcgtcacccttgcgcgagccggcgacgtaggcggtcgagatggcgacgaagtggcctggcgcgagatcggcctcggcacgtgcctgctcgtacgcctcgagcactctcgccggcccgagcaggttgatctcgacggcagcatcgagtgtcgcgtcgaagctcaccgtcgccgcggagtggatcacgatgtcggctgcgccaagcaccgaccgtcccgcagggtcgagaccgagaccatcacggccaacgtcaccctcgacgagcacgacccgacgagcagccatgtccgcaaacgcatcccgaccgagctcggctcggagtcgatcgaagcagctgttgccaagcagctctcgacggaggcgctcctcggcgctcgtcgtacgaccgcgtcgaatcaagaccgcaacacgagtctccgggagcaaccgaagaacggactcgacgatggccgtcccgaggaagcccgtcgcgcccgtaaggaagatcaaccgacccgccaaggactcgcgcaacaccccgacctagcctcctcaagcccccaccgtggggctcatcaagcctaccttcgggcactcacgacgaggacgtgccccgacgacgcaccgtcgccctgcgcttgggcggggtgtagcgcttcgatgcggttgtcggccgatgcggcaacaaggtcccttctgtggcggcaccatcgccagtcttgcccttgccgctgcgtcgtgcttcacgagcagctcgacgagcagcgacgacctcgggattggccttgaagccgacgaagacgccccacgcgaggatcgggaatgcggcgatgacgaggttgccccaaccggcgccgatcgcgacgagcatcgcaaacccacccgcgatccgtcgccggtctcgctgaatcatgatggccgtgatcgccatcaagaccagcccctcggcaagaatgaactcagggttagcgaggatcccgtggcccgtgagcttcacgtggccatcgaggactgggatccacagcaccgtgtacaccacggcctcgatcagcacgagtgcgtagccgatctgtcgttctcgacgagagagtggcatggcacggcgaagggctgcggtcacgggaccagtgtagtgcttgctactgcccacacttggtccccgcgaccgcgggctaccgatccgtcaccgaagtgtggcccttccgtcgagcgcgagcaaccgcaccgtcacccagggctctcacgctggaagcgtccctggaagacgacaacgggaggtcactgtggacacgcatcaaccgccaagtccgtatgaaccggtcgacgaggctcgactgaaccgcttccactggcggtcgctcttcaccactgggatgggcgtgctcaccgacggctacgacctgtcctcggtcgggatcgtcttgccacttgcgctggcaagcttccatcagcactcactgaccggtgtcgagagctcgctgctcgccgggtcagcactcgtcggatctgccgttggcgcgctcgccttcggcttcgccgcgaaccggggccgcaagcgcttctatggtctcgacgtcacgatcatggccctcgcagcgctcgctcaggccttcgcaccctcgatcacctggctcatcgcgatccggttcatcctcggcatcggcgtcggagccgactacgtcctcagtccgatgatcctcggtgagcacgccaatcgccgagatcgcggcaagatcatggcgctgggcttcggccttacctggaccgtcggcgcggtgatcgcaagcatgctctacctcatcctcgagggagcgggcgtcgcgcctgatctcgtctggcggatcgtgctcgcggccggcgcactaccggcggcatccgtgatctacctgcgacgacgccttcccgaaacgccgcgctttctcctggccatccgccgcgaccccaccgcctatgcagccgtcgcacgcgaagccagcggcgatcgcgtcgcaccgcccacgcgcctcggcctgaacgaggacctcaagtcattcttcgcacgtcgttggcccgccgtcctcgcagcctgctcactctggttcttgttcgacatcgtcgcctacagcggcatcctcttcgggccctcgttgatcgcgaaggggatcggcctgacgcccggaacgttcaacttggccatggagctcgtcgcgacgatccccggcgccatcgtcgggctcagcctcgtcgatcgggtcggtcgtcgctggatgcaggcgctcggcttcgccggcatggcagccttcctcgtcatgttcgccgcagcgcacgctgcgatcgccgcagcaccgcttgtcggcgcattggtgtacggaggcgtcaacttctcccagcaagcaggtccaggatcgatctcggcttcggggcttctcggcgtcgaactctcctcgacacgagcacgcggactcgtccaagcgctcaccgtcgcctcgggtcgtctcggtgcctcgctgacgtcattcgtctttccagcactcttcgcgacctggggagaagatgccgcactcgtgttcctcgcgggggtcgcgatcctagcgctcgccatcacgctgctcgcggtccccgagacagcgcgacgcaccctcgaggagaacgcaggcgaactccttcccgccggcgcagcggactgatcagacccgccgaggcacgcaccgacacgctcagctaccgctcggcccgcccgagcggtagctcgtgtcgcggggcctcgatcgggacagcccgcgaagcgcgctcgaccgcgccccacgcgcgtgcacagcgtcacgatcgtcacccacgtgtgctcgtgtgtcgtaaggcttcggcttgcgccacgccgcggcccctccccgaccactcccacctcttcgagcaggcagaaccgggttggacccgcccgctaccgcgacaggcgtcccacgtcagggctcaagcgccaacgggccacccgatccgaccgagcgtggagcgaaggacccgtcgtggcgatcgaagcgcggttccaccgggtgtcgtcgcaccggtgacggcgaccgcccaccacgatcactcggcggctccgggcaagtcgagctcacgaagccgcaaacgggtccctggtcgggtccctgttcggctccaactccaacgtccgagccagctccatcgcggtctcatccccgcagagcgacgcaacgagcgcaaccgtcatgtcgagaccagccgcaatgccagatgacgtccagcgatcacgatcctccacccatcgagcctgggcctcccagcggacctgcggcgcttgctccatcacccacgccaacgctcgcttgttcgaggtagcccggtaaccatcgagcaaacccgccgcaccgaggagtgcagagcccgtgcagaccgagctgaccaacgttgccgccgacgcccacgtacgcagccatgcgaggaagtcatgatcgtcgaccagctcgcgagttcctctcccgcccggcacgagcacgatatcggcgactggagcatcagcgtaggtggtatcgacacagagtcgtggtccttgcgtgctccgtaccggtgcggtcgtcggaccgacgaccgcgatcgcgaactggtccgcgagcgcgccgaggagctccatcggtccacacgcatcgaggagctcgaaaccatcgaacaccaccacggccacctgctgcgacatgggatccccctcgactcgacacactgacgttaggccacggccgcctcctcgcggaccgaagagagctcgtcgccgacgcaagcctggcacccgagggccgacgacaggcagatcgtgtcggttcactcgacccagcgtgcgatggcgtggccgcctcggcgaggtccatgacgcggtggcgggcgacgagctcgcacgatgagctcgcgaggaaggtcccggcgacggcgttgtcgcaacaggccacgaccgtgcccacccatgccaacaccccgtctgccaccagagcgtccacacgttcgcgacgagccgtgcaaccttagtcccgaggaagatcgcacccgtgaggccaccgcgagtccgccgcgcagctccgatcacctcgatcgccagctcacatcgagcatgcgctgctcgagcaaccagcccttcgtccgcctcgagtcggctcaggtgcgattgcgaggcggctcgatccctcgccgcgtcggacgtcggtgaggccggtcgattccgagtcggcgcagatcacgctgacgggcatcacgtgctcgctatcctcgccccttgggcgatcgctggccgtcgcaggcctggcgtcagatgtcgatggatcgtgctgggcatcgtcgcggagagccgatcggccccgtcgtgcaaggcccagcgcccagagcccactgtcgcgctctcacgccgagtcgggcatcgctcgcttcgcacgctcccgctccgtgtcgagctgcttgcgctggcggcagaggcagatctcctcctcgcggtcggcgggctcgagcccaccgtccggccgtgcgtgatgtgctctgcggacccagctccaagagtctgccctcgcgccgagcccaccggaggcatcggcactgcgcggggttggtcgaggaccagtgccgcgacaagcgcgacggaactggtaggagcagcggcccgccgacgtcgagcggaaccgctgcccaggagtggttcgtcgtctgtgactccttcgttccgggcccagtacgtatcaacccggcagaggaacggcggcgaggcgagtgctctgtgactcgaggctcgcgaccgcgctgcctcgtgcatcaggcacactccccgtcgctcacgccagtggcgccgaggcccggtgaccactgcccacgcggacggccccgagcgcgagccccacgatcgcgccgacgatcgccacgccgatcgcgacgatcatggccacatgcagaccgctcatgaacgcagcgtgcgacccgttggtgacggcggtctgaacaagggccggtacttgtggaatccgcggtgcgagtccttccgcaatcaaggggcgcgctggtccgagtcgcgttgcgacgacgccaggcacacccgctgcctcgagcttggagatcagtacactgcccacccgattcgagagcaccgaaccgagcaccgccgttccaaggagcccaccgatctgcacggcggtcgactgcacacctccggccacgcccgcttcggcctcaggcacgttcgcgacgatggtatccgaggtcgtcggcatgacgaggccaatacccaatccgacgatgacgaacggaagtgcaaggtggacgagataggaggagctgaccccgagcgtcgtgagcagtgcgagcccaacggcgatggcagccataccgatcccgaccggcacgcgcggcccgaaccgaccgttcagcgcagcaccgagcggcgccccgaccacaaaggaagcggtcaagggcaaaactcgcacgccggccgctacggggctgtagccgtgtacctcttggagatagagggcgacgaagaacaccaccccgaagaaggcgaagaacgacaagatgaccaccacagcggacagcgagacctgtcggcgtccgaacatgccaagtggcaccaatgggaagcgagctcgcccttcaacgaacacgaagatcaccgcgccaacgattgccaacccgaagaagatccaggtgcgacccgcgagccatccccagctctgggccttgatcagcccgaagacgagggagaacaacgtaccggcaagcacgatggtccccggagcgtcgagtcggtcgggttcttgttcacgtgattcggcgaggacgaacaggccgaggaggatgccaatggctccgacgggcacattgaggtagaacaccgactgccacgagacgttctgcaccaacagcccagccacgatcggtccgccagcgatcgccaagccactggaagcgccccagataccgatggccgtgttcagccgctcgaccgggaaactcgcacgcaagatcgcaagcgtgctcggcatgatcagcgcaccgaaaccgccttggatggcgcggaaggcgatgacccacccaatggaccccgcgagccccacacctgctgacgcggcggcgaagcccagcatgcccaccaagaaggtggcccgtcgaccgatccgatcggcgagcttgccagccgggatcagcagcaccgcagtggtgagcaggtacgcgttcgtaacccactgcagatcagcgaggttggcgtgcaggtctctcgcgatgaagggattcgcgatcgccacgacggtcgcgtcgagaccgaccatgatcaccccgaaggccacgctggccagggcccaccaggggttcgcgcgaatcgtgcgcttctcttgtgtctccatgagcttgcctcctcaccggccgtcgacctgcgccattctggcagccgctgccagtctagcaattctgacagtcactgacacttccaacccgatgctcccgcgatgcattccgccgcgcgtacactgatgattccggaggagccatgacccgcgagcagacgaaggcgcgcacggaggcagagcttgctcgggcagccgccgaactcttcgcacgccagggcgttgcccagacaaccgtggagcagatcgccgagcgagcaggcgtgtcggagcgaacgttctttcgctacttcccgaccaaggaagatgcagtcctctcgtacatctggttgaaggcagacgacctgcgcagtgccttcctcgctcgacctgcgtccgagtcactcgccgaagcgttcctggcgtccgttcgagccaccaagacggacgacgaggcccaagcgaccctcgaccgcgagctccttcgcctccttcgcaacaccccgaccctacgggcgcgctggctcgtcgccggatgggaaaccgcggcagccttcacgccgctcgtcgccgagcgactcgcctgcgagcccgacgcgctcatagctcggctcgcgacgaatgcgctactcgttgccatccagacagcgctggacgtggtcggagagcatggcgcagattttctcgaggtgctcacggacgccatcggccggctcgccgatggagcgggactcgctacgagaccgctcgagcgcccatcagactcgcaacgatctggctgaagtggcgagctgcgatcgccgcaccgctctcgacgaggaacgccacctcgggatcgcgcaggcggtagcgccgctgacgaccatcgcgctccgtcgagagcaacccggcgtcgaccagacacgacaggtgcaccgacgttcgcccctgcgacagtccagtgatctgtcgacactccagcgaggtcaactcgccccgttccaacagggttcgcaccagccgcacccgcgtcggatctgcgagcgccgcaaacaaacgtgccagcacggcgtcgacgtcggcatccggacgctcgtccagtgcgacgccacctgtgagcgctatctccctcatgacacacccatccccaccagtcgatcgagcatctctgcgaggacctccggctccgtcgccacgttcacacgcatccagtccgaacgtccctggagatcgaaggtctcacccgctgagacgacgacgccagcgcgacgggcccacgcagccgcactctctgccccaagaccgagcacctgcacccagagcaggtaggtgccggcgggaacggacgtgcgcatccgaccggtgcgaacgagtgcctccgcagctgtctcgaggttgtcctggatgcggtcaagggtggactccaaccactcgccgccctgctcccatgcgacggcggcagcgagcagccccagcgacgtcggcgaactgcgaaagtgtgcatcgacctcaccgagcatctgcgcaacgcgtgtcgagccggcctccacgtgagccgccttgaggcctgcgatgttgaacgtcttcgttgccgcggacagaccgactgaccgctcggttgcggcatgatccagcgagagccagggcacgtggcgcacgcccgtgcgcacgatatcctgatggatctcgtcggcgatcacgaccacgtgatgtcgctcgacgacgtcggcgatggcggtgagttcctcgcgtgtcgccacccgtcccgtcggattgtgcgggttgcagaggatcagtgccttcgcccccgacgcgatcaaggtccgctcgaggcgctctgggtcgagtcgatagtcatcctcttcgcgaagcggaaccgtcacgacgcgacgcccgagcgacaccggcgtcgagaggaatgggggggtacgacggcgtcggcaccaccacgccactcccgggctccgtgagtgtccagagtgccaaggcgaggccgcccaggacgtcgccgaccaggagcacgtcccgtggctcgtagccggtgcgcgccttggaccagcgtgccagtgccgatcgataccgctcgtcgagggctcccgaggcgtagccgacgtcgccacgcgtcaccgcatccgccaccgttcgccgcacgacctccggagggagcaagtccatgtccgcgacccacgccggtaggagcggcgagggtgccagctcccacttcacgctcaggggacgacgggcacggagcgcgtcgatgactcgccctcgcgccgccccggtatcgatcggacgaccattcgagccgtcctgagggagatcgaactgctggtgagccacagcatcatgctacgcatcgacgatccgcccgcgagagtggcaggtcccccaaagggatgatgcgaatgtgctatccggatgcgcgggactgcagcgcagctcgaatccgcgcatcggcgagctcgcgccatgccgtcgagggttcgacccgcggcacatgcgcgcgctcgagcagccaagcggcgaggtatggattgcgtgcaaggaccgggccatgcaggtaggtgccgaccacgctgcctgcgacgaccccgtccacgcccccaacgccgttcccgacaccgacgagcacccgaccgagcgggacggcatcaccttcgagcgtggtgacgccgcggtggttctcgaagcctgtcagataggccccgaccgagatcacgggactcgtcagaacctcgccgaccgcacggcgctcgccgctcgccgaccgaaccggcaagagcccgagtccttcgtgctccgctccctccgcggcaaacgagcgtcctaggagctgcaggcctgcgcacaccgcgagaaccgggcgcccctcctcgacgacggcacgcagcgtgccatcgcgcgcaagcagccgagcggccagcacctgcgggccgtcctcaccgccgcccaagaggtagaaggcgccatcatgtggcaagggacgatccgatgacgcatcgacgacctcagcctcgtgaccagctcggcgaacagcagcggccaacaccaacgcgttgccacggtctccataggtcccgagcaggtcggggtagacgacgacgatgcgcaccatcatggcacggccctcgccgaagcactcgcagccaaggtggtatcgcggagcgcaccgagcgcacgcagcgacgcattggcctcccaaaacgctgtgtagttgccgacgaaggcgatgggcttggaagcgtcggcacggcgaagcgcctcacggagcgaggaggcctgccaaggctcgtgcccggccacctccagacgcaaggcgagatcttcgacccgtcgcccacacacgatgacgcgtcggggcgcgattcgctcccagggcgcatcccaaatccacgaggtgtcacgaccatcggcgatctcggcattgagttgcgcaatcacgtcaccgtcccaatctgcgagcagctcgacgagagcatcgaaccccgctggattcttcgcgagcatcgtcatcacacgaggcgtaccgggcagctcgaggacccgccagtactcgaagcgtccctcgacctcgagccgtcgacggccaaggccgcgcagcacgtcggcgaccggccgacgttcgagcgccccgatcgcaaccgccgcagccagcgcattgaaacgattgaacgtcccaggtggcgcctcggccaggctgagcatcccctcgggaccatgggcgttcccgtcgtctccgatccaccaatccggatccggcgacgcgaggccgcacccctcgcaccaccatcggccgtcctggaacgacacgtggccaccacagcggggacacgcgtgggcgtcgtcggtccaggtcgacgtcgggcgaatccaaatctgacgtcgaaatcgcgacgcgccgagcaccacgatggggtccagtgcgttcgccacgacgagctcgatcgaactcgccgcttcggcgatgcgctcggacagccggcggacctcgagggctcgatcgagttggtcgcgagtgaggttgagccagacgagaagcgagggccgaagcgcctccgccacgctcggcacgaacgcctcgtcgacctcgaagaccccgaccgtcgcctctcgtcgagctcgagccagtgccccagcgatgccgaaactcatgttcgcaccacggttggtgaccaccgcgcccgcggccatggctaccgcaagcgcggtcgtcgtcgacttcccattcgtgcccgtcacgaggatcgagcggagttgtcgccccgcacgttcgaggatgtgcgggtcaatcgccaacgccagtcgaccactcaacgcgccaccagcgccgactcccaacatccgagacaacgccgacgcggcctgcgcggcgcccctcgccgcacgctgacgagcactctccacgggcgtgaggctatcgaccgggtgggcgcccttgcgctcatgcccgacgcgcggccgactccttcggacacgcggcagaacgtagaaggagccggctggggggtagccggctccttaagtgtgcaacggtgttgtgttggggggaaccatgccgttgctgtatgccagactaccccaccagtccgcgaaaatccaactatggtgatgatatcgtgtatcactttttccgatagcctcggtggctcgccatggagttgcgccaacttcgatcactcatcgccgtccaagaggcaggcagtttctccgcggcagcggaggcgctcgccacggttcagtccaacgtctccgcccacatctcgaagctcgagcgtgagctccaggtcgtgctggtcgaccgcagaacgggccagctcaccaccgagggcgagatcgtagccaagcgggctcgccatctcctcggagagatcgccgagatctacgaggatctctcgctccatggctccgacgccacgggcaaggttcgcctcggcatgatcgcgacggtggcgagttggctcctaccgccgctcctcgaccggctcgccaaggaacatccgcgagtcgagctcgaagtcgccgagggcaccgcggcctcgctgcagcggcggctccagagtggcagtatcgaccttgcggtactgacgacgccgattcgctacgaggaactggtctttcgcgttctgctcgaagagcgctacgtcctggtcgcaccgcgctcccatcccctggccagcgaatcgacgctcaccatcgcccaagccgcttccgtgccgatgctggtcccgcccgtccacgtcgggttccgcgacgaactcgaggcgatcgcggcgagccggggcgtgcgcctgcgcgtcattgcggagatcgacggtctcaacgtcatcgccgccatcgcacttcgcggctttgcacctgcgatcctccccgcgagcgccgtcgaggtgctcgcccatcacgccgacacggtcgccgtccaactcaccgacgtccctcctcgccagatcggactcgcacgccaccgcaaccacctccagagcgcagcagctcgagcggtcaccacactcctcatgagcctcccgactcggatggcggcccatgccctgccggcaggcgtcaccgcccctcgaccacgaggagcggaggcccgacgctagcgcacgcttctatcaccatcgttataggagtatcgacttctacgcactcttccggggtgccatgtccggcccgtggcgtcgtggcaggatggagcggttcgttcctcggaggaggaacgctcgctgggaaggagcaccatggctgggatctgtgaaggccgggtcgtgatcgtgaccggcgcgggccgagggattggacgtgcccacgcgctcgcgttcgctgaacagggcgcacgagtggtcgtcaacgacctcggcgccgaggtcgacggatccggctcgtcgacagggcccgctggcgaggtggtcgatcacatccgaagccaggggggtgcggccatcgccaacggcgacgacgtcgccagttgggagggcgcgcagcgcctcatcaacgcggccatcgagtcgttcggtcgcctcgatgtggtcgtgaacaacgcgggcatcctgcgcgaccgcatgctggtcaacatgaccgagtccgaatgggatgacgtgattcgggtgcacctcaagggcaccttcgccatgacccgctgggccgccgcctactttcgggagcaagcgaaggcgggtgtcgcgcaagacgcccgaatcatcaacaccacgagcgcatcagggatctacggcaacgtcggccaagccaactatggcgccgcgaaggcaggcatcgcgtcgttgaccatcatcgcagcgatggaactcgcgcgctacggcgtcacggtcaacgcgatcgcccccgtagcgctgacccgcatgactgagaaccttggcatcgtcgccccggacgaccgtgcagcacaggccgaactcgcgccggagaacatcgcacccctcgtggtctggctcggatcgacgcactcggccggcatcactggacgagtgttcgacgtcgccggccaccatatcgacgtcgccgaaggctggcacgcgggcccaagcgcggaggcgcgcggccaacgtttcaccgtcgacgagctcgacgacgtcgtcccggccctcgtccgcgcggcacggcgcaacgccgacatgagcgggcacgaaccacccgaggcgcccaacgcctaagctccatgcatcgtgaccacgccccctgagcctgtgtatcgctcacggtcgatcgacttcgcggtgctcgagcttttcgccctcgtgagcgacgcgttctcgggtgcaaaggaggcgttcctccacgaagacaagggcatcatcgcccacctcgtcgagcgcgaacgcattatcgacggtcgatacctcgcactcgagcgtgaggtgcacgagcggctcttggccccggaccgcaccccggcgatggtccactacctcgtcaccattgtccgcatcatcccagagctggagcgctcgggcgacctcgccgagcacatcgcgcgcaagggtgcactcggcctcgtgcgcgagctccgaccccgtgcgcgaggtcttctcgaatcgatggccgagctcgcgctgtcgatgtggtccgagaccgcggtggcgttcgagcacatcgacccaaccgtggcgcgtcgagtcaacgacctcgacgagtccctcgacgacctccacgtcaccttcacggccgagatcgcgtcgacgtgccaatccatcgcgaccgcgatggatttggcgctcgttgctcggttcgtcgaacgcttcggcgatcacgccgtcaacttggctcggtcgacggcggcactcgccacactcgagagccctatccccaagggcgacttgtcgtccgcgtcgtgagcagccgctaacgaacgtcgagatcggctgacgagcgcgatcggcggcgctcttcgagtcgggcgcccagcgccgcgatctcacttcgatggtgcatgccgagcttcgacaggatgttcgatacgtagttcttgacggtcttctcggcgagaaagactgactcggcgatctcgcggttggtcttgccatcgacgatcagatcgaagatccggcgctcctgcggcgagagttccgcgagcggatcgtcccccgcatcctggggatgccggatgcgctcgaggagccgtaccgtcaacgcggggtcgatgagcgactcccctttggcaacgcggcgcagcgcatcgagcagctcgtcgacccggacccgcttgagcagatagccagatgcgcccgccatgatcgaggcgaacagcgcctcgtcgtcagcgtacgacgtcaacatcaggcaacgcagctctggtcgtgcggcgcgaagctcgcgacacagctccacaccactgccatccgggaggcgcacatcgagcacggcgacatcgggagcagccaaggggattctcgcccgcgcctcctcaagagagccggcctcgcccacgacctcaaagccgtcgtcctcagcgacgaggcgagcaatgcctcgacgcacgacctcgtggtcctccacgaggaatacgcgcaccacgccatctagcttatcgcgtggcgcggtcgtcggattggcacgcggccccgagcggctaggcccgacgtcgaacgacgaccaccgggatcggcgcgtggtggacgagttggtcactcacgctgccgagcagcaacgaggtgaagcccccatgaccacgcgcgccgacgaccaagagatcggcagtctcacactgctcgatcagacgtgaggccgggttgccctcctcgagcacggtctccaggtcaagatcgggttccagggcgcgcacctgcgcggtcgcgtcgtcgagcagcgcgcgaccggcggcctcgagctcttccacggcggagggagttggaccgtagccaaactccggcaccgtccacgagtacacgatcacgagcgtcgaccggcgtcgcttcgcctcgtcgacggcgaactgcagcgccgtgcgacccgactcggagccgtcatacccaaccacgacgcgccgatgctctgtgaatcctgcctccaccatcgtgtgcacctcctcgagctcagcctacgcaacggtcctggccaccgcatcggacgatagtcccaagtcgcagcaggccttggcactagcatcgaaccgtgagcatgcgggcacgactgcgagaccacgtcgcaagctcgcagcaagcccttgctcgggtcttcgacgagtcgagcgcgctcggatcgctgcggcgggcccatctcctgtccatgaccgccgacgccatgatgacggtcgcgttggctggttctctgttcttctccgtgtcacccaccgaagcgcgaagccgcattgccctctatctcctcatcacgatggcgcccttcgcagcgctctcgccgctcgtggctcccatcgtcgaccggtctcgtcagctccgccgatcgatggtgaccatctccgccgtcgtccgcattgcggcggtcctgctgatggcggcgttcctcaggactctgctgctgttcccactggcactgattgcgctcatcgcatccaaggcgtacctcatcacgaaatcatccctggtgcccgaggtggtcggcgacccgcaacctcgaacactcgtcgcgaccaacgcatcgctgaccctgttggcatccgtcgggggcgcactcggggtggtcgcaggtgggatcctcgccaagacgcctcacctcggtcccgcgtgggcgctcatcgccgaacccgtcgcgctgctctacatggttgcggccggtcttcgtcttcatcggatgctgccccaggcggtagccggagcgtcgcaggctcgcgagcggctacgcagccgccccaccggacccggatacgcgagaaccttgctcgcgtccctccttgtcgccgtacttcgaggtcagatcggcttctttgccttcgtcatcgcgttcgcgctcaagggcagatcggctccgacctgggcctacggagcagcactcgcagccagcgccatcggtgcgatggccgccacgcaggttgctccccgcctccgacgccgactctccgaaatccccatcaccctcggcgcggcgacactcgtctccctcgtggccatcgcggcaaccaccgcacatccagcgatcgtctgggccatcgtggtcatggggatcctctcactcgcagccgggtccgcgaagatcgccttcgacgcaaccgtgcagcagggtctgcgcgaagagcactacgggaggaccttcgctcgctacgagacggagttccagctggcatgggtcgtgggggctgccgcagcaaccttcgctcgcacgccgttggccagcggtgagagcctgatcgcgaccacggcagtggtcgcgctcgccgcctacgcgctcgcgaccactgcactgcgtcacgcccgcgagcctgagttgccaggcgaggggacatgacattcacctatcctcgcgtgcgaattggcggctgcgtgcatcgctaggatcgtgtcgtggatcgcggcctcgagagctccgtagcgagcccatggaggccagccctcatcgcggcgatcggcgcactgctggaaatcgccgtacaagtcatcggggtcgggcacggcaacccaggaatcttggcgctcgtcggaaccctgttcggatcgcgcgcccacctccccgcctggattccacaggttcgcgggcctggctacgacggacagttcttcttgcgcctcgcgctcgacccattcgacatccaccgccgagccttcggcatcacctttgacacgccgtaccgtgcccagcgcatcggactgcccttcctcgcctggctcatcgccggtggtcagcagcacctcgttgtgtggacactcccactgatcgaagtcctggcggctgcgtgcatcgccggatcggtcactgtcttggccggatccgaaagccgagccgccctcactggtgtcgctgccgccctctacgaaggctacgcgttcagctacggacgagatctcgccgagccggtcgcggcggcactcatgttgctcgcgattctctccatcgaacactgggaccggccaatcgttggcaccgtcctcctgcttgcatcgacactgaccctcgagaccgaactcatggcggttggcgcgctcggactcgtagggcttgcccgatcgctgcgcatgaggcgggttgaccatcgcctcatcgtggcaacggccgcggcgatcagttggatcggctgggacgcctttgtgtcgcacgaggtcggccacgtcaccgccgctgccgatctcaacgctaacttgggtgtccctctgctcacacaggtcaaggctgtcgccctgcacctccacccctccgctgccgacctggcgtggctcctccagctcgggctcctagtccttgccgtcgcaatcacgatcccgaggatctcgcgttcgcgtgcgccctcggtgatcaaggttctgttcatcgccatgatcgtgctcgcactgctggtgggtcccgctgactgggacgtcgaaagcgggtttcgccagttcgatctcgtctggatttcgagcctgatcgtcatcggcaccaccgacaatccgccggcctggcttccagcgctcggcatcgcggcgtggatcggcacggttcacctcgcggtcaacaccactgccttcctgcgccgtctctagcgagtacacgagaggcggcccgccggtcttgcctgaggcatgaccaattcggtagagtcacaccattcgcaccagcggtcgactagcgagtccgaggtgcggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccaggtccccgcccctaccggttggggtagggacggggctggtgtgcctaggaggggatgggtgcctcccgaagaaggcgaagactgcttgcaagttctcgcagacgctcggccgcctgagcttcgtgagagaggacgccgcgcccgtggcgctcgacgagggcatgtgcaagcgcctcggcaacgcgcgggcgcgggccaaccaaccagcgcggatccgaaccttccaacaccgcgctgacgagcgcagtcatggacgaggagtcggcccaggcagcatcaccgagatcagcgatgaatcgacgctcgtcgcccggcgaaccttgtggtcccaatgcgagggtggccgcaaccgtcgcgccccgcccgcgggccagctctgccgcgatcttgagcgcatctcccgggtccaccgcatacgtcaggagaaggccaactggcgccctcagattggccggtagtgcctcgagcaaacgacgcataccctcgctgggccgttgcccgaccaccagcgccccgtcaacccagccggcgacaacgatcagatcggcgtcgacgaggtcctcggtttcgaactgatcggcggggatgcagcgcacgcttggcgcaaaattcgcgagcgtctctcccagggaaagtgccgccgcgcgggtgtggccacccttggagtcgtaggcaatgagcacccgtggcggagccagtcgtcgaccgggcaacaccgcgttgcgaccgcctgcggcgagcatctcctccccgacccggcgcccgtgagccatcgcctccaccaccgttgacggtccgacgaggacatcaccaatggcccaggtgcgggcctgccgccacgctgccgctcgcctccgggcccgatcccggctccaggcgagatcaccgacacgcaaccctcggagcggctcacccgcgaagatccctgaggccaaccagtgtcggctcggcagatctccaacttccttgcgttcagcgagcccaggcaccgaagcgatccaggacggatcgacgcgatagcccatcgcagctaccactcgatcgaccacgagctcctcggcgatctcactggtcaccgtaggccgctcactcgcgcgctcctgcttcgtccgaacgaggagacagtggatcccgtcgtcgcgttcggcgaccgactggagcgtcacgccaaatcgcacctgtacgccctcggcctccgcttcggcaagttcgtcaggccgcacaaggctgaagcgctgatccatccaatcgatacagactgcagagccaccgcgccgtcgcaccaggcgcgcgacgtccatcgccgtgttgcccgccccaaccacgagcacacgatcatccaccggcggcaaaccagcttgaatcgccgcctcggccacggcgatctcgtcgagtgcgttgccgacagagatggtctcgatgccatcggcgcgtacgggcaacggagcgccagcaccaacggccagcaccacggcgtcgtagcggttacgcgccgccaccacatcgtccggagacagcgcggtgttcatctggaaagccacgcctcgccgctcgagacgctcgatgacccgatcgagaacgtccgagggcagcgtgaaccgcgggatcccgttgcgcagcaagcctccaggttggtcggcagcgtcgaccacggtgacctcgaccccggctcccgacaggacatctgcggcaccgagcccggccggaccgctcccaacgatcagtacgcggccctccttggcagccggcgtcgggtcgaccgcatcagcatggtcagcgatgtagcgctcgatggcgtggatcgccaccggcctcgctccggcaagccgccaggaacagctcccctcgcattggatcgccgcatcacagacgcgtgagcagatctcgggcaacgatgtatgtgcgctcagcacgtcacgggcaccggcgagatcgccactacgcagctgagcgatgaactcggggatgtcgttgtgcgtcgggcagcctcgcacacacgtcgggtccggacacgccaagcagcgattggcctcttcgagcacgtccgcaaagctcgcgaatccgccgcgtacctcgtcaaggccgcccagggccacgtctggatccaactctggcaagacagcgcccggcgcaacctgcggatcacccgcgacgacgatcgcatcgaacggacagacccgctcgcactggcggcacccgacacaccgtgcgctgtcgacagtgacgacgtaacgatcgaggtcgagatcgatcgcctccaccggacaacgaatcagacactcttgacacccggcacaccggtcggtgagcacctcaacgacaacagcgctcatgttcaaccctcctaggacgctccgtgcatgatgacgtacagccatccagccacggccccgaacacgacgacgagcgcaagagcagagagcttggcgacggcacgatgacgcacgatcgacgcgagatcagcgtcgaagatgcgcgccatggcccagaggccaccgacgactccgagcgccatcacgccgacctggacctcgacaatttgcgggatcgccagcaggtggtccgacagcaagctccagtgctgcgtgttgacaccgaagatgccgacgatggctgggatgaggctcgggatgtgcttgaagaacttcggcagctggcgtgcgaagtagtccatcccgacaactgggatgaggccgtaggtgagcggcaggaacacctgacggaacggagtgacgcggtcgagccgactctctgcggtgaccgtccgccgtgcagccggatcgagaaaggctcgaccccacgcccagatgatccctgcagttgcgagagccaccgcggcgatgatgcccaggtagtcaatcgggttcgggtaggccggccacccagtcgcgcgattgagcgtggcatcgatggagctgtagacgtcggtcgcgttgaactgctggaagatcacgaggccccacaagatcgcgatggcccaggcaaggtcccaacggcgacgcttcggcgcgaccacggaggtgagtggcgcctgcaggaagagtcccacattgttcgaggggcatgccttgtagcactccgtgcacagtccgcaggcggcattcgactcagccgatcccggccacgtgaaccatggacagccataaccggacgcaccgccacgcatgcaatccttggtggtgcactcgaggcacgtctcgcggtcgaccgttcgaaagcccgcgaccgagcccatcgacccgacggtgccgatcaacgccgagagtggacacaggtaccggcagaagctccgccgctcgaagacgaggaacaccgagaccgccgtggcgacgataccgagcaccatgatggctgtgtagcgaggcacccccggacctgcgatgttgaagtactcctcgatgaaggtcagcagcacgaaggtcgcgacagatcccaagaagccgtactcggccagccacggaggcaccgggcgcccgagaccgatcgccgagtgcagtcggcgaaagaaggtacgacgctggatccactccgcgaagccgccgaaggggcacatggagcaccacgcgcgcccgaccacggccatgagcacgaagacaacgcagaaccacaggtaccacgtgatcgcggtcgcaaagttcgtctggggatcgacgacgccgacgaagcccaggacgatcaccagccagaagatgatctggttcggcagaatcaagaggaattgggtggtccgattcgcggcgaggcgggcgatgataccccgacgtgccacgttggcacgtggcgacggatctgatcgctcgaatcgatcctggcccggccgatgcggcggtcgcaatcgcacgaccacctgatcatcgagcacggtctgcacatgcgggggcttggtcgtagccatctcgctcctcctttggcaccgcgccaatgattagtcattgactaatcgttactgtagccatgcccatacgtggtgtcaagtcgcgactacgatcggacacgtggacctctcgctgtctcggcgtggcgactatgcggtacgtgcagcgctctaccttgcgcgccaggagtcgaacgaggccgtcggcgtgcgcgagatcacggccgcaatggcgattccaccgagcttcgcaggccagatcctcgcggacctgacccgcgcaggcatcctcggtgcgcggccgggccgcggaggcggctattggctccaacacgacccgaaggacatcaccctcctcaccatcgtcgaagcagccgagggcaccctccgcgcggaacggtgcgcgctcggggatggaccatgccgttgggacagcgtgtgtccactccacaccttctggcagggagccgttcgagccgttcgcgatcagctcgccaccgtgacgctcgccgacgtccgagacgcggacgtcgccctcgaacatggggttgccccgccgcccgatgcccaccgccacgccacggtcaccaaccttgccgagacgatcgacgtcgaggcacccgcagacgaggtcgaacgacgcttgcgcacgctgacgtccgacgatctcgccaaggcgatcgcgcatcgcctgaaggccgcactcgacctcgacctcactctctgcgaactcgcccatccaggccgtcgcctcgtcgtcgaggtgaacgaccccatcggccagacggcgagagcagagttcgatctcaccaccgagccggcggatcccctgcgcaccacgctcactgcggcgatcctctggcgcggtcggctcgaggacccacgccctagcgttcgcgcgatcctgacggcgacggcaagactcctcgaggacgcgcgctgatgcaccgctcacagacgccgtaggcctcgacctggtgatacaagactgggccaggcgcgtcgtcgatcgtgatcgcctgacacgaggccacccgaacctcgaagatctccccgcacgacacgcagtggaagtggtggtggtgcgacgcgtagggcggcaggagctcataggcgatgtcgtcaccgatggtcaccggttggacgatgccagcctcggcaaacgccgcgatggttcggtaggccgtcgccgacccaacgcccgcttctgcgagaacgtcgaccaactcggccctcgtcagcggacgccccgcctccgccaacacgcgaaacaccgcacgtcgctcatcggtgacccgcaacccgcgttgtctgagtgcaccctcgaactgcgtctcagccatcgagctgctccgtccgaccgggctcggcactcggagccgcatcctgctcgccagcgcgcgagagcgagcgggcccgacgcgcagcgtgacgagtctcacggacgagcgtcccgatcccgacgacgacgacggcgaagatgacgagcacctgagcgatgccgatgttgtgaaggttgtgcacgtggagcggtgtcaccaggtgaaaggagagaaggttcgggaatgcgagtccgacgacaccggcgaccacgaacgccacacctccccacaacagcgtgcgcccagcggtgaccagtgcgacggcgcgaatctgcgcctccgtcaacgacaggtgtcgagcgacggcaccgaagaggccgcccgcgaccgcctggaccaccgtggtgcccaggccgaaggctgcaccaggcgcccaaccgagccacacgggcatcgctggcgcgagcacggtgtagaggatgagagcaaacgccccgataccccagcctgcgatgaaaccgtgcaccgcgggcatccatggcttcatggtgacgtcgggtacaccgtcctcgacgtgatgggccggcgagagcagatgccagtgctcaccgcggaacaagtaacgtgccgccagcgccatcgccagcccgacggcgacgtagacggcatagtccagccagggcgtgtcaacgaagaccttggcgagcgccaggttcgcaagttcggacgcgatcgcacgctgcacggtgaacgcagccgagaacgtcaggccggcgacgagaccgcgtcgactcgagtagctgccgatggcgtacgagaacgtgatcggccacgtgtgctcgtcgggggtgatgccatgcacgatgccgagcgcgaacgcgagtaccagcgcaccgccgatcgtcgccaccccagccgggttccacaagttcagcaccgcgagcagatccacgacgacctcctgtccgtgctacacatgatagcaattctcacttagtgttgacacgcattctcaacaacgaggcggccgtcccattccctgaccgcgcgcgctagccttcccctgggacgatgtgtgcacgtgcaatcgtgggcgcggcgctcgactcggctccccacgcaccccggatcgtcaacggaaaggatccatgatgcgctatcgccatctcggccgaaccggtctcaaggtctccgaactcggcttcggctcctgggtcaccttcggaacccagctcgacgtcgggcgcgcggccgacatcctcgccgccgccagggaagccggcatcaatctgttcgacaacgccgaggcctacgccggaggcgagtccgaacgcatcatgggacaggccatcgcgcgactcggatggccacggtggagctacgtcgtcacctccaagttcttctgggggatccacgacgacgtgaacacgcaccacaccctcaaccgcaagtacctcgtcgaggccgtcgacgcgtcactcgagcgcttcggcctggaccacctcgacatcatctactgccaccgaccggaccccacgacgcccatcgccgagacggtcttcgcgatgagcgaactcgtcagcgcacacaaggcgcactactgggggaccagcgagtggagcgccgaggaaattcgccacgccatcgacgtcgcaaccgccaatcacctccacgctccggtcgtggagcaacctcagtacaacctgctcgagcgccagcgcgtcgagcacgaatacgcccgcctgctcgacgaggaaggcatcggcctcaccacctggagtccgcttgcgtccggcttgctcaccggcaagtacgtcaatggggtgcccgcgggatcacgagccacgctccacgggtacgagtggctccgtgatctgctcaccgacccgggacgccaagccgtcgtgcgcagcctgctcccgctcgcgtcacggctcgaggtctcgctcgcccagctcgccatcggctggtgcctcctgaatccgcacgtatcctccgtcctcctcggtgccacctccatcgatcaactcaacgagaacctcggagcactcgaggcccgagaccgtctgaccccagcggtcgtggacgagatcaacgcgatcctggcggagcacgcctgagcggaccaccacgtctcggacgtgcggtcgctgcggcggccctgttcgcaaccgcacccgcgctcacgcaacgcgcagacgcgctggcgggaccgggtgcggtcctcggtatgcgagccatcgtctcggtcgcggccctcgtcgtgatcgggctgccgcgggtcaggcacctcgctcctaccgtcgcagccggtgtcgccatcgtcctcggctactacggcgcgaccaccctcggctatgccatcgccccggcgacaatcgcgtcgctgggtttggcgagcgaaccgctcgtcgtcggtctcctcaatccccactggttgcgctcgccgcgcaccctcgcaacggtgacgctcgcagtggcggccatggtgctgccggtcaccgcggcccacgcagggacccatcatgtggtagctgggatcggactggtggcgctcggcggcgcatgcttcgtcatcggagctcgtctcctcccggcaagcgcgacgccgcgcgacgccgtgcggacgaccaccttcgcccaagccctcggtgcgatcgtcctggctgctgtgctcgccggaaccggtcgctttgccgtcgcgaccacgatcgagccctggctgctcgtcgcggtgctcgtcgccggctcctccctggtcgggatcgccctctacgtcggggcggctcgcgacgcacctgccatcgcggcctcgagcctcagcctcgtgccaccgctcggagccgcccttgcctggggcgcgcttggcgatccgatgacctggcaactcgccctgagtgccatcgtggccgcgttggctgtctacctgggcgcacgtagcccgaccgttccgtagtacctggcggtaggatcgcaggtgtgtccaccgcgtggaccttcggagcagccgccctccgctacgacactctacgaccgccgtaccccgcggcgaccttctcaacgctcgagcgcgcgatcggatcctacgagggctctcgagtggtggaggtcggtgccggaaccggcatcgccacccaggggctcgtcgctgcaggcgcggacgtcctcgccctcgagcccgatccaggcatggggcgcatcctgcgtcgacgcctcccgaccgtacgcatggtccccgccaggctggaggacgtcgacctcgagggcgtccacctcctcgtcggctttcagtcgctccattggataccggtgcgagccttgtggcgcgctgcccgtcgagccctggctcccggcggcgttctcgccggcgtctggcagctcgccacgctctccgatgtccgagcggcccacgcgatcggcgaggtgctcgcgagattcggcgtggaacgctccaggggatccgaccagcgcgtcagcgacaccatcgaggcactgagcgaccaggcggtgcacgggttcgcacccgcgatgcgctgcgagctcccttggcacacgcagcgcagtgcgacaagctttgcaggcctgctcgcaaccatgagcgacctgcttgcactcggtcacgaaggcgccgactgcgaggcgcaactcgctgaggccctgaggccgtacgagccgatcgacgtgcgctacgactgcgtcgtgatcatgcgtcagcggatgccctaaggtgacggacgtgctctccccgttcacccccgtcacgatcgatcgaacccgaaccgagttccccggtatcggagcggcctggcgcgcgcacgcgctccggatcgacgatcgcctcggcctccatgcgctcgctgcaatcgccgacgacccgcagccagctgcgcacggaccactcgcaggcgtgccggttctcgtcaaggacaccatcgacactgccgatctctccacgacggccggctccctcgtcctacccgaagagccccctgctactgacgcctggatcgtggatgcgctgcgcgccgctggtgcgaccatcgccgccaagaccacctgttcagagtgggcgaactttcgcggcgagggatccatatccgggtggaatgcgcgctacggactcgcccgtaacccctacgacccgacgcgctcggctgggggctcgtcgagcggctcggccatcgccgtcgcggctggcatgagcccgatcgcgatcggtaccgagactgatgggtcgatgctctgcccggcatcgctcaatggtgtcatcgggttcaagactgctccgaagcgcctcgaccggagcggcgtcatcccgatctcgtcgacacaggactccctcggcatcttcgccacgagtgccgacgacctcctcgtcgtcgcgagcgtcctcggcatcgaagccaccaccctgacagaacctgtccgactctgcgtggtcgaggagtccctcaacggcttccatcctcgtacgctcgcacgctttcacgacgtcctcgagctgctctcgcgcgcgggcgtcgacgtcgtgacgctgagcgcaccgccgcgcggaacgctcgagccctccgatgaggacgagctcatcgtgttgcgcaccgagctgcatgtcgagctcgatcgctacctcgatcgtcgcgccatccccggccttcgctccctggccgacgtggtcgcggcgaacgacgcgctcgccgaccgagagctcgcctacttcggccaagagcacttcgtggcggcactcgaggccgacccggccgatcccgcctaccgggccgcgcgccaacgcaacctcgagcgcacgaccgaaggaatcgagtcctcgctcgccgcgacggacgcactcgcgatcctcgcaccaaccatggacgtcgcgtggcccatcgatctgctccgcggcgaccccaactccccagctggctatcgagccgccgcagtcgccggcgggacttcggtctccgtcccggcaggtcgcatcgggcacctccccgtcggcgtgtgtctcagcgcgccggcaggtcacgaggaaacgatcctcgagctgacggcgctcctcgagcgcgctctggccccactcgcgggcctcgcgggacgcgagaggcccacgacgctgttgcccgaagcgtgagcgccaccatctcgatcagtcgccaagttcccttccgtgccgatcgcgtgttccgggaactcgccgcgctggaacgacaccacacctggatggcggatgcagaagcggtcgagatcgtgagcgcccaacgccgcggcgtcggcgtcgagatgatcgcccatactcgcatcggcccgctgcgcacagccgaccgaatggtggtcgtcgactgggacgaaggccgtgccatcggcgtccgccacgtcggactcgttcgcggagtcgggcgtctcagcgtccaagccgacggtcccgaccgtgcgcgagttcgctgggacgaagagctcgtcttcccaggcgggcatctcggtgagctggcagcacacgccgcacgaccagtcctcgagtggatctggcgaggcaacctcgcccgcctcgaggccgcgatcgcctcggcagggcccattacgctgggcgctccgtgagtacgacggcctcgaactccatcgccgcacgctttggcgcgctcgcgcgccacgccgtggccgacacgccgtcacgttccgaggacgtccacctcgaccgtgacgtgatcgcggccatgctcggcctggaggatgagccggaagcgctggttgcaaccgttcgactcgagggccacactgcacgtttcgcaacgcctcgcaccccgctccccccgcgtctcagccgcctcctcgccgagaacccgggtcagctctacacgcaccaagccgccgtcaccgaccacgccctggcgggccaccacgtggtgctcgccaccccgaccgcgtccggcaagtccctcgcattcctcgtccccgccctcgctcgcctcgagcgcgatcccgcagccaccgttctcgccctctatcccacgaaagcactcgcgcacgatcaactggcgcgcctcgtcgagctcgagcgagcgctcggcatcgacatcgcccctgccgtctatgacggcgacaccccggccccggaacgcgctcgcatcaaggaccgatcgcggttcgtcgtcaccaacccccatggcctgaacctctacctcggatggcacgaaggctgggagcgcatcctcgccaacctggcactcgtcatcgtcgacgagacacacgcctacacgggagcgaccggcggtgcggtgggctggttgctccgtcgactccagcgtctcgccgaggcgcacggtgcggcaccggtctacgtgggggcatccgggaccatcgccaatccggccgagcacttcgcacgactcatcggcgatgacgtcgtcctcgtcgatgacgatgggtcggcccagccgacacgcacgatcgccatcgtggatgcaacacgatctcccgatcacgccccgatcgctcaggccgcgctcctcgtgcgtcggctcgtccgccaccgccgccacgtcatcgccttctcgaactcacgatcgcacgccgagctgctcgcgagactcgcgaccgatcgcgcggtccgcgtcgaaccctacagggcagggtacgcggcccaacggcggcgggcactcgaagccgacctccgagccgggcgccttcgcgccatctcagcgacgagcgccctcgaactcggcatcgacgtcggcgtcatcgacacggtcgtgctcaacggattcccgggctcgatcgcctccctcttccaacgcatcggtcgagccggacgatcgggccaggacgcactgggcgtcgtcgtgctgggggccgaacccgccgcccgagcgctcatcgccgatccagaggagttcctcgtccgcccgcccgagctcgcggtcgccaacgtcgaccagccctccgtggtccggcgtgcgctcgagctcgctgcggccgaacgacccgtcacccccgacgaactccgtcactggggcgcgcccgcacgcgacgctgccgccgcactcgtcgaggctggcacgattcggcacgacgccgacggccttcgagtcccgggccgccgcccgcatcgcttccgaccactggtcgagatggagccgacgtggcgcctccagttcgaggggacgcgcaccaccatcgcgccagagagcctgtcggagagtcaggcactgcgcgaggcctatcgcggtgccatcgtgctgcatggctcgcagccctaccgcgtcgtccgggtcgactacgctgcgcgcgtcgcggtcgcacgaccagaacccgaccgaggccaccacacccaagcagcctggtatcgcgcgatcgctccgacgcgcgtacggtctcatgcgatcgcggggtcgctcacgttggacctggccgatgccgtgctcgtcgagcaggtcacctcagccaaggagttccggggatcagtgctcgtccaccaacgcaaggtcactgccccctcacgttcggtcgcgggcgaggccttgatcctctcgaccaaccaactcgtcgatcccgccgaacttccagccctccacggcgtcgagcacctcctcgtcaaggcgctcgcgccgcttgccgtcggcgcaagcgatctcaccacgctgacccaggccacgccggcaccgcagatcctcttcttcgcgcccgatgcgctgggcggcggcacgatgcttgcgacggtggctcgccagctcgatcgtgcgctcgccgtgtccgagcgcatcctcacgacgtgccgctgcaacgatggctgccccttctgcaccctggacgctcgctgcgacggcgacgttgccgccaagtcgctcgtcctggacgtgctcgtgcgcctgcgcgaccaccacgcgcggcacgcttagcacaatccggcgcgatgcgcctcgcacaggtccgcgagccggcagccggcgcacagtggccgcctcgccgtgcacgtctcccgaccgtgcaggatcatgcgcaacgagaaggtcccccagcgcttcggtgccaagaccgcacagagctcctgttcgatcccctccggggtcgacgatcgggcgatcccgaggcgacgactcacccgtttgacgtgcgtgtcgacggggagccctggcaacgagaagccgaccgaacgaacgacattggccgtcttgcgtccaaccccgggcaagctggtcagctcctcgagtccttggggaacctctcctccgaagcgctcgacgatcgcagctgccagcgcgacgatgtgacgagccttcgttcgatagaaaccggtcggacgcaccagcgcctccacctgctcgatcggagctcgggcgagagtctcggcgtccgggtagcgagcgaacagtcctggcgtcacgaggttcaccgcagcgtcggtggtctgcgccgacaagaccgtcgccacgaggagctgaaacggggtctcgaagcgcagggcacacagcgacaccgccgtccctggatagagctcttcgagtcgttcgtcgaccgcgagagcccgtcgggtttcgtcctgcaccgccaacctccccaccgctagcctagagacgtgcacgcgctcacgacggtcgagaacccgtctgcgcgcctgctcccgggggtgcttgcactcatacgcgatgtcgaggcagccgacggccacgaggtactcgaggctcatcgctggatcgacctcgccaacgcggacgccgagagcctgcacgggatcgcggtgacgctcgacgacgacaccgtcgtcggctacgtccacctgcggcggcaccaccgtcacgggatcgagctcgagctcttggtcgcgccagaccaccgcgacgaggccgcgagcatcgtcggcgcgctcgtcgaggccgcgagcgcgagtctcgagaccctcggcccccacgagatcttcgcctgggtacccagacactctcgacaggtcatcgatgccctcgagggcctcgggttccgtgccgaccgcgcggtacggcagctccgacgtcccctcccactcgagtcagaccacccggcacggccgattgactgcccgccgtttcggacctttcgtcccggcgaggacgaggatgcgtggctcgaggtcaacaatcgcgccttcgcatggcatcccgatcaaggcgactgggatctcgagaccctgctcgctcgtgagcgcgagagctggttcgacccagctggtttcctcctggccgaacaggacgggcgcctcgtgggcttttgctggacgaaggtgcatgcgccgcgctcgtcgtcagcgctcggcgagatctacgtcatcgccaccgatccagaacgcgcgcctcgcggacttggctcatgcctgctcgtcgccgggttggactacctcgcccaccacgacatccccaccgcctcgctctacgtggaggacacgaacgaacgtgcactccgcctctatgaccgcttcgggttcgtggtcgatcacgaagacgtccggctcgtgtggcgtctcccagcagcgtcgtagactcctcgacgaggaggatcaatggatctgaaggaagcgttcgtcggtggccccaggttcctcgacaccgcgagctacggattgccaccccgtcgcgaggtggccgcactcgaacaggcgctcgctcggtggtcgagcggcacggccgattggtacgacgagtggctgcgcgcgacggatgtcgcgcggggccaccttgcgcgcctgctcggcaccgattcgaccgcggtgaccaccggtccgaccacctcggtgctcgtcgccctcctcgcaaccaccgtggagccgggcagtcgcgtcgtcgtgccggacatcgagttcacctccaatgtgttcccctggcttgtgatcgctcaacgcaggcagctcgatctgcgtttcgttcccgtcggatcgctggcacgtgcaacggctgagggggccgacgtcgtgagcttctccctcgtgcagtcggcgacgggtgaggtcgccgatctcgacgccatcgtcgatgccgcggagtccgtggacgcacgcgtcttcgtggacgccacgcaagcgctcgggtggcttcccgtcgacgccacccgcgtcgacgcggtggtcgtctcgggctacaagtggctcctcgctccgcgcggcgtcgcggccatggctacgagcgaccgtgtccgtgcttccatgcggatcgttgccggcttttcccatcaggcctcccgagcggaaatggggaagaggcggacctccgtccccaccgcctcggccagtacacggcgagagaagtgctcgatcgcggcggtgtcggcttcctgcaggatgtcgatcttgttcaacaccaaaaagatacggccggcgtacttccggacctctcatggaggaactccagttcggcctcactcaccgcctggtcggcggagaggacgaacagggcggcatcgcactgcggcacgcgcgcccaggcggtgtcggtgttgtggcggaacaccgagccgacgccgggtgtgtccacgatgcgcacgccattccccaggagcggcgagggcgtccggatcagacttcccgcacgcccttcgcgttgcccgggttgcccggctcggtgatgtaatccgcgagcatatccggacggatgtcgaaggggctgccttccagcggctggacggtgatccgggggggatagccgtaggcgagcacggtcaccaccgaggtcagcggcaccgcccgcgtgggcagcaggttctcacccagcagcgcgttgatcaggctggtcttgccccgtttgaactggccgaccgtcaggacgtcgaaatggccggcctgcagcttgtcacgcagggcgagggcggggcgcagagcggcggggaggcgtccgccagctcgtcgatcaggctcaggagttcggttttgagatccgcatagccggtcgttggcgcctcaccggcgatcggccaacgggggatcgcgttcattccgcagtggtcggatcgatgacggtgcggatttcgttgatcgcatcggcgggaaagccgccttccagtgcgtgctgtaccagcgtggcggcgtcgggggcaatgtagacgcagtacaccttgtcgtcggtgacatagctctcgatccactgaacctgcggtcccatggcgttgaggatcgaacaggattacgggagatctgccgcagttcgtcgcgcgacaggtttccggcggccgcgaatcgtgcgctctatgacatatttgggcatggttatcagccttacggttctggtaaggaaaaaataggcttgtattgtgcttatccgaagataagcgctttccgcgcagcccgattctttcatggatcacgattccattgaatgcggcgaaagtctcagggtccggtcatgaatgaagagttatggcggcccagtacgtcaccgttatgtccgatggctgtatcaaacaaagacacgtgtagtgatatcggacaactcgtccatccccgtcggagcattcggataacgtgctcatcgttccaaaatattgatatacggtatacgtatccgaagaataaagttggcacgatccctgtaactaggttgtcacgacctcgtcggaggttgtatgtccggtgttccgtgacgtcatcgggcattcatcattcatagaatgtgttacggaggaagagccgctgtacgccaattggtacgccggcgaacccattccgacctcgctctacggaccaccgctgcgactggctccggatgcgcggcgcttcgacccctcgcctgcgtggttctcctgggtcggcgcggtcgccgcgctggaactcctcgacgaggtcggcatcgacgcgatctgggcgcacgacaccgacctcgccgccgccttccgcaccatgctgggtcttcccgagcccacggtcccaagcgcgatcgtctcggtggcgctcgatcgagcaccctacaagtaatggcacttagcaccgcaaccaaggccgcgacggacgcgctggctgccaatcgggcacccaccagcgtgaatgcacaggaagtgcaccgttggctccagagcttcaactgggatttcaagaacaaccggaccaagtacgccaccaagtacaagatggcgaacgagaccaaggaacagttcaagctgatcgccaaggaatatgcgcgcatggaggcagtcaaggacgaaaggcagttcggtagcctgcaggatgcgctgacccgcctcaacgccggtgttcgcgttcatccgaagtggaacgagaccatgaaagtggtttcgaacttcctggaagtgggcgaatacaacgccatcgccgctaccgggatgctgtgggattccgcccaggcggcggaacagaagaacggctatctggcccaggtgttggatgaaatccgccacacccaccagtgtgcctacgtcaactactacttcgcgaagaacggccaggacccggccggtcacaacgatgctcgccgcacccgtaccatcggtccgctgtggaagggcatgaagcgcgtgttttccgacggcttcatttccggcgacgccgtggaatgctccctcaacctgcagctggtgggtgaggcctgcttcaccaatccgctgatcgtcgcagtgaccgaatgggctgccgccaacggcgatgaaatcaccccgacggtgttcctgtcgatcgagaccgacgaactgcgccacatggccaacggttaccagaccgtcgtttccatcgccaacgatccggcttccgccaagtatctcaacacggacctgaacaacgccttctggacccagcagaagtacttcacgccggtgttgggcatgctgttcgagtatggctccaagttcaaggtcgagccgtgggtcaagacgtgggaccgctgggtgtacgaggactggggcggcatctggatcggccgtctgggcaagtacggggtggagtcgccgcgcagcctcaaggacgccaagcaggacgcttactgggctcaccacgacctgtatctgctggcttatgcgctgtggccgaccggcttcttccgtctggcgctgccggatcaggaagaaatggagtggttcgaggccaactaccccggctggtacgaccactacggcaagatctacgaggaatggcgcgcccgcggttgcgaggatccgtcctcgggcttcatcccgctgatgtggttcatcgaaaacaaccatcccatctacatcgatcgcgtgtcgcaagtgccgttctgcccgagcttggccaagggcgccagcaccctgcgcgtgcacgagtacaacggcgagatgcacaccttcagcgaccagtggggcgagcgcatgtggctggccgagccggagcgctacgagtgccagaacatcttcgaacagtacgaaggacgcgaactgtcggaagtgatcgccgaactgcacgggctgcgcagtgatggcaagaccctgatcgcccagccgcatgtccgtggcgacaagctgtggacgttggacgatatcaaacgcctgaactgcgtcttcaagaacccggtgaaggcattcaattgaaacgggtgtcgggctccgtcacagggcggggcccgacgcacgatcgttcgatcaacctcaaaccaaaaaggaacatcgatatgagcatgccgacctcacgacgaagatctcgttccgcgacggccgcgctcgcgtctccttccacctctacaacgacctcgccgacgccgagacgctcgcagccgagcttgcccccttcggcgtccagcgcccacgtcggagctgatcggccggctcgaccgtgccacgaccgagccaacaccagcgcatacgagcacgcacgggcatcgtgcactgccttaggagaaagacgccgcggtctgaccgatccggaaatggcggccgtcattttgaaggcgcttcctgaagctccgctggacggcaacaacaagatgggttatttcgtcaccccccgctggaaacgcttgacggaatatgaagccctgaccgtttatgcgcagcccaacgccgactggatcgccggcggcctggactggggcgactggacccagaaattccacggcggccgcccttcctggggcaacgagaccacggagctgcgcaccgtcgactggttcaagcaccgtgacccgctccgccgttggcatgcgccgtacgtcaaggacaaggccgaggaatggcgctacaccgaccgcttcctgcagggttactccgccgacggtcagatccgggcgatgaacccgacctggcgggacgagttcatcaaccggtattggggcgccttcctgttcaacgaatacggattgttcaacgctcattcgcagggcgcccgggaggcgctgtcggacgtaacccgcgtcagcctggctttctggggcttcgacaagatcgacatcgcccagatgatccaactcgaacggggtttcctcgccaagatcgtacccggtttcgacgagtccacagcggtgccgaaggccgaatggacgaacggggaggtctacaagagcgcccgtctggccgtggaagggctgtggcaggaggtgttcgactggaacgagagcgctttctcggtgcacgccgtctatgacgcgctgttcggtcagttcgtccgccgcgagttctttcagcggctggctccccgcttcggcgacaatctgacgccattcttcatcaaccaggcccagacatacttccagatcgccaagcagggcgtacaggatctgtattacaactgtctgggtgacgatccggagttcagcgattacaaccgtaccgtgatgcgcaactggaccggcaagtggctggagcccacgatcgccgctctgcgcgacttcatggggctgtttgcgaagctgccggcgggcaccactgacaaggaagaaatcaccgcgtccctgtaccgggtggtcgacgactggatcgaggactacgccagcgcgatcgacttcaaggcggaccgcgatcagatcgttaaagcggttctggcaggattgaaataatagaggaactattacgatgagcgtaaacagcaacgcatacgacgccggcatcatgggcctgaaaggcaaggacttcgccgatcagttctttgccgacgaaaaccaagtggtccatgaaagcgacacggtcgttctggtcctcaagaagtcggacgagatcaatacctttatcgaggagatccttctgacggactacaagaagaacgtcaatccgacggtaaacgtggaagaccgcgcgggttactggtggatcaaggccaacggcaagatcgaggtcgattgcgacgagatttccgagctgttggggcggcagttcaacgtctacgacttcctcgtcgacgtttcctccaccatcggccgggcctataccctgggcaacaagttcaccattaccagtgagctgatgggcctggaccgcaagctcgaagactatcacgcttaaggagaatgacatggcgaaactgggtatacacagcaacgacacccgcgacgcctgggtgaacaagatcgcgcagctcaacaccctggaaaaagcggccgagatgctgaagcagttccggatggaccacaccacgccgttccgcaacagctacgaactggacaacgactacctctggatcgaggccaagctcgaagagaaggtcgccgtcctcaaggcacgatggatcgggttgccccgttgcgatcccagcaccacgagagaggtccgcgatctcggcccggcaggtccgcgccttcaacgaggtggacttccgtcataagaccgctttcggcgaggatgccaagtccgttctggacggcaccgtcgcgaagatgaacgcggccaaggacaagtgggaggcggagaagatccatatcggtttccgccaggcctacaagccgccgatcatgccggtgaactatttcctggacggcgagcgtcagttggggacccggctgatggaactgcgcaacctcaactactacgacacgccgctggaagaactgcgcaaacagcgcggtgtgcgggtggtgcatctgcagtcgccgcactgaagggaggaagtctcgccctggacgcgacggcatcgccgtgaagtccagggggcagggatgccgttccgggccggcaggctggcccggaatctctggttttcagggggcgtgccggtccacggctccccccctccatctttcgtaaggaaatcaccatggtcgaatcggcatttcagccattttcgggcgacgcagacgaatggttcgaggaaccacggccccaggccggtttcttcccttccgcggactggcatctgctcaaacgggacgagacctacgcagcctatgccaaggatctcgatttcatgtggcggtgggtcatcgtccgggaagaaaggatcgtccaggagggttgctcgatcagcctggagtcgtcgatccgcgccgtgacgcacgtactgaattattttggtatgaccgaacaacgcgccccggcagaggaccggaccggcggagttcaacattgaacaggtaagtttatgcagcgagttcacactatcacggcggtgacggaggatggcgaatcgctccgcttcgaatgccgttcggacgaggacgtcatcaccgccgccctgcgccagaacatctttctgatgtcgtcctgccgggagggcggctgtgcgacctgcaaggccttgtgcagcgaaggggactacgacctcaagggctgcagcgttcaggcgctgccgccggaagaggaggaggaagggttggtgttgttgtgccggacctacccgaagaccgacctggaaatcgaactgccctatacccattgccgcatcagttttggtgaggtcggcagtttcgaggcggaggtcgtcggcctcaactgggtttcgagcaacaccgtccagtttcttttgcagaagcggcccgacgagtgcggcaaccgtggcgtgaaattcgaacccggtcagttcatggacctgaccatccccggcaccgatgtctcccgctcctactcgccggcgaaccttcctaatcccgaaggccgcctggagttcctgatccgcgtgttaccggagggacggttttcggactacctgcgcaatgacgcgcgtgtcggacaggtcctctcggtcaaagggccactgggcgtgttcggtctcaaggagcggggcatggcgccgcgctatttcgtggccggcggcaccgggttggcgccggtggtctcgatggtgcggcagatgcaggagtggaccgcgccgaacgagacccgcatctatttcggtgtgaacaccgagccggaattgttctacatcgacgagctcaaatccctggaacgatcgatgcgcaatctcaccgtgaaggcctgtgtctggcacccgagcggggactgggaaggcgagcagggctcgcccatcgatgcgttgcgggaagacctggagtcctccgacgccaacccggacatttatttgtgcggtccgccgggcatgatcgatgccgcctgcgagctggtacgcagccgcggtatccccggcgaacaggtcttcttcgaaaaattcctgccgtccggggcggcctgaaccggggaagtaccgtgaccaccgagcagttcccgccccaattcctgcgtgaaatgatcgagcagctggacgccagcatccaggagctcgcacgcaaggaaaagggacttgcggcatccctgggcacgggccgggtcgccgagctcaaggaatactgggaccacgttctcactcccgaggaggaatgggagctcaagcgaccatggacttccgcgaccgggaactggtgtggatctggtcccgtctcaggcgggcccgaacctcccgcgccaatgccggggaggcctatatcgccagctgtcgccggcgccgcgaaaaaacgaacaatcctgaaacggagtcgacgggtatcgttgggaaaaaggttatctgtcgccctattttgtaacgttccgagcccatcgcctggcgccctgtgcgacaaccgttgcaccgtgactcaggcgagcgactcgagttgtttgccctcatgtggtcgggccatgctcgccaacagacaatcgtcggaaggtgcggctcgccctgggagcatgaggccgatgtccccgcacgactcctgggagcccgggacgagctccgtcacggcaccgagccagggctcgcagcaagacccgcgcgagcgctccgatccgatcgtcgcatcgagcgcacgagtcggagcgcagacgatctgctctgcccgtcactcatcgagccgcggtgctgccgcgacgattccacgccagcgtgacctcgacccgctgcgtggcggggatgcgcgcgccggggcgtcgctgtgcccgaacagccggggcacacccgagccatcggtccaccaaaccgccctcccatggtgatcgacgccgccacgctcagacgcccacccaaaggcgcccacgcctggccctggccatcaccggctcggcgctgcgctgcaggctggtgcgcactagcgaacgagcagatgccagccgagccatgcccacccgagccacgccacgacgcgccacagccgcgagcgacgcaggcctcccacgaactgtgccgggcccgcgccgacacggttcagcaccacccacgccccgatcacggctccgacgaggacccaagccgcccacgcgctcgtcacgacgacaccatcatggcgcgaggagccaccgaccgagcacgacccacgcggccgccagcacgctccgaccgagtccgaagccatcgaccttcgaccgcagcacgaccgcctcgaccatcgacgagaaggtcgggtagtgcccgcgcggtccgtggaccaactccaccagttcgaccgccgtgaacacggtcgcgacgaccaacgccgccaccaccgcagaccgcacgacgcgggcgatcccgtcggtcgtcgtccagggacgagcgacaccgagaccccacgcgatcagcgctccggtcgcaaggcgggcaggccacgtgaacggagtgctcacgccctcgacgacgatccctgcggcgacgagcgcggcccctaggagccagatggcgcgccgaggcgcgcgaacgtccataggccccccatcacccccgcaagcgcgagcgccccgaccgaggccacagcgacgacgaggctgcgcggacccgtgctcgccgcaacgccgatgccgagcgcaacgagaaccgcgctcacgacgacgacaccccggcttgccgatgcggctcgcgcgatgcgagcagcatcgaactcggccgcacgagccgccagctccgcctcgagacggcttgcgcatccccctccacggccctcgcacgcctcgcacgcttgggcgcagccaggctcgggtggcgccggacgtggtgcgctcgatctgacgactaccgcgccgacgacgacccatgcaaccaccaagcccccgatggccacgctggacccgacgccggcaagtgcgcccccaacgatggccgcaaggacacctccgaagccgaagccaagcagccaacgaccgctacgaacaccgcgctcgagcgcacgaaacccggaggtcgtcatgccaggcagtctaggcaggtgattcgccagtgcccaaggcgggagcttccggtgcgcacgaggcgcagctcgtaggccgacgaccgtgtgcgccagcgtcgactgtccgaccctgtccggggctcaccgtaggatcatgctcgtggagcagctcggcctcgacgacgacgggaccgatctgcgaaccgtgcgcttcgccatcctcgacgtcgagacgaccggagccgcatccggtgcggacgagctcaccgaggtcgccatgatggtcgtccaagagggccgtgcgctcgctcacctccaaagcctggtacacaccgaccgccccattcccccggcgatcgtggcactcaccgggatctccaacgagctggtcgccgacgcaccgagcgcccgcaccgtcatcgagcgcacggctcgactgctcgagggcaccgtcatggtcggacacaacgtccgcttcgaccgcagcttcctcggcgccgctgccgatgccgccggcatcacactgcccgaggtaccggtcctcgacacgctcacgctctcgcgcgtcctcctcgacggagaggtgccgaaccaccgtctcgccaccctcgctcactaccttcagctcccaccgccgagccatcgggcgatggcggacgtcgtcaccactgtggcgctcctccaccgtctcatcgagcgggccggtgcgctcggcgtcaccaccctcgagggactcctcgcactgcgacgcccacgtcgcagtggcgccgacctcgagcgccaggccagacgtctcccgcatcgacccggcgtctactacttccacgacgcgggccgggtgctctacgtcggtgtcgcgaccgatctccacgatcgcgtgcggtcgtacttcagcgccgacacacgcacgagcgtgcggcgcctgctgcgacgcgcctccagcatcagtgcccggccggtgccctgcgacatcgctcggcctctcaccgagttggccgagatccagacactgcgaccgcccttcaaccaagtcggcgtccgacgcccgcgcacgcgatcattcgtgacgcccgagggacgcgtcatcgcgccatggcccctcaaccaacccgatccgcccccgtcgatctcgacgtgcttcgatggcgacgcccacacggttgcgagagcgctcgaggaggccatcaggcaccttcaggccgagatgatccaagcgagcgacgacggtgagtacgaacgggccgcggcgcttcgcgacctcggcgccctcgtcgcaacccgtgtaccgacgagcctgctccacgaagtccaccgggagggtcgcaggctcgggctcttcgacccccgctgcgacgcccgacacgagttgacgggccccgagggactcctcgatctcggcccggacgatcctgagcttcgaagctaccgagcgctcctcgtgctgcgtacgatcgccgaacgtcgtgacctcatcctcgacgacgagctcgcccccctcgtcgccctcgttcgtgagagcgtcaggttccgccgcggctcagtcggcgccgcctcggatccgagcaagggtctcgcccgctcgtcctgagctgatcgcgtcgaccgccagctcgaagccgtcgacgatcgtcgccgaccgcccgtcgacccacaaggccaccgcggcgttcagcacgatgatgtcgcgcaccggaccgcgtacccgcccctcgagcacgccctcgagcaccttggcgttctcctccgcgctgccaccacgcacagctcctgccgccgcagtcgcacaaccgagcgacgttggatcgagcacgccagcctcgagctcgacggcgcccttgccatcggaacggagttccacgaagcgcgtcggcgccgacaccgacacctcgtcgagtccatcgtcggagtggaccacgagagcatggcgcacgccgatcgcggccagcacgtgcgcgaccggctcgagcagcgacggactccacacgcccacgagctgcgctcgagcacggccgggattgaccagcggtccgagcacattgaacgcggtcgggacgccgagggctcgccggacgggcgcgacctgggccatcgctggatggaagcgtggcgcgaacgcgaaaccaaagccggttcgttcgagctcccgacggagctcgtccgctccgagctgcgtcgggacgccaagggcctcgagcacgtcggccgagcctgctcgcgacgacgaggcgcggcccccgtgcttgagcacgagcgcaccacaggcggcagccaggagcgccgcgccggtcgacacgttgatcgtgaacgcgcgatcgccacccgttccgcaggtgtcgaggaccgggcccggggtcgtcaccggaaccatgtggtcgaccatggcctcggcgaaacctgcgagctcctccggcccctcgcccttggcgcgcagcgccaccagcacgccggcgatcacgaccggctcgacctggccgtcgaggaccgcgtcgagaaagtcgcgcgcgctgcctcggtcgagactgcgcccagcgaggaggtctccgaggagatccgaccaggagtgcgaatctggcgtcacgccccccaggctagcgaagggcacgtcggcgctgacggagcactcgtgcaaggccgcccggactgagcggacgaaagaagtagaacccctgcgccttcggcacgccaagctccaggagacgcgcggcggtgctggcgtcttggacgccctcggccaccagctcgacaccgagacgccgcgcgagcgagacgagcccgtcgagcatgctcgagccgttcttcgtacccacgttggccacgaagcttcgatcgatcttgacctcgtgcacggcgagcgtcgcgaggtggcgaaacgacgaggtgccgacgccgaagtcgtcgagggccaccttgatgcctgctcccgcgagtgcctcgagggtgcgtcgtagctgctcgagggccgaggcagcgatctcggactccgtgagctccacgacgacctggttcgcggcgatgcccgatcgttcgacgagttcgatcaggcgtgacgcgatgccgcgccggcgcgcactctcggccgacaggttgaacgagacccgaagccctcgtgccaccccggtgcgctcgagctcgacgacctgacggagcgcgagcgcgcgcaccagttcgtcgacgcgctcgacgaggcgaagatggacggcgatcgggaggaaacggcccgggagcaccgtaccgagcctcggatgctcccaccgagccaacgcctcgacgccggcgatctggccggtcgcaagctcgacgaccggttggaacacgacgccgaaggtgcccgcctcgcgatcaccctcgagcgcgcgtaccagttcgggcgcgagcgcgatgtcggccggctcgagcggcgcggtgacgcgctcgacacgagccaccccccgacgctcgagatcggccacgaggtcgcgctcggcgcgttgcacggctgcgagcacgtccccgtcctgaatactggccgcgccgagcgacaccgcgaccccccttgccccgagtacctcgagcatgtcacggcggatcgtgccgaaatcacgcgaactcgtcgtgccgacgatgagagccgcaaactcatcgccaccgatacgcccgacgaccgcctccggaccgagagcctcgaggaccccagtgacggcccgtaccaggtagcgatcacccgctgcgattccctcccgttcgttgacgtcccacagctggtcgagatcgatcagcagcacgtacgcgcccgaacggggcccttcggcttccagtcgctcgctcgccctggccaggaaggcctgccgatgccagacaccggtgaggggatcgcggtcggcgctctctcggagtgcgtcggtggccgctcgacggaccgctgcactcccagccacgacaagacaccgatccaggccgagatcgatcacccactccggatccctcgcggcagcggtcgcgatctcgatgcgccgttgctccgtctccagcacgatcgacatgccaaggctgttggcgagaggcagatgctcctcggcaccgaggtgtgcgccaagaagacgtccacgatcgcggacgtcccagagcgcgacgagtcgggcgaggcgctcgagcgccaacacgtcgccgacgtcgaagcgatacggcaccgcatccagggcggcgagcacgcccacaggcccatcggcaccgacgagcggcacgacgagcgcactctcggccgagacgacgccccgaatggcccgcacggcctcgctggggacgcccacgccagcctcggcagagccgacgaggacgctcagctgattccgaagcacccatccggcgaccccggcgcccacgtccagctcctccagcaagccgaagtcacccgtccccgccgcggctcgcacgacgaggctccgcccggcgacttcactcacgaccacctgcgatgcgccgagcaccgacgcgccagcgcgaccaaggaggcggaggcgatcctcccgagactgatccgagactcgttcccctatccggagcgcccggcggagccgatcggcccgccgccgctcatgatctgccatgaagcttgccgcagcgatccgaacggccggtgcaagccgctcgacgagggccaacccagccggatcgacgccctccgcagcgcccgcaaggaacagtcgctctccgagcgcgaggacccagaaggacgcagcgtcaaccccgacctcgacaaccgtgccatcagcaaccgctgcgagcgccgcccactccagaccgacgaggccacccatcgccgtgggaccacggaccacgcgcaggcgcgagaatccttgatgcacgccgagcaccgcgcacggcacaccgagcgctgcggacaggactccgaggagctggtcgagcacgccgtgcggtgatgacggcgcggcgagcacgcgcgagatggcaccgtagagctcaccttggcgctcgcctggagatggtggtgccggcagctcgggccgagtcacccgaacctcggccacgctgcccctttggcatcaacgctcgttcaatatcccgaccgttcgcaacgttacacggtgctaccatcccggtgtgcgcgacatggcagcgaccgacaccacctctcgcgagctgttcgcccgcatctccgccatcgtcggcgcaccggaccctccctacgcccgcctcgccaggctcggcgagctcgccgagcaggtcggggcccgactgatcgttcgtgacggcctcggcccaggaacagcctccgtccgcgcggccccctcgccagagctggggagggccatgggtgacgccgccaacctgctcctgcgcctcgactaccgggcacgtgctgccgagcgcgccaacgagcacctcgccgagaccgtgaccgcactcgagctcgcgatcgatgcggcgacgagggaaccgccgatcgagacccacgcaccggcgttggcactgtggcatctgccggtcgcgctactcgtcgtggacgagcagcagcggatctgcttcctcaatccgcaggcggctcgcctgctccagctcgacggtgccgacgtcctcggctcggtgtggacccgagcgctcgcgagtctcggcgaggcccagctcgatcggatccgaggtcactttcgtgcctccggacactttcgcggcgtggccaccgtgccatcaggcgatgacggccgtcggtacctggccatcgacgcagcgacggtccacgcaacgtcgtcgcacgcggcacgtcccctcgtgcgtgtcatgctctgggatgcgacgcacgcggccgtggaggcgagctggctgcagtggaccgcgacccacgaccctctgaccggcctgttgaaccgagcgggcctgaccgaacacctgcgaacgtggggagagcgacccctgcccggcctcatctggctcgacatcgccggcttcagcgacctgaaccgagcgctcggccatcgtgtcgccgacgagatcctccggcatgtcgccgacagcatcatgaccgaactcggacccgacgacctcgcggcacgcgtcggcagcgacgagttcgccatcctcgtggccgacggggccgccgccaagcaacggcggtgggccatcagccagagcgcaagcagcctggggagagccgcgatcactgcggacatcgcggtctcgctccggagcgccgtcgcgacccatccacgtcccggcatcgagcgatcggcggcagacgccgtgtgggaagaactcgggcgcctcgcgaggatctcgcgggagatcagccatccggccgctcgcggccgtcgacggttcgcgccacggggaagccaccaacccgccgacgagctcgaccatcccagcgtgcggtggatccgcctcatcgacgttgcgacctcctctccgagagggcacgaactcgtgctcaccgatcggaccggtcgcccactacgcgacgacgcccgacgcgaccacgcggccggtcgctacgaccgcgccctcctcggtgcgttggcgaggaccgcgcatccaggtggggtggtcgcggtgcgtctcctcgagccctcccacgagctcctccgcgctctgaagaccagtgaccgcgggtccacggtgcaggtcaccctcgaggcagacgacctcgtcgcgaccccggagcgccggcgcgttgccgcgaccatcgctcgcgaggcccatgcgctcgcgctccgggtgggcctcgacctcggcgaacgccacggcggtgaactccagctcatcgctgcgctcgagcccgagcagatcgtcatgccgctccaccctcgccgaacccgcccacgaggaccgctcgcagaacccacgactcgactcgtggagggtctggccgccttctcggctggtctcggctgcgagttcgtcgtgaccaacgcacgagtccaggacctcgtcgtgctgcgcgagatcgctgagcgtgcagggggcaccatcatcgccgcgctggcgtcgacctttgctaccagcccgtcgtgaatgccccctcgggatcatcccaccacaggtgctgatcgagcacgccacgggcgatcaggttcaactgcacctgcgaggtaccctcgacgatggtgagctgcttcgcgtcgcggtagtagagctcggtcggatgatcgctcatgtaaccggccgcgccgagcagctgcagcgccacggagctcgcacgcaccgcaagttcggtggcgtagtacttcgccatcgacaggaagggcacccactcgcgggtgaaccgcccctggtcggcgagccaggctgcccggtaggtcagcaacctcgccgcctcgatctcggtcgcgagcttcgcgagctcccactggatgccctggaagtccgcgatccgaccaccgaaggctggacggtttcgcacgtacgtcgtcgcgtacatgagcgcgccctcggcgagcccgatcccccgcgcagccaccaccggacgcatcgcgttcagtccgagcatcgcgaggcggaaccctcccacctcgccgatcacgttctccggaggcacacggacctcgtcgagcagcagctcaccggtgtcgacgccgtgcacacccatcttgtggtcgaccctcggcacatccacccccggccaggaccgttcgacgatgaacgcagtgatcgcatcgtgccgacgcgatgtcggatcccctgtcttcgcgaacaccgtgtaccagtcggcctgccgcacgccagagatccacgacttccgccccgacaggatccaaccgcccggacgatcggggtcgggtactgcccgcgtccgcatgccgaccacatcggagcccgcctccgcctccgagaggccgaacgaggcccgctgggttccatcggcgatgccgggcaagtagcggcgcttctgctcctcggatccagcgatcatcaccggacccgtcggcaggcgcgacagcaacagcatcaagcccgcggtctgcgagaacttcgcgacctcttcgatcgcgatcgtcagtccgaggatcccagcgccagaccctccgtactcctcggggatgcacaggccaaacagacccgcggaacgaaagacctcgaacagatcgtccgggtacgtcccctcggcgtcgatcgcccgcgcgcgcggtgcaacgtggtcgcgtgcgatccgacgcacggtcgcctggaggtcttgatagacgtcgtccaactcgaagttcacctgcgactcctcgctcggatgccgggagcagcgtagccgacaccatgtggtggcgccagctcaccgacgtccccagcgccgtcggcgacaggcgcgggcagcgagcagcccggacccttgcgctgggactaccctgggtcgcatgctcgtcgcggtcctcgatgccggcaccacgacgcttcgcgccagcttggtcgacgacgacctgcgcatcctcgccaccctcgaggacatcacgcccatgctccgaagccgctcgggtgaggcgtcgttcgacgccaacgaactggcacgccgtgcacgccacctcctcgacggtctcgcacgccgcggtcgagcagatctcgtggcgctcaccaaccagcgcgcgagcgccgtcgtgttcgacccgacgcaccgggtggctctggccccggggatcggttgggaagatgctcgaaccgctgcgcgctgtctcgaactcgcacgccacggcgtcgtggtctcaccgagcgaatcggcgaccaagttcgagcgcctgctcgccatcgccgaactacccgaccacgcccaggtgggcaccgtcgacgcctggttggtcgtgacgctcacagggtccgcctcgaccgacccgacgaacgccgcggtcaccggcctcagcgacaccgaggcactcgcctgggacggtgagcgactcgcactgcttggcatcgcgcctgagcgactcgtcccgatcgagccgagcgtggggccccggggccacgtgcgcctcgggggtcgcgacgtcccgcttgtcgtcgtcatcggggaccagcaagccgcgcatgcgggccatccggagctgacgaaactgaccatcggcacctcggcggtcgccgatcactggctgggcgcagcaagtccaccattcgcacgacgtggcggcgccgggagcttccccgtcgtgctcgtcgacaccaccgagccacggacgttcggcctcgaggcgttctggcctgcagcgggctcgacggtcggctggctcgttcgccgcggcatccttgccgacgcagccgaggccactcggctcgccgagcgagctggctcggccgtaccgctggtcgtacccacgttccagggcgcgggcgcacccctctgggacctcggtgcccgaggtcgcatcgagggtctctccgcggcgagcggcccggcagaactgacggccggcgtcctcgagggtctcgcccacgtgggggtcacgctgttctcggtgctcgcagccgaccgagcagccgcggggtacgctccagatcttggcgacgtcgcgctcgatgggcgcgcaggccacaacccccgagtcgcaggcgtgctcgcgagcctgctcggcagaccggtcgcgctcggtgtccagccggaggccaccacgatcggggctgcgcgactcgcactcggtctaccccgtgaggcggttccgcgtgggcctctggtcgaaccaggtcgcatccggccggtccacgaccacgacagctggcgagcagccctcgaacgatcccggggcgccgtacctgccctctcagcggtcgccttctaggccctcggacaacgccgtcagcgggccgacgagtccgacgagcgcacagccggccgcctcccggtcgttcgcaccttacgcagcgtgaaggctcggaaggtgccgagggcatcgatcacgccgtcctgctcggcggtgaggaaatcgcgcagcgtcacgacgcccgcgatgaaccaaggaaccgctccaaagacccacaagatgcctgccgcgatctgttggtcagcctcgagcgagagcgtgcggagcgtccccatccattgctcataggcgctgtaccagggttgcgtcgacaacccgaggacgatcgcgaggatcatgcacgacatcgacacgatcaccatgtgcgcaaagcgcacgatgggcgactcgtgctggcgccgaggattcggatcgaccgcgacgtaccacatccagatccccgaggtgaagaagctgaacatcatgagctccatgcgcccgcccgaggccatggcccaatcgaagggcccagggagatgccagatccacatcgcagcgtcgaaggccacgaccgcagaccacggcgacgacaccacgccccacacgcgggcgatcggcgcatgtgctccgagccggccccacagacgacgcacggcttcccgaggtccctcgggcaccccggcgacgatctcaccccaggggtccgcgcggacgatgagcggtggcgcgaggatcatgagatcgaggtgccagatcatgtggacccactgatagaccatcgaccacgccgcgatcggcgagaacagcccgatggcgagcgcggccatcccacccagcatgagcagcgctcgccgctcgtagcccctgcgaagctccggatcgtcgagggtgcgcatcacgatgaggtgaccacgccaatagagcgcgatgggcagaccgaagatgatcaatccccaccagtcgacggaccagttctccaggacgtacgcaaccagaccatgtgccggctggatggccatgctcatgccaacgatccccacgtccacctcccaagcccgacggccgtggccccagtcctcaaggctagcgcagctaggctcagagcagctgagcgacgagtggcgcgcaggaggatcgggtgacccggacgatcggcgtcgtggggggcggccagctgggccgtatgctcctcgaggctgccctggccctcgatctccgcctcgccttctacatccgccccggcgagcagggagtcagcggctgggcgacgtcggtcgtcgaggggccactcgaggcaagaccactcgcgagcttcgcgaacagcgtggacgtgctcaccttcgagcacgagctcgtcgatccagccatcctcgcagcactcgaggcccaaggggtccagctcgcgcccggggctgtcgccatggcgaccggctcgaacaaggaacggcaacgagctctcttcacgacactcggcttgcccaccatcccggcccagctcgtcgaccgcgacgtgggtgaggtgcccacgctcgaacccccgtacctgctcaaggccgtccgaggcgggtatgacggacgagggctactgcgcgtcgacgcgacggttgagctcccgcgcaccgggcggtggcttgccgaaccgctcctgcccatcgcgtccgagtgcgcggtcgtcgtcgcccgagcggccaacggcgaggtcgcgacctgggatccggtcgccctcgtgcatcgggagggcatctgtgtcgaggcggcctggcccagcggtctcgaacctcgactcgagcgagacgtcgtccgtgcagcacgaaccatcgccgatgcgctggactacgtcggcgtcatggccgtcgagttcttcatcgtcgacgacgccatcgtcgtcaacgaaatggctccgcgagtccacaactccggccacctcactatcgaaggagcagtcacgtcacagttcgagaaccacctgcgcgccgtcgccggtctgccgctcggctcgacggagtcgatcggaccggccgtcatggtcaacctcatcggcgcccgacacctcgagcgggtcccgacggccgcacgcgtgcatcgctacgggaagacaccccggaccggccgcaaggttggccacgtcaccgccgtcgccgcctcgctcgacgacgcgcgtcggcgcgcctgggccgcagcgcgcgacctcggaggcgagctcctcgatgcgccctgggagcttccatgacaccccccgtcgcgatcgtcatgggttccccgtccgactggcccgtcctcgggcacgcagcgaccatcctcaccgaactcgaggtggagtgggacgcacgggtcctgtcggctcaccggacccccgacgacatgctcgccttcgcccgcgacgctcgcgacctgggattccacgtcatcgtcgcgggcgcaggtggcgcggcacacctccccggcatgatcgcggctgcgacaacgctcccggtcatcggggtgcctgtccgcctcgccgccctcgaggggctcgactcgctgctgtcgatcgtgcagatgccacggggcgttcccgtcgcgaccgtgggcatcgacaacgcgacgaacgcaggcctgctcgccgcacgaatactcgcgatcggtgaaccggggctcgccgatcgcctccaggcgtaccaggccgccaacgcggagcgctcgcgaggtgcggtactgcccccaccctcaccacactgaggaccaactacccaccagatggtcggtgtcctcgagcggctccggcgactggccgaccgatcgtcggcgcactgcgacgacgcacggcacccatacgcgctcctcgtcgagagaggaacgctcacgagcgttggctctatcaccgtcggtcggcacgacggatgcgggcaggtgcgtcgagccttcccggagatcgtcgaccgatggagcgctgtggtgcgaagcgatccacagctcgcacgcgccgagtgggcgcggggagccctcgctctcgagagcgccacgggcgcaaacgatcgatcggccatcgcgacaccgatcggctcctcaccagcgtggttcgctgtcgtttcggtcctcagcactcgaggacctcgcctcccaatcgagcggggacgaggcccccgcgaccgaaccgaccgccgccgaggccatcgtcaacgcctcgcgcgctgctcgcgagcgatataaccccatggcaactcgccggcccgatgaggcgtccgctcgcgccaaggaacaacgcctccgagtcaaggaccgcgccacacgggctcatggccgatggggccagacggccccacgcccagactcagcccccgatcgacgggcgcccgctcgaggcgtagccagcttgcaggtagagctgagaaccgacaggcgcacccgcataaccgttcaccgtttggccaaccgctggctgctgccacgaccgtgagccgatactcagctgctcgacgagagcgcctgcggccatcgtgatcaccagcgccacgacagccacgagcaaccacgccgtgactggggggatgcgatggatgggccgatcgtcgcttccacgacgcatcccgacacgccttcgcccgatcgccgccaacctgacctcctcagcacccagacaccctcaggctgcacgacgccgatgcctgcgccgtcgcacaaaccccgctggacacgaactcgttgcttccagcagccggctgccacgatcagcggacaggatcaccgacgagactcacaacctcgtgccgaggctaccaaacacgctcgtcgacgaccaagtccacagctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtgaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgggacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatgtcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagttcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagaacgtcaacctgcacgtcgacagcggcgacctcgtcgagctcgcgttggccaaccgactaggacgatcctctcgatcgcgatcccctgtcagcatgcacgcctcgctaccgtaggacagcacccggggaggtgctagcgcgactcccttgcgtgcatcgtggtccttcgccgtctctgtctggctcgggttgcgaaacgcgcgactcgagacgagacaactcgtgacggttccgcctgggctccgcgaccccctcgagcccagccgtagtcgcactacgcgcagccgcctcgttctcggttgcgatggctttcaggagttcgtctcgcacgatgcgcacgtcacgtggcgcgacgatgccaaggcgcacgccgccatatggatcgatcgcaagcacggtcacgacgatgtcgtcaccgatgacgatcgattggccgagcttccgagccaagacaagcactagcgagacgtgccacgcatgagaccaacgacgtcacgagtggtcgcgacgaagatcccggcactgatccccaccaggaggacgccgatcgctccgaggaagagcatggccaagccgagggcccattgaccaacgagtcgttcgcggatcaccttgtcgacgccagcacctgcaacgaacgcgaggaggcagcctgcgagtgttccaccagcaagcgtcgccatcacgatgaggagcatgggaacgagccacgccgccgccactatgaccacgaactagggtgactgaagacgtcaataatgcaaagccaatgaaccacggccaactatgccgaagccacgaacggcgtgcgaggcgacgccggcgtcgcacgcctgtcggaatcacacttacccgcacacgcgaccccacttcggaaatggaggattacccgaccctccatactggccgttcatataccagtagagatcgccgttgggactttctaatggctgatcagcaacagcatgcgcggtagggaagctgaaatagtctgcccatgtcggcgtcgcgagcgtgacgttgagcttgccattcaccatgacccaagacgacgacgatttacacaccacgacgtcgattgcgttcttcgtcggatgcaccgcgaactgcttgttggagatactctgctgataaaacgtcttcggtgaaggcagataggtctgattggtcggcgtgatgctggcaaagaacgatgcagtcggtgcgacattggcgttcgcggtcgagaggtactgcgacagcatcgtcgacgccgggattggtccgttacccgcatacgggtcgaagagctgcgccacatccggcagcacggtgacctgaccgttctgctcggtggtggcatagctcgagctgtagagcccgcccatcaccccgagggtgcgcgccgtgtagaccgcatcgcgctcgagcggcgtgagcttcgtgccgacgtagaccgggccgacatacggcacgctggtgtcgttcacccatgcgccgagcacgctcggcttcggcacgcgcaacggcaccgggatggccgggtccttgggcggaatgagcaggttcgacagcggcaccgagttcggatcgccctggtagatgggcagatcgttcgcggcgtcgaacggatactccttctcgagctgcgcgagggtgaggttggtcggcgcaggggccgtctggctcgagctgctcgacgaggcgttcagcgagctcggcacactgggctgtgacgatgagccacacgcagcgagcaggatggcgctcgtgccgatgactgcgccggctgttgccgtccgcaagcgagtctttctgtgcatcactcccctccttgacttgcactcagtataacgcgctgaccatagtgcgtgagaagcaccgcatgatccgagtgtgacacacgagacttgcgaacgcaagggccggaggtccgtgcgtcatccctcctaccgagagatatgcgtgtgcaacgaccgttgcccgtagtaaccacaaccgatgccatcgacctactgtccgagcaggtgcagcgcgttcgagaggccagcgttgccgaggaacagaccaacgatgacagtccccacgaagacgaccatgtacgggagcaggagcaacgaagcggtattctgtcgcgagcgaagcgtctgatccacgagatctgtggtctgacgccaggtttggtcgatgagcgaccgcaggaccggcaccagaggtgcgccggtgcgctgagcctgcgcgagcgcagagcccagcgtgaccatgatcccgacctggtaggtgcgtccccagtcactccagacctcagccagtgtgcgcttggcaagaccggtcatccagtcgttcagccaaacacgcccacgagggttggcatacgtgccgtagacgcgaaagtactcgctcatagccgactccattgtgccggcgccggcggtgagagccagccggaggtaggacaggatcggtgcgatgagcagggcgctctcagcacgagcagccttggcctgactgcgaaggtatgtctcggcgaagacgaggcccccagggaacgcaatgatgatgccgacgatgccaccgatcaacgcgaggttcatggacatgagcttgatgaagacgagtaccccgagcgtcgcaacgatgagcagtaagagcatgagcgacatgcgcatgacgaaggacgcgaactcgtcggtatccatcccgagcaagtgaagatcgacctggagcagctcagaggtcgtacgccgttcgagggcgttcatcacgaagcggacggtcgccgagccgctgcgagtacgcgaggggtggtcatgccatcgcgtgaggcgtcgagatcggcggtatccaatcaagccacgtacgccggcgacgagcgcgatcgcgaacaggccagcgagaatcgagatcccgagtggtgacgagaaccaagccattgacgtctcccgaactcaaacaaaccacgtcgacagcgcgaacggcctgcgagagaagccgacgacgacgatcgtgatgaccagcaggatgccgaacgcaagctgcatgagtaggctcgcaaagagatggtgctggtagacgctggcgtagtaggcaccggcaccaagcgacgtcaagatgccaaaaccgagcaggatgcgcgccaccgtgatgttgggcacgatgtaggtgcggtaggccatctcgaacgtcgtgagctgaggcgtgatggcctcgaggaggtcctgcacgagcggcgccacactcacaatgcgcgatccagccgtgaggatgacgacctgatcgatgacgcgactcggtggatcgtcagcggtggcgatgagctgctcgatgttgcgctcgtgatcctcggggtcggtcgcatcgaagatcgcctcgtagatgcgctgacgactgcgtacgaagaggttctccgggttcgcagcaagtgccatgcgaacgatcgagaccagcgagacgttaccaccgctcgtcgcggtcgacgcgagtgatgccgcgaaggtctggaggtcgcgcagtcgttcgatctgacgttgcgcgaatgtcggcgtgacgtaggtgtcgacgaagatccacgccgctaccccaccggcgatcgcgaggatcaggtagtgcaagagaccaaaaacaacgccaaccacggcagcgatcgcgagacgaatgtcgatgctaggggatccaaaggtctgataccaagcaaccttgacctgaccaaccgtaactgaggcggccttgatcggttcctcgagcttggggtcggtgggatctgcgcgaaacacgaggagcatgccgaccacgatgacgacaacgccaaccacggcagcgacgacgagtgctccggttggggtcatggtcgaacctccgtggactcggtgagctcggtctcgagaagccgggcggtcacgaggagttgctcgagtgcgccgtggcgccgacgccggcgccggtcacgggagtcgaagacgagtgactggatatccgggatcaagacgtcgccagagagcggtggcgtcacgagcagagggatctgactcgcgccgagcgacgcacgaaccgcatcgacgaaaccgagggcccggtcagcaaggagcacgatcgctgagggcgtgagcccgtcgcgcacgagctgagtgagacgaccgaggtcgctcggcgtgggagccgtgacgaggaccaagcgctcacaactgctgagccacttgagcggtgctgacgtctcgtcaaagatgtaacctgcgtcaacgacgctgtggacacgacggtcttgaccagcaagccaatcggccatcgcggtgagcaccgtcgcgagatgagaccgcgtcaagatcccggccatgggatcggccaggagcgtcggaagagatcgggcctcttcccaccgttcgagggaatcgagcacgacaccactggcaaggtccaccgtggcagcaaggacgatgccggcggacagcgatgaggcgtgttcactgatcgcggcagcgatcgcacgctgacctggcggctgaggagcatgctcgcgatcacggatcgcccatgtcgattccatgccggcgatctcgatgagcaggcgtcgtccaggaacgctgtcagcaagcatcgttgcaaggacgcccgtcgggagatcggtgctcgtggcgacgacggcagtacgcatagccctagttgaccgtatgcgtgtggaccgacggctgaagctgcacgatggggacgggctttgcgttcggcggagcgaaggcgatgaccaggttcgaagtgtcagcgacggcagcgatgtcgctcgcctcgttcggtgggacctcgatctcgagctgcgacgaaccaccgttgctcgacgggatgacagcaaggacgggaatcgctgtggcgaccggaatgtacggtgcaggggcggtgtaggacatgggcgcgttcgacgacccacttgacgaccccgacgcctgggcctggagcggagcgtaaatgtccaccgtgtcgccagccgtgagattcggggggatgacagaaggcgtcaacacaaagacccggtagttgccacgcaggtgcggcgcgagctcgctcacgagcacgggagcgttctgtggaatcgtcgtcgtcacgacttgattgttgagcacacgcacgttggcgaccgggatcatccccggcgtgaccgactgctgtggcaccgcctcgacagcgaggtctgacttcgtcggcacttcccctgggacgagtggcttggctgccacgacgatgtcgaccgtctgcgactgcttggagaagaacgagtagaccccaagagtaacggcggcaccgagcgcgacggtaccggcaatcttgagagctacagaccgacgctggcgagcaagtgtcatgcgggtctcctttgttggtgtgagccgccccagattccgttgacacgtcgtaagtcacacgtaccatggcagagggaaggggaggtcgatggggacgtcgagaaggaagttcaccctggagtaccggaccgaggcggcccaccgggtcatcgacagcggccggagcgtcccagaggtggcccgtgagctcgcgatcggggagcacaacctctatcgatgggtgcgggaggagcgcaggcggatcgaagcagcaaacgccactggcagcccgcccctcacggcgcaggagcgcaccgagctcatcaggctgcgcagggagctcgaggagctgcgcaaggacaacgagttcctgggaaaagcagccgcgtacttcgccgcgaagccaccaagcaagagagattcgcgctgatggaggcggagtacgctcgcttcgagatcaaacggatggcacgcttactcgaggtctcccgggctggctactaccgatggcgacgcacccaggtagcaccgtcgcgtcgggcatgtgcaagacgcgacctcgagaaccgagtggtcgcggtccaccaggcatcctctggcacctacggcgcacgacggatcacggcggcactcctcgccgctggcgtggtgacgagccacaacacggtggcagcagcgatggccaggcgcggcatcgccggtatcagccccaggaggttccgcccagcgaccacccacgccgatccgaaggcgatctacccaccagacctcgttgccaggaagttcgacccggggcgcctgcacgccctctggacctcggacatcacctacctcgctctcgccggcgcgatggcatacctgtgtgtggtgcgcgacgagcactcgcggcgggtgctcggatggagcgtcgcggagcgcatggagaccacgctcgtgctcgaggccctcggccaggccgtcgcggtgcgtgggtcccacgcgcagggggtcatctggcacaccgaccgagggagtcagttcagcgaccatcgagttgtggccttctgtgcccgacacgggatcacgcgctccatggggcgaaccggcacctgctacgaccacgcgagcgcggagtccttctggtcgatcttcaaacacgagttcttctaccgccacgcctttggcgacctcgccgagctgcgccgcggcatacagagctacatccagttctacaaccaccagcgcagctgctcgaagatcggctaccttgccccagtcgtcttcgagcacctcgtcgcggaggaggctcgcgtgaagtaacctgggtgtctacgaaatctggggcacctcagtgagttgcgctcagcctaatcgcaagggacatgtcgtgagttgcagtgatgtgcgtgtgcctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtgaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgggacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatgtcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagttcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagcatggagtgcggaggtggccgggcggccgcgggtgacctcggtcacctgaggaaggtcggggctccagagggcagggtgctcgcgagaggcgagtcggggtgacccgcaggacagtgcaacagagagcagaccgccgatggatcgacgatcgatcacaggcaagggtgaaacggtgcggtaagagcgcaccagcgacttcggcgacgaggtcggcttggcaaaccccacccggagcaaggccgcagtggagcagggtggcccgcccgtcacgctcctggtaggccgcagagatggatggccgcacaggcggccgtttgggccgctggacagaaccccgcctataggccacctcccgccaatccttcgcccacgagccaggcgccacacgattcgcaatcgacgtcccgccctgccgcgaccgcgccaaggaccgcacccgagagctccatgtgacaggccgaacaacgaccagcgatgctgagcgccaacgcgcgcccacgcttggcccgagcttcgatacgcgccctgagaccagggtcgagtcctgcgagcgcctcggcccacgccgcctccgccgtgcgcacagcctctcgacgctgctcgcgctcgacgtcaagggccgcccggagttcggcaacggtcccaccgacggcgtcacgctgggcagttacctcatcgagggaggccacgaccgagtcgcgctcctccatcgcctcgagctcggcctcgtcgagttcctcgagcctggagcgcaccatggtcgactcggcctcgagcctggattgatcgcggaagccggcatggtcgccctgtccacggaggcgagccaggcgttcaccgagttcgtcgcgttgcgactcgagcgcagcgatgcgtccctcgacctcacgacgttcggcttcgagagccgccacgcgctggacgagctcagcgtgttcggcttcagcagcacgcagtgcggcagatggccggaccgcctcgagcgccgctcgcgcacgcgagagtcgttcctcgacggtagcgatctcgatcagctcctggcccatgggcaccatcctacgccaggcagcaagagctgcccccgaacgcgcgacagactcggtcgtgccgatcgcagcgcatgcgtcacgccgccacggctctcgaggccagcgcggcggacggcctcgccaccttgagtgcacggtcagtggggcaaggcgctagctcccctcacgagggaggaccgcctccacgacgacccgggtaccagcaacgcggtcgtggagggtctggcgagaaggatcgagaaatgcgacgagatagcccgtgaagagcatgacgaacgacagcagtgagacaacgaagcgaatgctcgcgcgtcgcatgccgaccgggccaccgtcttgagcctcgacccgaaggtgcgcagccgcctggccgagcgtttgggaacgcagtccgatcagcacgacgaagtaggcggcgatggcgagtgcgttcaggacgtagtcgaacaccggcagctcgaagcggtcgacctggaagatggggttcgacaggccagcaagcccgccgaggatcagttcgaagatcaccgagccgagaaacaccacgatcaggtcgacgatgagtccccacaaccgtcgccacggcgacgcgagccgcgatccgccatcagccgcactcataccctcgacctcccgcaccacatccgtccgccacgtcgaaccgcacagctcgaccacgagcccgggaaaccacgaccgcgccagtcgatgcaccatccgggagcgcgaagtactcggcacccgtcgacctaggccacctcatcaagcctagcgacgccaccctcgggagttcctgaggtccccgtcgctcgcgcccgttcgcgccagcgtcgctcggcgaacccagctgccgccatgatcacaagaccgaggacgccgacgacgacacctgcgaccgcaacggttcggaacccgcccaccccatagaggagcgatgcgctcgacgatccagcgacgccgccgaggaagtagcacaccatgtacaccatggtcacgcgcccctgggcgcccggtgcgagcaggtagatcgccgcttgattggagagctgagccccttggatcccggcgtccagcgtcgccgtgagcaccacgaaccagagcaacgacgaccgatcgaccgccaaggcgagccacgagagcgcgatcaggctgaacgaagcgaccgtggtgaccccggcgcgtcctcgatctgcctggtggccaacgacgcgggccgccagcacgcctgccaggcctgcgaagccgaacagcccgatgacgccggtcgagaggtggaacgggggccccgagagtgcgagtgccatcgtcgtccagaacatcgagaacgcagcaaagctcaagaacccgagtccggcccgcagtcgcagcaacggctcgcgccgcaacaacgccatggccgtccgatacaacacgacgagcgatcgctccttcgcaacccgctcgtgcggcaaccatcgggcgatcgcgagcgcgagcacgatacaggcgacgcctgcgacgacgaacaccgctcgcacgcccgccacctgcgcaagccatcccgcgtaggtgcgcgcgaggacgatcccggagagcaggccagccatcaccgccgcgaccgagcgtgcgcgacgagccggctcggctgccgcagctgcgtaggtcaccgcgagctgggccaccgacgagaagaccccaagtccgagcaggccgatggcgaacacgacgacgttgccggcgaaggcgaccaggagatcgaacgcggcgctgacgacgatcgtgatcagcatgagcctgcgacgatcgaagcgatccccgagtgggaggagcgtgccaagcccgatgacgtagccggcctgcgtgacggtgacgagcagccccgggctcccgccgcgaagaccgaaggtgtccgcgatcacgtgcagcaacggctgcaggtagtacgtgttcgcgaccgtgacgcccgcgacgagggcgagcaggacgagcggaagccgaggagcgcgttgccgtggaatagttgcagtctacgaggacttcatcgccctccggaggtctctacactgaggtggcccgagcttggaggtgtccatggacgcactgcactgcgtgatcgagatcccgcgtcactcccgcaacaagtacgaggtcgaccatgagacggggaccgtctggctcgatcgcacgctgttcacgccgatgggctacccgcttgactacggctacatcgattcgacattgggcgaggacggtgacccactcgacgtgctgctgtatctggatgtgccgacgtttccagggtgccatgtgaagggtcgtccggttgctgcgttcgtgatgagcgacgaggccggtcgcgacgtcaagatcctctgcgtgccccatggggatcctcgctacgaccacattcgtgacctcggcgacgtccacacgcacctccaacgggaagtcgctcacttcttcgagcactacaaggacctcgaaccgggcaagtcggtcgcgatcgaagggtgggcccccctcgagcaagcccagcgtgagatcgatgcagcgctggcgcgcttcgagcacgcccacggcaacgcctcgccgagccactagcctggcaggtgacgtccacccactggtcgcgccagcgaccgcgagctgggaaggaggcctgcccatggactcgccgaacgacgaacgcgatcccgaggccgtccgcgacctgatcgagcagctgcggccggcggtacagtacgacggtggcgatctcgaactcgtcgacgtgaacaccgagaccggcgtggttcgcgtcaggctgaccggcgcctgctcgagctgcgccatctcgacgtcgacgattcaactcggtgtcgagcggatcgtcaagggtcgcttctcgtgggtcaccgcggtggagggcgaactcgacgaggagttcgacttcgccgcctcggcagccctcggacgcggcggctgggtaccgcttcggccccccaccaccgcgtgaggtgcacgcccactcctcgcactcggtgacgcgcgaggcgtcggccgcgctggtagagatcacgcggcccgagcgcgccaatgcgttacgcgtcgacgacgccgaggcgctcgccgcgaccctggtcgcactcgacgacgaccccggcgttcgggccatcatcctcctcggatctcccaggtacttttcggccggcgcggacctcgcagacctcgcagacgaggatgcactcgcccatatcgaccgcatccaccgcctgcttcgacaggttctcgcactgcggaccccgacgatcgccgccgtacggggcgcagccgtgggcgccggactgaacctggcccttgcgtgcgacctcgtcgtcgccggcaccagcacgcgcgcgagcgagatgttcatccaccgaggcctcacgctcgactttgccggctccgccatcttgagcgcgcggatcggtccgcatcgggccaaggcgctcgccttcttcggcggcacgctgaccctcgacgagctcgccatgctcgtcaatcgcgtcgtgcccgacgacgaggtgctcgacgtggcccgtggctgggctcacgatctcgccgagcgctcgccacgcgccctgaccttgagcaagcgcctcatcgaccaagccgcgccgtcactcggatcggcgctcgatcgcgagatcatcgcccagctcgccgcagccagcgatccagcaacacgcgcagagctcgagcgatggcgctagccccacgttggatcgaagacccgctgacaggcctcgaggccgagctcacggtcgtccagccgtaccaggcccacaagtggtatcgctgcccgggatgcaacggcgacatcgcaccgggaaccggacacctcgtggtcgtcccgaccgacgcaaacgacctgcgccgtcattggcaccgcagctgcctcgactgggagctccgccacggccatcgccgccggcaccgacgaacgtgagcagtgtcctcctagagacccgctctcgtgagcgctcggtcgagatcgccccagagatcctcgacgtcctcgagaccgaccgacagtcgcacgaggccctctccgatacggtcctctccggggtagcgtccccggcgctcggccaggctctcgacaccccccaacgacgtcgcgtggtggaagaggctcagaccatcgagcatggcgtcggcttgctgggcactctcgagttcgagggccaccaacgccccaccagccgactgctgccgtccggggccgacgagctcggagtcgaagccgggatagcgcaccgtgtcgccaaggcgatcgcgaagccgcatcgccaaggtggtcgccgtcgcgctggctcgttccactcgcacggcaagggtgcgcagaccccggaaacacaggtacgcctccacgggaccgatgatggcccccgtgagctcgcgcacctctcccacgcgcgcaacgaggtcctcgtcgctcgccacgagcacacctccgaggacatcggaatggcccgagaggaacttcgatgccgagtgcaccacgacgtcggcacccagcgtgagcggccgctgcagcaccggcgtcgcgagggtcgagtccacggcgagcagacctccgcgctcatggatccgcttcgcgagcgtcgcgatgggataggtcaccaggagcgggttcgatggcgtctcgatcagcaccaccgagccgggagcaaggcgatccaggtgcgcatcgaggtcggagggctcaacgagctcgatgcccgggatacgcgcaccgagccacctggcgagctgtcgcgttcccatgtacgagtcggccacgacgagggccctcggaccaagggcgagcagcaacgcgaacgttgcggccgcacccgaaccgaaggccactgcggtaccaccctcgagctcaccgatcagggcttcgaaggcctcccaggtcgggttcgtgtggcgcccgtaagcagaacgctggccctcgtagtaggtggcattgagcgagaccgaaggattcggcccgaagagacggtcctcgctcggcggcaactgcaagagggtcgcgatcgaacgccgttcgaccacgtcgtcctccggagtggccatgctcagctgggatcccgtcgaggaagctcctcgacgttcacgtctcgaaacgacaccacccgcacatgatcgacgaagcgcactggacggtacatgtcccacacccaggcgtcgtgcagttcgatctcgacaaagctcaatccggcctccgccttcggctgcacaacgaccgagttcgccagatagaagcggcgctcggtctcaaccacaaagcgaaacagcgggagtaccgccttgtattcctggtagagacccagctcgacctcggtctcgtaccgctcgagatcctcagcactcatcgagcaacgccgtcacgctggcggtcagcgcttctccttgaccttcgcggcgcgaccgacgcgcccgcgaaggtagtacagcttggcacgacgcacgtcgccccgggtcaccacttcgatcttggcgatcgtgggtgcgtgcacggggaagatgcgctcgacaccgatgccgaagctcagctttcggaccgtaaaggtctcctgcgcgcccgacccgtttcggccgatgacgatgccctggaacacctgtacccgctcgcgagatccttccacgacccgcacgtgcaccttgacggtgtcacccggggcgaactcgggaacgtcctcacgtagcgaatcagcatcgacgagatccgtggccttcatcttcgaccctcttgctccttgacccagcgtgcaaccaggtcagcatagccgtagcgctcgaggagcgagacctcttcgtcggcgagtccgccccgtgcgacgatcagatctggacgatgtcgtaacgttcgagcgagcgcagcggctcgccgccaacgagccacctcctggtggtcgccactgagcagcaccggggggacctcgaggccctcgaacgaacgcggcctcgtgtactggggatattcgaggagcccctcggcgccgaaactctcctcgaccgccgaggccgtgttgccgagcacgtgtggcaccaggcgcacgaccgcttcgatgaccagcagcgccgcgagctcaccgccttggaggacgacgtcgcccaccgagagcagctcgtcgaagacgctgtcctcgaggcgcgcatcgaagccctcgtagcgcccgcacaccaacgtgaatgcatcgaggtcggcgagacgctcggcctcgcgctgcgtgaatctccgcccagcaggagacatcccgatccagggatggggggcgtcagccacacgcagagccgccgcgaagggctcgggcttcagcaccatccccgcccccccgccaaagggagtgtcgtcgacggatcggcgaggatcgtccgcgaagcgacgcacgtcgatcacctcgtagtggaccgcttcgtcacgtgctgcccgcccgaggatcgactgcgtcaagaccccctcgacgagcgccgggaagatcgtcacgaccgcgatgcgcatggccgtgctcagtcgtccaggagcccgggcggaaggtcggcgaccacgtagccgtcggcgacctgcgtgatgaagatggaggggaccaaaccacctccttcgaggaccagcaactcgctggccgggttcgcctcgaccgcaacgatgcggcctcgatcgacgccatcggcgtcgacgagtcgcgcacccacgagatccggaacgatcaccatgccgtccggcagtgcgacacgctccgcccacagggagtgccctcggagctcctccgcggcttctcggctctccacgcctcgaaggcgcacgataggccggtcgggttggccccgcacctcagtgatcaccatagcgacctcgtcatcgagccacacgtgggcgtcggcgacgaatcgtcctgggacatccgagacgtggtgaagcgtcacagcgcccttcacgccgtgcgggcgcccgatgaccccaatgcggaccctcgaactcacccgcggccgcgacgccctccggatcggccccgaggcccacctcgccgaggtcgatcgtgaccatcggagaacgacacccgcgtcgacagaccagaccgctgcgcaagcgccgcgaccaccgtgcgcaccgccgtcgcggtacgaccaccgcgaccaatgactcgaccgagcgcttccgtgggaaccgtcaccgagagcgacagctcaccatcgcgcaccggctcgtggcgcacgacgacgcgctcggcaacctccggcgcgagtgatctcgtgaggtacaggacgagcgacgacgctcgctcgattgcgagcccctgcgtcggcgagatcgacggctcgctcgtcgcgggcacgttcgcggagtcgtccactactcggccgcctgcgctcgcgcgagctccaacagcttcgcaacgcgctccgatggggtcgcccccttcgcgatccacgactcggccttcgccagatcgatcgagaagctcgacggctcctggcgtggctggtaccaaccaaggatctccaggaaccgaccatcgcgaggggtccgcgcatcggcagcgacgatgcgatactgcggctgcttcttcttgccggtacgagtgaggcgtagccgcactgccatcgagagggactccttccgttccaggtgcgccaactcgggcgctcggtcgaacagtctagacgcaccgacctcgccgttacttccgcttgcgccgaggaggcttgcgtcgcttggtcgcactcggcgcgccaacacccgcttggcggagcaccttgtgcacgtcgcgaaactgcttgagcagcgcggcgacctgcgctggttgtgtgcccgagccacgcgcgatccgagctcgcctcgatgcatcgatcatggtcggattgctccgctcttccctcgtcatcgacgagatcatcgcctcgatgcgtgtgagctccgcatcatcgatgtcctggttgcgcaactccttgggaactccgggcagcatggccagtacccccttcaggggcccgagccgacggacctggcgcatctgctcgagcagatcgttgaggtcgaagcggccctggcggagacgatccactcctcgctgggctacctcgtgatccatcgtcgactcggcccgctcgatgagtgagagcacatcgcccatacccaggatgcgcgatgccatgcgatcggggtagaacggctcgaagtcttcgagcttctctcccaccgaagcaaaggcgatcggcttgccaaccacctcgcgcaccgagagcgcagcgccccctcgtgcgtcgccatcgagcttggtgaggatcacggccgagatcgagaggcgctcgtcgaacgcctgagccactcgtaccgattcttgacccaccatcgcgtcgacgaccaggaagcgatagtgcggatcgatagcctccgacaccatctgcacttcgcgcatgagggcttcgtcgatggccaggcgacccgctgtgtcgacgatgacgacgtcgcgcccaagtcgtcgcgcctcggcgacaccgtgacgagcgaccgtcacgggatcgtccccgtcgctcacgacggcgacgccggctcgctcgcccaagatccgtagctgctcgatcgcaccagggcgctgcaggtcggccgcgaccagcaacggcgaccgtccctcccgtagctgcgcgagcgcgagcttcgcagctgcggtggtcttgccgacgccctggaggccggccaggaggatcacggtcgggggtgtcgaggcgtagcggagacggaagggctcgccgccgagcacccggaggagctcatcgtgaaccgccttcacgacctgctgcccgggggtcagcgatgccgacgccatcgcaccgacagccgcctcttcgacgcgggcgaggatcgtgtcgaccacacgcaccgcgacgtccgcctcgagcagcgcgactcggatctcggcgagcgcttcgtcgacgtcgcgctgggtcagtcgactcttgcggcgaagacgacccagcgctccgtccaacctgccactcagcgtctcaaacatcggcctcgtctcctcgcatggaatcgggtcccgcctccgatccactcatgtcgagcaaggcatcgacgaagtcatcaggatcaaacggttgaaggtcctcgagggcctctcccaccccaacgagcttcaccggcaccttgaactcgtgctcgatcgcgagcgcgataccgcccttggctgatccgtcgagcttggtgaggacgaccccggtgagcccagtcacctcgccgaacacgcgggcctgactcaacccgttctgtcccgtcgtcgcgtcgaccaccaacaagacctcgtcgacgtggccggccgccttctcggcgacccggcggaccttgccaagctccgccatcaagttcgccttgttctggagacgccctgcggtgtcacacacgacgaccgcggcgccacgcgccttggctgcgtcgaccgcatcgaacacaacggcaccgggatcggcaccctgctggcccgccaccagccgaaccccggaacgctccgcccagaccgcgacttgttccgttgcggccgctcggaaggtgtccgcagcagcgatcaccacatctccccgctcgcgcaagcgcgctgcgagcttgccgacggtcgtcgtcttgcctgccccgttgacgccgaccacgagtatcacggtcggtagctctgccgctaccgcaagcgatcggtcgccactcaggaggcgagcacgcagggctctccggagagcctgccagaggtcatctgccgacgcgccgcgtcccgtctcacgtcgaacctcatcgaggaccgccgccgtcaacgtggggccgagatcactctcgagcaggacctcctccatcgtctggaagagcgcgtcccgatcgagcccgccgattcgccgacgcaggtcccggaaccgacccgatgagcgtcgcatcgcaccctcgagggtgcgcggacgagactgaccgatgaccgctgcggcttcgtccggcgctgccgattcgctcgccggaatcgactcttcgcgcgcatgcgggcccacgcgtggacgacgacgaacaagcagtgccgccgtggcaatcgcgaacacgagaacgaccagcaatacgatgtccaagaccatcgccaaagagcgtaggcgaccggcacaggagcgtcgccgaccaggcagacgccgtgctggccgcgacgtcaatcaccattggtcggtcgggcagcgccaggaccatcgctacgaattcttcctcggcaactgcaacgctgggctcagtcgtagcgattgcccctgttgccgccacaggggcgcggccctaggacaaggaggaactatggcactcggagtcggctcactgagcaagctactcagcatgctctcggcaaaggccgccatcgcgaccgcatccgccgtcgttgcgacaggcacggtggcagcagcggccactggaaaccttcccgcatcagcccagaacgtagcgtcacagctcgcggcgtcagtgggcatcacgatcccaacagccacggcagtagccccgaccgcgtcagcgacgccagccactccggcgacgccagccactccggcgactccggcaacgccagccactccggcgactccggcaacgccagccactccggcgactccggcaacgccagccactccggcgacgccggccactccggcgactccggcaacgccagccactccggcgacgccggcgagtcacgacaactcccctgacaccgcacagcaagagctccagtcttccaacgaccatcagcagagcacggatcagcagagcacggatcagcagagcacggatcagcaggtcgccaatcccgggaccacgctgacctctcctgctgggacaacgagccaggacggctcgagcagcgactctcaggcgagttcaagcacgcagagcagttcatccgacaactaaccgagcggacgctgcacgcgccacaccacaccatcgcagcgtgcaggcccagtggaacgaggagcgaacatgccggaggcggcgatgtcgaccgacgacgcgcaacgcgagtccgtcgacatcgatcgcctccgtacaggcgacccggacgaattcgggcgatgggtacgtcacgttggcccggccctacgaggattcctccgcgcctcaggagttgcagacgtcgacgacatcctgcaggatgtgtggcttcggctggtccgttctctcagtcgcttcgacggcgacgaagacggtttacgccgcctgacgttcacgatcgcctatcgatcgcgtgcggatgcactacgcgcgcttggacggcgccgcgaggtcgctttcgatcctgccgaactcccacatccgacgttgtcgccggaggacatcgatgacggcaccgtcacagccctcctcagacggctaccggagcagcaagcgctcgtgatcggccttcgtgtcttcggcggcttcgctgccactgaggtaagcgacatgctcgggatacccgatgcgaccgtacggagcctcgcacatcggggactcaaggccatggcacggctcctcgagcaacaatccccgtcgtcgctggaggcaccctcgtgagcacttccaccactttcaccgaccgcctcacggcgcttgcgagcgaggtcgcgctcgagaccagggaacaagagctactggcgacggtctgcgcacggtcgtctgcttggccgacggaactccccgacagctacgttcgcaacgtcacggagctggtcacagcagagttccgcaatctcgcagcatccaccaccagccagcgtcgtgccacacatgcgtgggcctcgtggttccgctctcgctggctcatcgtcgcggcggtcctgagtgccgcaagtgggggcgtcgcgttctccggtgccctcgcccacgctctccaccgtgtggagtcgatcgtcctcgccccgacgccaagcacccaccaagggacgctgaacggttcgcaaccagccattggctcatcggccggcataccaccgtcgggtcttcgcgaacaggggggccaacagtcctctggctccgcgacagcgacggcaaccccagcgcagagccgcgacaccggcgacgaacaccacccgcttggaacggtacgatcaatcccttcgtcatcgccaccggtcgaatcgcctacgccgaacgaccaagcacccccatccgacatcagccagcaagctggcgacgcttcctcgtcgcctgctccatcggaccacacggacagctcctcgagcccctccgaccagtcgaccagtacgaccgggtcatcgaaccagtcaaacacgacatccacgtcgcaggaccagtcgagcagtgcgaccgggtcatcggaccagtcgaacacgacatccacgtcgcaggaccagtcgagcgccgctacgtccagcgccagcagctcgaacccagacaactaggcgacgaagacccgtcggagtccgcgagcgacacgggacgtcgcgtggctagtccgtcgcgacctgaacgccctcaaggcccgcctcgccaaggtcatgacgcacgaccgtcgatactccgctcggcgcaatcgagacaccaagcagcacatcggcggcctccatggtccgtcgctggtgggtcaccacgagcacctggctcgagcgtcccacccggcgcagcagttcgaccagacgagtcagattgcgctcgtcgagcgcggcgtcggcttcgtcgagcacgagaaacggtacgggtcgaacctccagcatggcgaacaacagcgcgagccccacgagcgagcgctcgccgcccgacagcaacgccaaccgacgcacgcgcttggttggcagatcgacatcgacacgaaccgtcgccgccagcggatcggcaccagcctcgagctcgaccgaaccgcctccgccagggaagagctccccaatgatgctccgaaacgccgacccgacctcctcgaccgtggtcagcacgcggcggcgcatctcctcctcgagccgctcgagtccctcactgatgacagcccgcaccccacgggcctccgcaagcaccgcgccgagctcctctcgtcgagcgtcgagctcgcgcaactggacactcgcgagaccgttcacctcgccgaaggtccccaaggcatcttcgacctcgtgcaacgtccgctcaacgtcgttcggtgcgacatccgagggcaggcgggcaccttcgatgtcagcgagctcgacgtggaggcgaaggcaccacatctcttgctcggcggcgagccgggctcgagctcgctcggcgcgccccatcgcctcgagcaatcgctcacgcgccgtcacgagcgctgcctcggccgaccgacgttgcatccgcagccgctcggcctcggcacggtgccgcgactcccaagcaagcagcagctgcagctgctcgtcaagaccgcgcagcgtgagggcaactgcgttcgccaaagcgtgggcacgctccacgagctcacgtggtactggcgtcgcacgaaccctggcctcgtcaaggcgcgcacgttcgcgctcgagctgatcgaggcgctcccgagccgccaacgcccgctgctgctctcgagtcgcatccagtcgcacgccgacgagctgctcatcaagcgcttgccgagcccgctctgcggcctggccagcttcgatggccatcgccagtcggtcggccgccgccgcctctcgcgcttgaagttcggcggcgcgacgtccgacatcctcgtcgacgtcctcgatgtcgacagtcgggagctctgtcgcgaggcgcgcgacgaccgtcgcgcgatcgcgatcgatccgcgcctgctcggtcctgatccgctcgagatcccggcgcctcgcttcacgacggttgagctcctcgacatgcgtgctgcgacatcgctcgacaacggctcgcgcctcccgaagcgccgcatcaacggccgcgagctcctcgccgacgccctggagctccgcggcgatcgtcaccgcctcatcctcgagctgacgccgtcgtagccgcagcaacgcacgaatgctgcgaccccgccgaatccacccatcgtcgctcacccagccggcagcgtcgacgaggagaccgtgcgctcggccgacacgcacctcctcgagcacgctctcgacgactctcgcctgtgcgagtcgcgcacccagtggtccgggcgcccaacccaccgccgcactcccgtgctccccttcgacctcctcgatgacgacggcgctttccacctcgaccgtcgggtcgagctcgccgaccgactgaacgatccgcgcctcggcgagctcgccgagcgcagcaagcgcgacgtcaatgccagctgtccccgaacgcacgacatcgatcgtcagtcggccctgcccctcgtccccgacggcctcgagcacgctccgcagctcaacatcgatgcgacgtgcttcggccgtcaaactgctgtgtcgttcggcaaggactgcacgatctcgctgaacacgctcgaccagctccccggcctcggcgagctcgcgggctgcgtccgcgagcgcctcctcggcctcggccaacgctgcctcggccgccgcacgctcggcggccaacgccgcatctcggtcgttcaagtggcgctcgagctcgcggtcacgcgcccgttcgagccgcacccgctccgcctgcgcgcgcgcacgctccgcggcccgctcgcgctcctggagaagcgtctcgagacgcacgcgctcgcgacgcacctgatcgagctctgcccgcagcggctcgacgtcgacggtctcgatcgcggctcgttcctgctcgagacgctcgcgcatcagcgcgagtgcgcgtgcgcgctcctcgagtccggtcagggtcgcgaccacctcatcatgctcctccgcgatcgcccgccgtcgctggtcgcgagcacgctcggcatcgacgaggcgctggtgctcatcgatcgacgcgatcgcccgtgtcaagcgcacctcgagctcgcgaagacgccgcgcaccctctgcgaccggctccgggtccacacgaggcgcatcgtcgacctccccctcgaggagtacgagtgccgcctcggcatcggcaacgtcgcgactgcacgactcaacgtcacgctccgcagccgcaagctcttcggcacggcgctcgagcgctcgacgagccgccgcgagcgcgagtacctgccatcgggcctcgagcgcgcgacgtgcctccgcgcgctcgacctgcgcgaccagcggtcgacgttggcgtcgaaggtctcggtcctcgcgctcgagctccgccagcgcctcctccgcacgccggagttgctcgagggtcacctgccgttggcgccggagcagcgtgaccctcgatgcgtcctccagcatggtgcgcaggacgtcaccggacgccccagcgagggcatcgatctcgccctgggagacgacgacgtgttggctccgaccgatgttcgccccttggaggacctccaccacgtcctggagacgcgccgcacggccgttgattcgatagctcgcctctcccccacgctcgactcgccgggtcagagcgatctccgcgacaccaagtccgctctcgtcgtctgggtcgtccaaggtgagttcgacctcggcccgaccgagcgcaggacggtgcgcgctgccctggaagatcacctcgtccatgcgagcgagtcggagcatcctgggactctgggtgccgagcacccaggtcagagcatcgacgacgttcgacttcccggatccattgggcccgacgatcgcgttgatccccgatccgaatcgcaccgtgaccggatccgcgaacgacttgaaaccgcgcatcgtgagcgcacgtagtcgcactcagccccctccctgctggcaccgcgggcaccagtgcgctgatcggccctgcaagaccctccggacgatcgacgtagcgcacctggggcacggactgcccgcacgttggtagacggcgaggcgcgcgccaaaggcgccaggccgatcgagcgggtcgcgataggcccgatccgcgaaggtcgtaccgcccgctgcgagcgcctcccgggcgacatcgcccgcagcctcggcgatcgccacgaggcgtcgccccagcacgttcatcggggtgctcggatggacaccgacacgaaagagggtctcgtcagcgtacatgttgccaagacccgccaccacgcgctgatccaggagcgccgtcttgatcgcacgccgagacctcgcagcgtgccgttcgaggctcgctgcgatctcctcctcgggaccgaacacgtcgggaccgagccccgcgagccgacgcggccgcccgtcggtgccgaggacgtcaacgaaggcctcggagaacgtgcgcggatcgaccagtgtgatgacggcgcgacggaagtcgagaacgagctggacgtgggtcgccgtcgccgaggcgtccgagacgacgagacgtccagccatgccgaggtgcacgaccagcgcgtcggtgccgagatcgaacaccaggaacttgccgatgcgtcgcatcgacacgatcgggcgccccgacaccgtcgccaagagctccgggtcgtgccggcgcacgaggcgccgtccaaccatgcggatcccctcgagcgtcgccccctcgacacgtgcggccagcacctcgcgcacccgctcgacctcaggcgcctccggcacgctccggctccgatgggcgtggcgaggcgcggcggctactgcgacgccgcgggggtcgcgagggagcctccgtcgttgcctgagcgaggccggcagcttctgcccgacggttcgcctcgaggatcgcaaggcggcacgcctcctgctccgcctccttgcgcgacgccccttcgccggctgcctcgaagcctccaggaagctgcacgacgacccgatagcgacggtcgtgatcgggcccggaccacgagactttgtagcggggtggctggtggtgcagcttggcgagcgcttgatggagcagggacttgtagtcaccgagcaccaggtcgccatcgacgcgctccagcgagggcccgaggatcgcgaggacgaacgcgaccgagagctggaatcctccggcgagatagacagcaccagcgagcgcctcgaccgcgttggccgccaggacagggccaagagcatctgcttggccgaccgtgatcgcctcgagcagcccgccttggaccccgacggagccgagcgagcgtcgagagacgagagctgagcgcacctgggtcaggcgaccctcatcgacgtccggatagcgccgatagagatagtcggagaccacgagctcgatcaccgcgtcgccgaggaactccaaccgctcgttggagtccagcggatcgcggctcgctgacttgtggacgagcgcttgacgtacgaccggatggtcgcggagcgcagcgggaatgagctcgaggatcgaccgctcccgccgcttcgctcggctcacgcctctcgggtcacgccgagcacctcggcgacgtagtcaacggcgtcacgcaacgtacggagatcctcgagatcctcgtcctcgatccggaaggtgtgatcgccttgggagaactcggactcgatggcctccaccagctcgatcaacgccagtgaatcggcgtcgaggtcgtcgacgaacgacgaactctcgctgatgcgcccttcgtcgatctccaagatgtccgcgagctgcttgcgaatgacctcgtagatcgcggctcgagtcagttcctcaggcacggttcgactccttcgcttcgtagtgtcgaatggtcgagacgacgtctccctctgcgagctggaccgcgttgcgaatcgcactcgcgactgcccgctcgttcgaggcgccatggccgatcagcaccaggccgtcgacaccgagcagcgccgccgcgcccgtggcatcgggcgtcagctcgttccacagcgggagcagtcgctcgatcgcggcgtcggcgaccgcatcgctctcccctgctggtgccaacgccgacagcaccgcatgcgcaaaggtgcgggccgcgccctcgagcgccttcagcaccacgttgccggtgaaaccgtccgtgacgacgacgtcgacgcggtcgctcatgacgtcacgcccctcgacgttgccgaggaaggtgatccgcgcatcgccctcgaggcgcgcgaaggtctccttgacgagcgacgtccccttcccgggctcctcgccgatcgacaacaggccgacgcgcggcgcctccagcccgagacgcgctcgagcgtacaccgtccccatcaaggcgaaatcgtgcagccacgccgcttggacctcggtgttggcgcccgcatccaacagcaccgtcggggtcgcgcctggcaccggcaactcgaccgtaatggccggtcgcgccacgcccttgatccgacccaacttgagcaacgcggtcgccatcgcggcgccagagttgccgaaggtcaccgccgcaccggcgcgaccttgcttcacgagctcggtcgcgaccaccatcgaggcgtcgcgcttacgccgaggcgcgctcgcagggtcgtcggtcatctcgatgacctcgctcgccaccacacgctcgacgccgctcggcaacgccgcgagtgcctcggcggtgccgaccgcgatcacggcggctccctcagcccgcgcgatgccctccgcgaccaccgctgagccgaggtcggtccccatcaggtcgaccgcaatcggcagcacgagcccctagccctggatctcgaccgcgggacgaccgcgatagtagccacactgcggacagacggcatgggagcgcttcgccgcaccgcaactcgggcaactggccgcgccggcgaccacgaggcgccacgccgatgcgcggcgagaccgggacttcgccttggaagtcttcttcttaggaacagccatcgtctctcactcttccttgccaccgggaccgggggatcatgctagcgccccgagccaccctcaccttgcgactgtcccagctcgtcgaggatcgcgaagggaccgtcgacctcgggttggcactcgcacggaccctcgttcaggtccgcaccgcagcgcgcacacagcccacggcactcatcgcgacacagaggcagaacggggagctcgagcaccagcgcatcgtgcacgaactccgacacgtcgaggacgtcgccgtggtaaccatacgcatcgtcggtggtggggccctcgcgatagagctctcgcccttcgacgacgagtggcccttcggctggtgccaggcatcgcacgcactcgcctcgccaccgtgtggttgcacggagggtcaccagcatgccttcgccaaccgcctcgacgtgaccggccacctcgatgggctccgtcggctccacgcgcgacgacgtcaccgcgatgtcatccaagctgccgacgaatccgaagcgctccaaggcggcgctcccgtgtcgcagcgcgaccaccgacaccgcgaactcacgcatcgccgacctcctcatccagcgcctctcccgacgccagcgcactcggcaccgtaccggagcccgccgcttggagccgctcgcggccgcgccgggtcgcggtcaagagctcgtcgagcgcgatctccaccgctgccagacggcgatccaggaagtcctcggtctgcaaccggagccgcgcagcacgctccttggcatcgagcacgatgcgcgcggcttcgtgttcggccgctcgaacgatctccgtgtgcgacacgagcgcctcggcctgctgacgtgctgcgtcgaggatcgcctcagcctcgagcgaggctcgcgcaaggaactgctcccgctcgcgcagcagccatcgtgcctcgcgcagctcctcgggcaacgactccatcgcttcgtcgatgagcgcaaggacgtcatcacgtaccacgatcaccgacgccgagaggggcaccccgcgcgcctcgctcacgagggtacgaagctcctggagcgccgcgagcgtcgtgctgccgtcggagccaaccgccgtcaaggccgacccccgaggcggccatcgagcgccttggcaacgacgacgggcacgaacgaggtcacgtcgccgccgtaggctgcgatctccctgatcaacttcgacgacaagaacgagtgttcggacgatgtcgggacgaagagggtgtccacgccggacagcgtgcgattcatctgcgccatctggagttcgatctcgaagtcgctgaccgcacgcagaccgcgcacgatcaccgttgcgtccactgcccgtgccagatcgacgaccaagctcgacaacgctaccacccgaacgttctcgaggtcatcgaccgccgcagcgatcaacgccatgcgctcatcgagcgagaacagctgcgacgccttctgcgggttacgcatcgccgcaaccaccacctcgtcgaagagcgcactcgctcgctcgacgacctcccggtgcccgttgtggaacgggtcaaacgaacccgggaataacgcgcgcctcactgtgcctcccgcgctcggctcgtctggtaggcccgagcggctcacggcgccggaacgaagagcccgacctgggtaccaccatagcgccgccagcgctccgctcgccaacgctcgccgagttccaccggagaggctgcctcgacgacgacccaacgagcgttcgggagctgggggccgaggtcctcgaaggagcgccggacgtagggcggatccacgaacaccacgtcgacgtccatcgaacgcccctcggacgcgaggaaccgctcgacgctcgtcggacgaacgctgagacgggaggcgacctcgagtgcgtcggcggcacgccgcacgtcggctgcgagtcgcgcatcacgatcgacccacacgacgcaggcggcaccgcgcgagagcgcttcgaacgtgaggccaccggccccggcgaagaggtcgacgactcgcgcaccctcgaggtcgacccgcgcctccaccatcgcaaagatcgcctcgcgcacgcgagctgcggtcgggcgcgtgccgctcggcacccgcaccgggacgacccgaccaccgagggatccgccgatgatacgcagcacgcctagctccggagcaggtatgccagctggtcggggtcggcgaccagtgcgagttcccgcgcgagcctcggatgctcgcggaggctcgggtcgacctcgagcaatcgggtggcgtggtggcgtgccgcctcgaccaaggggcgatcgcgcacgaccgaggcgagcttgaggtcgctcctgcccgattgacgcgcaccgaggaccgtgccctcgccgcgcagcacgaggtcgacctcggcgagctcgaagccgtccgtcgtacgttcgagagcctccaggcgcgccgccgtcgggccctggtcggtctcggcgagaaggaagcacgccgacgcgtgctcgccacggcccacccgaccgcgcagctgatgcagctgggcgatgccgaagcggtcggcgtcttcgatgatcatcacggtcgcgtttggcacgtccacgccgacctcgatcacggtcgtcgcgacgagcacgtcgatgatgcccgctcgaaacgccgccatctgccggtccttctcgcgcgccggcatgcggccatggagcagtccgagccggagtccggcgagctccgagttgccgagcctggcgaactcttcctcggccgagcgcgcctggagccgttcgctctcttcgacgagagcgcagacgacgtaaccctgccgacctcggccgacctctgcccgcaggtagtcgaaggcctcgacgtaggcgctccgttcacgcagccacttcgtgcggatcggcgtccgccccggtgggagttcgtcgatcacggagaggtcgagatcgccgtagaccgtcatcgccgcagttcgaggtatcggtgtggctgtcatgacgagcgtgtccgccacacgcccggcgatctccgcatgacgatcgcgcaacaacgaacgctgctccacgccgaagcgatgctgctcgtcgaccacgacgagcccaagcgaagcgaggttgactccctcggtgagcagggcatgggtcccgacgaccagatcgatcgttccgcgggccaacccctcgacgatgtcggctcggcgcttcgaggccacagtccccgtgaggagggcgacctcgatcggcgctacctcgtcatcgaagaggcccggtgtgcgctcccgagcctcacgagcagtgccaagcagcgacaggatcgtgcggaagtgctgttcagcgagcacctctgtgggcgcgagcaacgcggcttgatggccgccttggatcgcgaacagcgcagcaatcagcgcgacgagcgtcttgccggctccgacgtcgccctggaggagccgatgcatgggccggtcccgctgcatgtcaccggcgatatcggtgaccactcggcgctgggcagccgtgagtgagaacgggagtcgggcgagcagttctgccacgcgccgaccggtcccaggcccgaacggagcaacgtcgtgggcgaagccacgctggtgagcatcgcgctcccgtcgtacgagaccgagcatgacctggatgcgaaagagttcctcgaaggcgatgcggcgtcgagcttcgagtcgctgctcgagcgtggccggcgcatggatggcgcggagcgcttcctcgcgcccgagcagacccagcgcatctcgcaccgccctcgggatcgtctccgcgatcggggagaagcgctcgaggagtccgagaaccgcactcgcgatggcaccagagtcgatcccggccccgtcgcgcagcggatagagcggcacgatccgacccgtacggtcgccgatggggtcgacgagcgggttgacgagctgacgctccttgcgaaagagttcgaccttgccgaacacggcgatgtcgccgtggagccgtccgagctgcttcgcacgccacggctggcggaagaagcgcagcccgaccgaccccgtctcgtcgaccagccgcgcctccaccagcgtcatggagcgcttgcgcgtcggcacgacacggacgctggcgatgcgtccgatcagcacgacctcttcgcccggaaccgcgtcggcgatcatgacgtggcgggtgcgatcgacgtagcgccggggatagtaggtcacaaggtcgtaggccgtcacgacgtcgagcgcctcgagacccttcacgaccttcggtgacagccacgcaaggtccgcaagcgccgtcgctgcgagatcctcgagtccgacgccactcattccacgccaagcaggtagggatagagcggctgccctccctcgatcacctcgagttcgacaccgtgatggcgatcgaacacgcccgcaagggccgcctccacgcgttcacgatgaccccgctccccgacgatcacggtcacgatctcgcctccgggctcgagcaagcgctcgcacaggccgacgagcacggcctccgggtccggtcccaccgacacgatgccttgatcgctgataccgatcgcagaaccggcaccgaacaccccgccctgccaggatccatcgcggacggcaacggtgacctcgccccagcgaacccgtcgcgcggcctcggtcatgcgccgctcgttctctgagagccccgactctgggtcgtaggccatgagcgcggcgaagccctgcacgaggtggacggtcggcacgatcgcgacctcagcgtcgacgagtccgatcattgccgaggccgcagcgaggatgttggcgttgttgggcaggacgatgacctgcttggcgtgcgtggagcgcacggcatcgacgagttctgcgatcgacgggttggcgccttggccccctgcaacgatgctggcgacaccgaaggaccgaaacagccgcgcgatcccgctccccgtgccgacggcaacgaccgcggtcgccggaggcgacggctcggctgctggcggcgcgtcgcgcacccaggcgacttcgccggtctgctcacgcagatcggtgacggagagatcgcgtacccgacccgcgtcgatgccgccttggatggcggcagcgatgtcgttcgtgtggacgtggcaacgccagacggtgccatcaccgacgatcacgatggagtcgccgaggccggcccagaccacccggagcgcgtccacctggcgctcgggtgcctccagggagaacatcacctcgtagcgcagctcgtcctcgcgatcggacgccaccagctcggccgccgacagatcacggacgctcgcgaccgggaccgcgatgtcgtcgagccatggatagggaccgacgctcgtcgtgagtccgagcgcagcgctcatcgcctcgaggacgacgaccaagcccgcgccgcccgagtccacgacgccagcggctgccagcaccgcgagctgggtaggggtgcgctcctcggcggctcgagcagcgtcgatcgccgcggcggggtcactggccccagcggcggcgtcgatgacgctgagcatcgtgccgggcttcgggtccagcaccgccgcgcgagcgctcgccgacgccgcctcgagcccacgcatccatccgcgcgctcgatcagggtcgctggcgagttctcgtacgagcgagcccaggatctgggccaggatgaccccagagttcccacgcgccgcgagcagagcgccacgagcgacggaaccggcgaacgccgcgcagtcgtcggtatcgcctcggcgagcagcctcggccatgccctcgagcgttcggagcatgttcgaaccggtgtccccatccgggaccgggaacacgttgagccgatcgaccgcatcacgcaccgacgccaacccggcgacggcagcctcgatcgcctgcgtgagctgtgcgcaggcactctgacgttctgccaccgcccgcatgctagcctcgaaggcccgagacgtcgccgagcctcgtcgctcgcgccgtcctcacgatcgtaaaggagaccgaatggcgagcgtctgcgagatctgcggcaaggggccgcgcgtgggcatgaagctgtcacattcccaccggcgcaccaagcgtcgcttcctcccgaacgtccagcgcgtgcgcgtcctcgaaggagccacgacccgtcggcggttcgtctgcacgtcgtgcctccgagccaacaaggtcgtcaagccatagccacgatgggcccgacgcgagcgctgctctggctctcgtttggatcacccgagcggccggaggacatctggccgttcctcgagcgcgtggtcgctgggcggggtgtcccgcgcgaccgtctggcgatcgtgcacgaccaatacctcgccactggaggctcgagccccctcaacgcactcaaccgcacgttgatcgaacgcacccgagcagcgttcgacgcagccgacatcgacctgccgatcgtgttcggcaaccgaaactgggatccactggtcgacgaggcggtcaaggagctagggaggctcggtgcgaccgacgtcctcgtgttcgcgacctcggcgtacggctcctactcggggtgtcggcagtaccgcgaggacgtcgaacggacgaatcccccattcacctggacgaaggtgccaccgttcgctggccatccccgcttcctggcagcccaacgcgagatcctcgcgtcgttccttgcgacccacgatctcgaccccgagcacaccttcgtcgtcgccacggcgcactcgatcccggtcgccatggccgccaacagtcagtaccagcgccagcttgccgaggttcgagcagcgctcaaccaggttgctcgcacctacggcctcgtcgtcgaggaggcctaccagagtcgctctggcgatccgcgcacgccgtggctcgagcctgacgtcggcgatgcgatcgaccgcgccgccagcgagcgcacgctcgccgacgtcgtgtgcatccccatcgggtttctctcggaccatcaagaggttcgctacgacctcgacatccttgcccgcgaacgcgcagaagcccgcggcgcgaggttctggcgcctcgagaccatcggcgaacacgggccgatccccgagatcgtcaccgacttcacccaggcctggctcgaggggcgagacctcagatcgctcctcccgtctgagccggccctgtgcaccggcacctgctgccagcccctgcacgctcgacccagcaggagtgtgtcgggcgcgtaacgactcgatgacacctccggccgacggcgcgggatcgttgcgggtcgagttgctcgtggcctaccatggtcgcacgacatgaagagtgcgaacgaagtgggggcatcgtggttcagcgacgtcgaagtcgggtcctgaccgtactggcaggcgcagccctgttggcggcgtgcggcagcactgcccagagcggttcatcgagcacgtcgagttcgtccgccgcgaacggcatcatcaccttcgccgaacaacccggtgcgagcccgaactggatcttctggctcacgcccggatccgacttcaccgttgcgaacaacgatcagttccagtatctgctgtggcgtccgctctacgtgttcggcaatggagcaaaggccgagatcaactacgcgctgtccatcgggaatgcgccggtgtactccgatcacgaccgcgtcgtcacgatcacgctcaagcattggatgttctccgacggccagcccatcaccgcacgaagcgtggtcttctggatgaatctcctcaaggccaacaaggccgactggggcggctacgtacctggtcagttccccgacaacgtcgcatccgtcaccgcggtcaacgcatcgacggtccgcttcgacctcaccggctcgttcaatccgacctggttcacctacaacgaactcagccaggtcgttccgcttccgatggcgtgggaccgcacctcgctcggcgccccagccccgaccgcctcgaccccgaacctccccgacaccacgacccaaggcgcccaagcggtctactcgttcctcgccggccagtcgaaggatctcgccacgtacgcatcgagcccgatctggtcgatcgtcgacggcccttggcgcttgaaggccttcaccacggacggtcaagcgaccttcgtccccaatccggcctactcggggccgatcaagccgaccgcgaaggagttcatcgagctgccgttcacctccgacagcgccgagtacaacgtcctcgcgagcggccaagggcagatcagctacggctacatcccgagtaccgacgtcgagcagaccgcgcacatcacccagctcggctaccacgtctcgccctggacggtgttcggcttcaactacatcccgatgaactaccacaacccgacctacggcgctgtcttcgggcagctgtacttccgccaagcgctcgaacacctcatcgacgaaccagcgtggatctcgaccttcctccacggtgacggaacgccgacctacagcccagtgccggtcagccccgccaatccgttcatcgataccacgacccgccgtccggcctacccatattcgccggctgcggcacgctcccttctcgagtcccacgggtggcggctcgtcaacggcatcatgacgtgcgagtcgcccggcaccgctgccaacgagtgcggcaacggcgtcgccaaggggacgagcctctcgtcggtttcgctcgcctacgcgagcggcgtgccatcgctcgcccaggagatggaggcgttcgcctccgcagcccacagcatcggcgtcaacatcgtgctgtcctcgaagcccttcgacaccctcctcggaggactcggtgcatgctcaccctcgcaagcactgtgctcatggcagatggtgaactggggcggcggctggacgtacggtccggactacctgcccacgggcggcgagttctacctgccaggagcaggagccaacccggagagcttcgcagaccccaccgcgacctcgctcatcgacgccacccacaccgccacgaacctcaccccggcccttgatgcctaccagaactacatcgccaagaccctgccggtgctctaccagcccttcccggcctaccaagtctcggcgatctcgacgtcgctccacggcgtcgtccagaacccgtacgggatcttgtatccggaggagtggcgccagtcctaagcgccgagccacggatcgcgaaatccgcggtggccgcgcgtgagggcgacgacaccgtccggcccccaggatccccgacgatacgggacaaccgggttgggatgcgcgaggatcggatcgacgatccgccaggcctcctcgacgacgtcctcccgggcaaaacgtgctcggtcgccttcgagggcagcgaggaagagcacttcgtacggctctggcgaccgaccgagttctgcccggaacgagaggtcgagatgcaccggcgcgagatggcgctcctcagcgtcgagcgactgcaaggtcacacgcagcgccgaatcaggatcgatccggaggatgatctcgttggcctcgaggtgctcgggcagccccaaggccccgagacgtggagggcgccgcaggacgaggcggacctcggtcgcggtcaccggcaaagccttccccgctcggaccacgaccggtacgccatcccaccgccatgaatgcacgccgagcgcgagcgcaatgaaggtctcggtcgtcgagtcggccccgactcccgggatggaccggtaaccctcgtactgaccccgcacgacgcgactcggctcgatgaggtccatctctcgcaggaccgccacgcgtgcgtcccacagtccatcggcaccaggccgactcggcggctccatgagcacgagcgccaagagctgcaacaggtggttgacgaccacatcgcgaagagctccaactgggtcgtagaagctgcctcggtcctcgactccgaagtcttctgccatcgtcacctggatctcctcgacgtgttctcgacgccacaacggctcgaggacctcgttcgcaaagcgaaggtggacgaggtccgcgagcggttgcttgccgagaaaatggtcgatccgcaggatggattgctcatcgaccacgcggtggagtcgttcattgagagcctgcgctgaggcgaggtcatggccgaaaggcttctcgatcaggtaggtgacctcgctcgcgatcggctcgcgctggagattctcgatgaccggcgcgaacagagcaggggggatctcgaggtagacgagagcctggtggacccgtcccacggccgaacgcagcgcatcgaccgtgtctcgactcgtgaagtctccacgcacgtagcgcaagcgtcgcccgagccggtcgacgaccgagggcttggcgtccgcgatctgcgagctgacggactcgcgcatcctcgtctcgagatcgcccgtgctccagtcgtccagcgcgacgccgacgatcggaaagtcgagcgccccacgctcctcgagacgatagagcgaggggaaggtcatcttacgagcgagatcaccgctcaccccaaagatcacgaagacatccacgaacgagcctcctcctaggggcgcagctgcgccccccacgtcgcctccagaccttcgccggccgtgagctgccagatatcgttgcccgtagcgagcgcgttcggcggcgcggtcatcggctcgacggcaagcccgcaccgacggcgctccgacgcgagcgtgtcgccgctgaagagctgaaggtatcgatacggcggtgcagcccatagtgcagccaccgcaccgtcgacgccggtgagcaaggcccacgcccgatccgcgccgagaagatcgagccggatggtgtggtcgagccgccgaccagcgagcgcgatgcccgagccgacgtctgcaagttctcggtcctcgctcaacgcagaaggcacctgaagccacgcgccatcgatggaacctgcgcccggagagaggtacgggtgatgtccgatcgcgacaggagccgactccgatccttcgttctcgacgatggttctcacgacgagtcccgcgtcacggagctggtagtgcaccgtcacggcgaggtcgaagggataccccggtgttggcgggatccgggtcgcgagcaccacttcgttcgttcgcgcgtgctccaacgtgaagggtcgccaccgaacgagcccgtggatcgcgttgcccgccgacggctcggtgaggtcgagctggaattcggacgtggccactcggtaacgaccgcccagcacgcgattcggccacggaaccagcacggcaccgtgcgcgccatcgcagacggagtcctcctcgtacggatcgagcaccgctcgattgccgcgcgtgaggacccgaatacccgctccgacctcgacgacgaccgcacggtactcgccgctcaccagcacgaactggctgccggacggtggtcgatgctgggtccctcgcacgcgcccaccctacatcggtcgccacccgacctccaagtgccgcgcatcgaagcgccctgctgtcgcccaggacatcgctcgacaccctcggccgggccgagcacctcggtcacgacagccgacagcgtgagagcagcgttgaccctcacgacggccacgagtaccagactgcgcagccgatctcatcgtctcgccgaactcgcaccgagcaacttcggagctccgcgatggacgaggctcctccgacagcgcggtggccctctgcccgatccatgacgttcggcaggcggaaccgacatacccgggagcacgcagcgatggcaccttgtccgcgagccggtgtgacgaatcgcgggcccagagcccgaggctcggggcggtcgcaccctcttcggcgatcaccctcccgatccgctcactacagtggctccacaagacggcccagcgcgcgatccacgtgcgacaacgggatactcgggacctcgacacacagcagaactctcgagacaccgcagagccgacgactcgcagccgtgcctgagggaagaagccgccccttcgggagtcagaacgagcagccccaacgggattcgaacccgtgtctccaccttgagagggtggtgtcctaggcctctagacgatggggccagagtgctcgaagcagcatagcgggctctggccctgcgagacgctactcgcagggccagaggtgcagagcgaatcaggacgacggtctagcgggaatccgaagctccaccctgattactgatgcttcggtagtacgagcgccagatcgcacggtagagcggcacgtgctcggggagtcgacgcaacccagggatgtagggcacgaacgcaaaggccaacgtgaggaccgccatgatcgccatgacctcgacgtcggcgttggacgaactcgccatcgggttcacctgataccagaacgtgtacagccacagccaggactgtcccgggaagttgccggtctcgttggtcatgccccactgcggggtcccgaggaggtgtcgctgggccccgaggttggcaaagtactgaccatcggcgaggaacatgagcggcttcgtgtagttcgttccgtagaaggcgctgtgcgattcgagggccgcgtccagcccaccgctccgtgcgatgacgagcaggtcactcaggagcgtcggaatcggcccgtacgatcctcgcggcacgatgagccgtgagcccacgacacgtagatgggcatcggccttcgcgaacgcggcgttccaagcggcgcgctgagcggcggtcgcatcgttgtacgtcgccaaggctggcgcaagcccaggagtcacggcctcagccaggcgcagcggctggaggacgaaggtctgtgccgcattgatcggttgggtgacgcccgcgagcttctggagggagatcggtccgaggttctgcacgaagccggtcccgttgttgtagggcggaccgtaggtggccgtctccgacgtacccgcaagctcggtcgcggcggtctgcacgaagtccaccggatctgccgtcgcccactgacggatggtcaccgctggatcatccggcgagccgaacacgatcgacaggccgagcgtcagcactgcaaccaccacgaacgcaatggtggcctccttcaggatgtcgtacggccgcacgcgtccgcgccacggcttcgcctcggcctctcgcggcaccgagccgatcggtgggaccacaccgcgataacgaaccaggaggacgtgaatcgccacgacgagcacgacgagcagcggcagcagcaagatgtgccacatgaacatctggccaaagttcatgacgttgaagaaggccccgataccggtggcgttcatggcgtccttggcctgcgtcgagatccattgtgagtcgaagttctgttggctcagatacccggtgaacgctgctccgatggacaggaggaacgcgagcacgccggtgatccacgtcatcgcgcggcgcccgcgccacgccgccatgaagaacttcccccacagatgcacgaccatgaagaagaagaacagttctacgctccacaagtggagggaattgacgaaatggccttcgggactcccatgccaccagtccgggcccttgagggcgaggatggcaccagagatggcgaccacgaccagtgcggacaacgtcaggacgccaaagacatagatccagcttgcgacgtagatcggctgtgtatctggcagcagcttctcaggtggcagcttccccgtcagggtctggcgaagccgatgggtccactccctcgacaacgtctcgggcgcgacgccgtcctcggtcgagatcggctggtcggtcttcatgaccgcctccgatcgtgcgacggaaacggcagtgcgagagccacgatgaacacgacgatcatcaacgcgatgatcaccgcgttcgccaccgtgatctggatcacgccccattggatgtagtgctgcttgccgttgagattgatcaacgcgccaagcacgagtggcaacaccaccccacctcctcatattcgcatgctgagaccaccagcacaggacggataataggcgatggcctcgtcgatcaacagggtcctaggtccccgacagaccgggaccctgggcagatcacggctacagagcgctgggggggccgtacgccgcagcccgtcgcgcatggtcgatcaccgtccgaaggtccgcgaacgcatataccagctctgcagtaagcccgcgaccacgccagagagctcgacgcgctcgctcccaccctggcgcgtcagcatatgctcgccccggtccgtcgaaccagtgctcgagcgccagcttctcgcgtggcgcaatgccccgatgccgttcagccgccgcaagggtcgagagcacgatcaggtcgtcgacacgccagcgcggaatgtcgatcggtgtgaaccgagtggactggatgagggcctgcaccgaggcgagcgaacccgggcgcgcatagcgataaccctgcacacaactaccaccgagacggagccacagaccgatctcctcgtcgacctcgacgccctcggcaaccacggacacgctgcccgtctcctcgagcgtcgcgagcgcagcaagcaccgaaaaggcatggtggtcctcacgcgcccgttgcacgaagctgcggtcgaccttcacctcgtccacctgcaagcgcgccagtgccgacagcgacgaagccgcagtaccgaagtcatcgagggacactgcgatgcgacgagcgcgcaccgccgccacttgcgccgccgcaagctcgaggtcttcgagagcgacgtcctcggtaatctccacgaccagtagggagccgcgaggcacgagctcgtccagatcgtcgaggaactcaccgtgcagaaagtgtgatggcgtgatgttgacggcaacgggaaccccgttgagcctctcggaatagtccgcgccggtcctgagtgcagcacgcccgagcgagcgtgcaagctccggcgcggcgcgaagctccgcgacgacatcgacggtcgcgatctcgggccagcgcaggagcaactcgacaccgaccacggtgccgagacgtgcatcgaccttcggctggcacgcgaaggtggctgcgcctgacgccagcgcatcgaccagcccatcacgcacccgccgacgccgctggacccgctgcgaaacgtcgccgccgtagcgaacccaccgggccttccccgccgccttggccgcgtagagcgcctcgtcggcggccatcagaagctcgcgagtcgtgcgcacgtcgtcgggcgccagtgcccacccgatcgacccggtgatgcgccaccgctgcccgatcgtgcgtaccatcacgctgatacgctctgcgatctgatctaggcggtgacgtgccgatccaaccagtgcgaccgcgaactcgtcgccaccgaggcgtgctacgaacacgtcgggggcggcgagccgagccagcgcgcgcccgagcgcagcgaggagttcgtcacccttcgtatggccgagcgagtcattgacgtccttgaagccgtcgagatccaagaatccgaccgctaccggctcctgcgcgacgagtgcgttcaatcgaacctcgaaggcggagcgattcatgagccccgtgagcgtgtcagtctgagcaagtcgctgctgcagcgcgcgctctcggtcgagtcgatcacgaagcgcgacctccgccataccgaggccgaggagttgggcaccggtgccgatgaccgaggccagccgcagctcgtcgacgccagcgtgagccaggccgactccgagcgtgtcgtggggcccatcggccgagccactcgtcggaacctgaacgagtaccgcgtggcgccacccgcattcggtgactgccgcgccagcaccctgctcgacggcgacgagctgcccgtgggcaagatcacggactcgacccaacgtgtcgaccacgattccctgcgatggccccacggcgcgggtgagtgcggtcgcagcacccggcggcacgcgcagcgctcgcacgatctcgctcgcacctgcgcgagcatcccagcgagagagccatgcccccgccaccaccccagagttcgcgagcgcccgcagcacggcctcctggacgtcctcgggtgcgcccgcagccaccacagcagcactggcatcgaggagtgatcgcgatacctgcgcgaccgcctcagtggtacgcaatccctgattgcgctcgaggcgagctcccgcagcgccaatcacgtcaccgagctggtcgaagagcgcatcggtgagcggtccatgctgctcgtcggcgacgctcaccatcaccacgcccatgagctcgccttggctgacgacgggatagcggaccaccacctgcccatgggcgaggcgcccagcggtgcgatcgagacgatatccagcccagctggcggcgacgccagcggtgagaacgcgttcgcgatgcaccgcagcagcgatcagcggcgcctccgctgcgcgcgcggggtcgaccacgacctcgacgacctcgagctcgcgacgaacgtcgtcttccgcctcgacgtggacgagtcgaaggacctcgaggccgtcctggcgacccgcgtgctcgtagaacgcagcccggtcgaccgcaccgcagccgaccagcgacgccgtcaccttggcaaagaactcacgcgacgaggactccgcactctggaggatcgtcgctcgcacctggtcgagcgcctggcgccgacgctcgagtcgcgccatcgcacgggcgcgaaacagccgtgagagctcgtgaccgagtgccgcggcgatgtcctcgacgtcgtcgggaagctccgctccccgtggacgatagagcgcaatgacacccgatcggtgcagtgagatcgacaccggggccacgactgcggagccgagtccccacgcgtcagccatcccgcgccaaagtgcaaagcgcgcgtcgtgcggcaatccggacacggtgacgcgcccggtccgcagtgcacgcccaaccggcccctgaccagcaggcagttgctcatcggtcgagagcgtcaggcctagggcatagggcgtcgcgacccccgctgccgcccgtaccaccacgccgggtccgagaccactgtgaggggtcccctctgcttcggcccagtacacgagcgggagaccggtgacacgaaccaccagatcacagatgcgctcgatggcgtcttgctcggggaggcccacgaactcgtcgaaactgttcgcgagctccacgatcgcgcgctcgagcgcatcgcgcgcctcgagtcgctcttcggcgagcatgcgcatcgagcgagagagtgcgcgctcgtgcgcgacgacgaggagcgcctcggtgccgagtccctgctcgacgagtacctgctccagcagtgcgtagatctgggccgcccgatcgaactcgacaccgatacggtgatgcatgcgcgcgatctgcgcaacacgctcgtcatcgacgtgccctcgctcgagggtcgaggcgatctcatcgaggactgcgtcggtcaacccggcgacgtcgacgacgttctcgtcgtcgagctcgagcgccgaatggacgagccgatcgagctcggcacgaaccgtagcgcgcacggcagcgagcaccgctgcgatccgtgcctgccccatcagctcgcttctcctacgcgtcaccttgcgacgagccgcccgacatcaacgcccgtggagtcgggcaccatggcgaagcgtagtgcgggctcaccgactcgactgagctatcggctcgaaccgcccgttccttagacggctgctcgatggcggcctctcggtctcaagtggcacccccacccgagaccgagcagaatgtgggtatgactgccttcgagctctcgcaagagcaagacgcctttcgtgccgtcgtgcgtgccgtcgcggaagagcggatcgccccgcacgccgccgacgccgaccgttctgcttcattcccatgggagagcttcaaagctgctcgcgaactcgagctgcccgcactcggcatcccccaggcctacggcggccagggagccgaccacgtcacccaggcggtcatgatcgaggagatcgcgcgggtgtgcgcgtcgacctcgctcgcgctcctcatctccaagctcggcatgaccccggtgatggtctggggttctgaggacctgaagcgacgctacctgccgcgcgtcgccagtggcgaggcccaggcgtcctactgcctctccgagccagacgctggatccgacgtcgcctcgatgaccacccgtgcggtccgcgacggcgacagctacgtcctgagcggcacgaaggcctggatcacgaacgccggcatctccgacacctacaccgtgttcgccaagacggaccccagcgctggccatcgcggcatctctgccttcgtcgtcgaggccgactggggcgtgcaggtggccaagctcgaacacaagctcggtgttcgcggttctccgacgggccaaatcgtcctcgacgaggtacgcgtaccggtcgccaatcggatcggtgaggaaggtcaagggttctacatcgcgatgggcaccttggatcgctcccgtccgatgatcggagcgcaagccgtcggcatcgcgcagggcgcgctcgacgcagcggtcgcctatggcaaggaacggcgtcagttcggtcgccccatcaccgacaaccagggcatccagttcaccatcgccgacctcgccacgcagatcgaggccgcccggggtctcgtctatcgggcctgcgctcggatcgacgccgacgagcccggaaccgagctgactcgcctcggcgccatggccaagctcttcgcatccgacaccgccatgcgagtcaccacggacgcccttcagctcctcggcggctatggctacaccatggacttcccgctcgagcgcatgttccgcgacgcgaagatcacgcaaatctacgaaggcaccaaccaaatccaacgcatcgtgatcgcgcgccaggtcctgaaggaggtcggagcatgaccgtcacacagctcggcgtcgtcggtggtggcctcatgggatcgggcatcgccgaggttgctgcacgacgaggcatcgacgtggtagtcgtcgaggccacggacgacgcggccaaggcggcactcgggcgcatcgagcgctccatcgcccgcggactacgctcgtccaaactctccgaggcagaggccgaggcagcccttgggcgcatcagcgtgacctccgacctcgaggcgctcggcgatcgcgacgccgtcatcgaagcggtgatcgaggacgaagccaccaagctcgcggtcttcgccaagctcgaccacgtcgtcacccgcgccgatgcgctgctcgcatccaacacgtcgtcgatcccgatcatgaagctcgcgatggcgacccaacgacccgagtacgtcatcggcattcacttcttcaacccggttccggtgatgcccctcgtcgagctggttccgtcactgctcacctcagaggcaacccaggagcgcgctcacgccttcgcggccgatcagctgggcaagcacgtcatcaaagccaaggaccgcgccggcttcatcgtcaacgcactgttgattccctacattttgtcggcggtcaggatgctcgagtcggggttcgcgaccgcagaagacatcgataccggcatggtcgatgggtgcgcacaccccatgggccccctcgcgctcgccgacctgatcggcctcgacacgaccatggcagtcgccgaatcgctctacgaggagttcaaggagcccctcttcgcgccgccgcccctcctctcgaggatgtgcgaggccgggctgctcggccgcaagagcggccgtggcttctatcgctacgacgagccgagcgcaccgaagggaggctcctagactcgtcctccgcgccctacccaaggccgaggaggtgtcatggcccctgagcgcgtacgcttcgcgccatcaccgacgggcatgttccacgtcgggtcagcacgcactgccctgtacaactggctcatcgcgcgccagagcggaggtacgttcatcctgcggatcgacgacaccgacgaggagcgcaatcgcgaggcctgggtcgacggcatcctgcgcgccatggagtggctcggcctcgactgggacgaaggtccgctccggcagtcgtcgagggccgagcgctaccgtgccgtcgccgaacggctggtgagcgaggggcacgcctattggtgcgattgcacgcgagagcgcgtcgaggcccgcaagcaacccggcgaagcgccaggctacgatggcttctgccgtcaccgagggctcgggcccggcccggggcgcgcgctccgctttcgtgtccccgaccatgacgtggtcgtgacggacctcgtccgaggggaggtgcgtttcccggccggctccatcgaggacttcgtcatcgtcaagtccaccggtcagccgctctacgtcctcgccaacgtcgtcgacgacatcgacctcgccatcacgctcgtcctgcgcgcggaggagcacctccccacgacgccgaaggcggtgttgctgcacgaagcgctggcagcgccgccgccgcgcttcgcccacctctcttttctcgtgaacgaccagcgtcgcaagctctccaagcgccgcgatcgagttgcggtggaggactaccgtcagatgggcatcctcccctgggcgctgctcaactacgtggcgctcctcggatggagcccaggcaccgacgaggagttcttcagccgtgaggagctcatcgctcgcttcgacctcgctcgagtccagcactctcccgccttcttcgacgagcgcaaactcctggcgttcaatcagcactacctccaggcactgccacttgccgagctcctcgagcaaggccacgaccacttcgcctcgatcggcgcgttcgccacccaacaggcaaccgagctgctcactcagctccttccactcgtcgtgcctcgagcacgaacactgtccgaggcagcagcgatgagtgcctttctctttgcggacccacccatcgccccgaacgagatcgaggcactccggtcggagtccgcgtcgtggctcggggcgatcgccgcacgtctcggggagctcgagcgcttcgatgccccctcgatcgaagcagcccttcgggcgctcgccgacgagctcgggacgtcgctgcgccatctccaagcaccgctgcgcgtcgccgtcaccggcagtcgtgtcggacccccgctgttcgagtcgctcgcactcgtcgggcccgaggccacgctacgacgcatccatgctctccgcgtgaccctcgaggaccggacccaagcacacgccgggtaagctcagctctgcccttcgggggtggtgtaattggcaacacagcaggttctggccctgccattgggggttcgagtcctcccccccgagccgaaggctgcgcacgctccccgcgagcacgctccgaactgcgcgtgccgctggtcgagcgtgcgggccaccgaatggcgtctggccgaggcgatcgatctggcaaaggtgggcaactcggccacgccatcgatgacgaccgtgtagaacgtcgcgtccactgtcgtcgctcgtgtgccctgacgcctccgtgctgcgaccgcgtggaacgggtgagccgacgcacgcgccgcttctgcgagcctcgcgtcgaggcacacccgcaccgcgcctctcggccacgagctctcatgagccaggagctggtcgatgacgacggggacaggtgagacaacgggagcgccagctcgacgcggactcgcgacgagctggcgccgacaccctcgatcccccgacgctcagggcgtctcgcggttcgatgccttctcgcgcacccgcgctgctcgattgagcgcattcaagagcgcacgcgcagaggcctcgacgatgtccgtcgacacgccacgcccactcacctcgtgcccaccgacgtcgacggtcaccgcgaccgatcccagcgcatcggccccgcccgtcaccgacgtcaccgagaagccggtgagccgtgcctcgagggccgtcgcctcggcgagcacccgaccgagcgcgtcgaccatgccgttgccggaggccgaggcctcgaccggggtcccatcgacgagcacggtggccgacgccacggcctcgcgacccgttcccgcctcgacccgaaagctcacgagctcgaaccgatcggcgagcgtcgtgccgagctcttcggcaacgatcgcctcgagatcggcctccgacaactcgaccttgcggtcagcgagctccttgaagcgctggaaggtcgcgttgagcgcatcaccctcgagcgcgatccccatgcgcgccaacgcttcttggaaggcgtgccgaccagaatgcttcccgagcacgatttgggctgcctcctggccgacgctggcagcgtcgatcacctcataggtggagcgatcggtgaggacaccgtgctgatggatgcccgactcgtgcgcgaaggcattccggccaacgaccgccttgttgtactgcaccggatagccggtgagccgcgagacgagtcgagaggttcgcgcgagctcgcgcgtgtcgatcccggttgtgacgtcgccgatcacatccgaacggatcgcaagccccatcacgacctcttcgagtgcggcgttccctgcacgctccccgatcccgttgatgcagcactcaacctggcgtgcacccgcggccacggcggccagggagttggccgtcgcgagaccaaggtcgttgtgacagtgacacgagatcacgtaggaaccggcgacctcccggcgcaccgactcgaccatgcgcgcgaaatcccagggaatgccgtagccaacggtgtcggggatgttgagcgtgctcgcgccctcgtcgacggcgacctggagcacgcggtagaggaacggcagcggcgtgcgcgttgcgtcctgcggagagaactcgacgtcgtcgacgagctcacgtgcgcgagcgatcgcgcgacgcacggcctcgaccacctgatcctcgctcatgcgcaacatgtgctcgaggtgactcggcgacgtcgagatgaagacgtggatgcggtggtgctccgcatcgcggaccgcttcgtagcagcgctcgatgtccgccacgtgggtcctcgacaggccgcagatcacagggccgtgcacctggcgcgcgatctggcggaccgcgtcgaagtcgccctggctcgcgaccgggaatcccgcctcgatgatgtccacgccgagtcgagcaagctgctcagcgatctcgagcttctccaaaggatcgagcgagatgccgggcgcctgctcaccgtcgcgcagggtcgtatcgaagatccgaatccgctcttgcgttcctacctcgtccaccatgttcctccccaacgtcgatcacccaatcgtctgtgcgttgccgctcggagcctcgctcccccagcgctccgagcggccagtgttgcccgaatacgagacgaccctcctgccggaggcaaggagggtcgggccagccgcgatcgcggctggcctaggtaaggagctgctcgctacgacgcgcacgcacgcacgacaccctagaggccagcgacggcacacgtgaccgtccgggcataaatgatgccgtcggtggcatccagctcggtcaacacctcgtccgggatcgggccgtcgacgccgagcaccatcagcgcagtgccatcgtcggtgcgcggcgagaccgccatggcgtcgatggagcgaccggcctgcccgaggagcgagcccacgaccccaaccatcccaggtcggtcgacattgcgaaccaccagcatccatcgcgacggaggaacctcgacccagtggccatcgacaaggacgacccgtggctcgctcgcccgctgacccgcgagcgtcccccccaccacgtgcgcaccagagcgcacgacgaggagagagtgatagttcgccgaggcgacttgcgtcgactctcgtaccgacagcccacgttcggccgcgagctgcggcgcgttgacgtaggacacgggctcttcgaccgcaccggagaggatcccacgcaagacagcgagcgacgcgagtcgcgtgtcctccgaggccaactcgccctcgtaggcgatctcgagctgctcgggaagcttgccctcgatcgccccgagcaatacaccgagcgcctcggcgagcgggaggaacgagcgaacgagctcggatgcttcgcccgcattgacgttgaccgcgaaggggacgaactcgttcgcgagcgcgagcaggacctgttcggcgatcgtgacgccggccttggactgcgcctctgcggtggaggctccgagatgcggggtgagcacgacctgatcgagccccacgatcggcgagttggtcggcggctcctcggcgaacacgtcgagtgctgcgcccgcgacgtgcccacgggcgatggcctcggcgagcgctgcctcgtcgatgatccctccacgagaagcgttcacgatccggatgccgggcttggccttggcaagcagcgccgcgccgacgagccccacggtctccttcgacttcggcagatggatggtgacgatgtcggacgtcgccatgagttcgtcgaggtccagcagggtcacgcccatcttgcgcgcgcgctcctgcgagatgtaggggtcataggcaacgagccgcatgccgaacgcgttggcgcgctgggcgaccaacgccccgatccgccccaggccgatgatgccgagcgtcttgccgtagagctcgacaccctgaaaggcgctgcgccgccactcaccgcgctgcaccgacgcgtgggcctgcgggacgtgtctcgccagcgccagcaggagcgccagcgtgtgctcggcggccgacacgatgttcgactgcggggcgttgaccaccatcaccccgcgcttggtcgccgtctcgacgtcgacgttgtcgagtccgatgccggcacgacctaccaccacgaggtggtgagccgcctcgagcacgtcggcggtgaccttggtcgcagagcgaatgatcagcgcgtcggcgtcggccaccgcctcgaggaggccatcgtggtcgagcccggtgcggaccaccacctcgtgacccgcgtcagagagcagctggaggccctcctcagcgatcgtctccgtcaccaacactctcgccatcgcgcgctccttctccctgctcagccctaaagcctaccaatgaactcagcaattcggcgaaccccctcctccagggcatcgtcgccgagtgcgtaggagagtcgccacgccccagggccgtcgaaggcttcgccgggcacgaccgcgacgtgcgcctcctcgaggagccgagtagcgagctcgagcgcgctgctgcttggcatctgcacctcgaggacgcgcgcgagcgacgggaagacgtagaacgccccgtcgggccacagcacgtccaacccttcgatgccagcaagagcgctcacgatcgtcgtgcgccggcgcgcgaacgcatcgcgcatgggcgccgtcgcctcgagcggggcctcgagagcggcgatcgccgcacgctgggacacgttggcgacgttggacgacagctggctctgcaggttcgccaccgcggacgccaccggtgccggggccacgatccaaccgacgcgccaacccgtcatcgcaaaggtcttcgcaacgccgttgacttggatgagcctcgcctcgagggcctcggtgcccacctccgcgagcgacgtcgcgcgctgccccgtgtaggtcaggtgctggtagatctcgtcggtgagcacccagatcccggcccgctcgagaacctcggccagcgctcgggactcgtctcggctgtagaccgccccagtcgggttcgagggcgagacgtggatgaacgcaacggtgcgatcggtgatcgccgcctcgacctgctcgggggtcaccttgaacccgttcgcgagggtggtcggcactgcaacgggcacgcccccaaagagtcgcacgatctcggggtaggacacccagtagggcgcggggatcagcacctcgtcgccgggctcgacgatagcggccatggcctcgtagatggcgtgcttgccgccgttcgtgacgaccacgttcgaaggactcaccacccgtccgctgtcacgcttggtgacctcgacgatgagctctcgaagctcgcccaacccagccgctggcgtgtagcggtggttccgaggatcacgtgcggctgcggtggcggcctccacgatgaagtcgggggtcggaaagtccggttcgccggccgcgaagctcacgacatcgatgcccgacgccaccatggccttggctcgctggtcgatcgccagtgtggccgacggtgagagctcggtgagtctggtggcgatacgacctcgtggcatggacctcggcctcctcacgccccgtgaagggaatccggacggttacagtgtcccttgccaggcaccaagcgagcctcgaggcagcgaaggtgaccaagggccacacgaaggaggagcacccatgcccgacgcggacgccatcagactacccagcaacctgctgcccagcgacggccgcttcggatctggcccgtcacgcattcctccgtcccacctcgaggcgctcgccgcgaccggcacgacgctcatgggcacgagccatcgacggcctaccgtccgcggcctcgtcgcgtccgttcaagagggcctggccgagctcttcagcgccccagaaggctacgagatcatcctcggcaacggtggcgcgaccttgttctgggacgccgccgcgtactccatgatcgagcacaagagccagcacctcgccttcggggagttctcctcgaagttcgccagcgtggtcgccgcgacgccccacctcgacgaaccggacgtgcgccgagccgaggccggctcggcacccgccgccgagcccaaccctgccgtcgacacctacgcgctcacccagaacgagacctcgaccggcgtcacgacccaggtgacccgccccagcgaggacgggctcgtcctcgtggacgcgacctcggcggcgggtgcgatcgtcttcgatccctcccaggtcgacgcctactacttctcaccacagaaggccttcgcctccgatggcggcctcttcgtggcgatgctctcgcctcgggcgatcgagcggatcgagcggatcgccgccagcggccgagcgatcccggccacgctctcgctcctgaccgcactcgagaacgcgcggctcaaccagacctacaacaccccggcgatcgcaaccttgttcctcatggatctccagatcaaggcgctgctcgagctcggcggcctcaagggggccaacgaacgctcgcgccaagcctccgacgtgctctatgcgtgggcaaccacgcacgcgcacgcgacaccgttcgtggccgaccccgcactgcgctcgcccgtgaccgtcacgatcgacttcgacgacaccgtcgacgccaaggcgctcgctgcggtactgcgctcgaacggcatcgtcgacgtcgagccctatcggaagctcggccgcaaccagctgcgtatcgcaacgtttcccgcgacaccggtggcggacgtcgaacggctgcgcgacgccatcgactgggtcatcgagcgcctcgccgacgacgctcgagccccccagacggcctaggcgaaggccctacgccgacgcggagccttcgaggcgaggcagccaggacggtcgtcgtgcctcgaaggcttcgatctcggcctcgtgctgcaggctgatgccgatgtcatcgaggccgtggatgaaccggtgccgaaccgccgggtcgagggcgaaggatgcctcaaggccaagttctggcacctcgaagcgacccgagaccacgtcgaccctcgccacgatcgtcggatcggacgcgctcgcctcgaggaggcgctcgacgatcgccgtgtccagcacgaccgggaggagcccgttcttggtggcgttctgacgaaagatatccccgaaccggggcgagacgacgacccgaaacccgtaatcggtgagcgcccacacggcgtgctccctcgaggacccgacgccgaagttctcccgtgccaccaggatcgtcgcaccggccatgcgcgggtcgttcagcacgaacgtcggatcctcgcgccactcggagaacagtccctcgccgaatccggtgcgcgagatgcgcttgagccactcgctcgggatgatctggtcggtgtccacatcgctgcgcccgagcggcaccatccgcccggcccactcacgcatgggttccatgctcagccctccacgtccgccggtgtggcaaagtggcccgccagtgccgtcgcagccgccacggcaggcgacacgagatgggttcgtccgccgcgaccctggcggccctcgaagttgcggttcgaggtcgacgcagagcgctgaccaggccggagctgatcggggttcatcccaagacacatcgagcagcctggttcgcgccactcgaaaccagcagcgaccaagacgcggtcgatgccttcggcctcggccgcctccttgacgcgccgtgaccccggcaccacgagcgcctgcacgcccggggcgacccgtcgtccacgcgccacgctcgcgacgacccggaggtcctcgagacgggcgttcgtgcacgagccgatgaagacgacgtcgacgggcacctctcgcatcggcgtcccgggctcgagccccatgtaggcgagcgctcgctcggctgcttggcgctcgtgctcggtcgtgaacgacgaagggtcgggaacgacgtcatcgacaccgatgacctgcgaggggttcgtgccccagctcactcgaggggtgagcgtcgaggcgtcgatgcgaacgacgcgatcgaagaccgcgtccggatccgtcgcgagcgctcgccatgcagacacggcctcgtcgaaggcccggccacgcggggcgtacgggcgaccttcgagatacgcgaaggtcacatcgtccggggcgatcaggcccgcacgcgcaccggcctcgatggtcatgttgcagaccgtcatgcgagcctccatcgacagccgacggatcgcctcaccgcgatattcgatgacgtgtccgatccctccgccggtaccgatctggccgatcaccgcgaggatgaggtccttcgcactcgccgactcggccaaggtgccctcgacctcgatcgcgagtgtgcgcggtcgacgttgcgggagcgtctgcgtggcgaggacgtgctcgacttcgctggtgccgataccgaaggcgagcgcgccgaaggcaccgtgggtcgcggtgtgcgagtcgccgcacacgatggtcatccctggctgcgtcagtcccaattccggaccgatgacgtgcacgatgccctggttctgggaccccatcgggaagtacgagatcccgaactcggcacagttcgtcgcgagtgcatccagctgcgccgccgagatcgggtcggcgatcggctggtcgatgccgaccgtcggcacgttgtggtccgccgtcgcgaccgtgaggtcagggcgtcgtacccgacgacccgcagcgcgcagcccgtcgaaggcctgcggcgaggtgacctcgtgcacgaggtgcaggtcgacgtagagcaggtccggttcgtcctcggttccctgggcgacgacatgcgcatcccaaatcttgtcgacgagcgttgtgctcatcggctgctacccccctcccgtcggccgctagcgagcggtcttgagcggcccgatctcgacgacctggaccttcagggtaccgcgtggcgcctcgtactccacccaggcaccgacgcgcgccccgagcagtgcctcaccgagtggcgaggtcggcgagacaacctcaagccccgggtgccgctcctcgatggagccgacgagatagtgctcgacatcgtcttcaccctcatagcgaaggcccacgaccacacccgggcgcacctcgtccgtcggaaggtccgccgacaccacccgagcgctctggaggatctgctggatctggcgtatccgcgcctccatcttgccctgggcgtccttcgcggcgtggtagtcgccgttctcgctgagatcgccgagcgcacgggcagcctcgatcgccttggcgatctcgatgcgcccctgggttgtcagctcctcgagctcctgaaccagggcgtcgtacgtcgcctgtgagatctctacctcgctcattgacgacgatcctagcggccggcgccgagacgccgaggcttgagccgaccagcatccgagggtacactgagctgccagcaggccgatcgacgcatcggtagcaccagcatcgtccgacggagcaccaccggtgcgacgactgatcgagaagcgaccgacctagaagggagcaacgtgggccaccgcgtagcggtcatcggcggcgacggcatcggccccgaggtcatccgagaagcgctgaaggtggtcgaggcgacgggcgtcgtcctcgaaacccgagcagtggagctcggtgcggcgcactatctcgcaacgggcgaggtcctcgacgacgccacactcgagttcctccgctcccacgacgccatcttgctcggcgccatcggaccggcgatcggctcgacggaggtcccgcctggcgtgctcgaacgtggcctgctcctgcgcctacgcttcgaactcgatctgtacgtgaacgagcgtccgtttcgcaccatcgacccctcggtcaccgtcacgcggcgcgaggcagacttcgtcgtcattcgcgagaacaccgaggggccctacgcgggcgaaggcggctttctctatcgcggaacggcccacgaggttgcccaacagggatcgctcaacactcgtcacggcgtggagcgcgtcgtgcgctacgccttcgagcgagcgcgctcccgaccacgcaagcatctgacgctcgtccacaagaccaacgtcctcacctacgctggcgacctctggagcaggacttttgcagaggtcgcggccgaatatcccgacgtcatgacggcctacaaccatgtcgacgcggcgtcgatctacctcgtcgaggatccggggcgctacgacgtgatcgtcactgacaacctcttcggcgacatcttgaccgaccttgccgctgcggtcacgcagggcatcggctacgcagcctctgccaacctcaatccggcgcgcaccggaccctcgctgttcgagcccgtccacggtgccgctcacgaccgcgtcggcaccaacaccgccaacccatgggcggccattcggtcggcgggagccatgctcgagttcctcggcgagcacgaggccgcgtcgcgtatcgaagcagcgctgtcggtcctcccgcccccgtcggcaacgacaacgcagatcggtgacttctatgcagaaagggtgcgtcatggcgatcgctgagggcaaggtcatctggatggacggcgaggtggtcccgtggggcgaggcgaaggttcacgtgctcacccacgcgctccactacggctacggcgtcttcgagggcatccgtgcctacgatacgccacgcggctccgccgtgttccgactgcgagagcacctcgtccggctgcatcgctcggcgcgcatgctgctgatggagatccccttcagcgtcgacgagctcatcgaggcgacgaggacggtcgtcgcggccaacggagaaccggcgtgctacatccggcccgtcgccttcaccgcctacggcgagatgggcctgtcgcccctgtcctcgtcgatttcggtgtcgatcgcgacgtggccgtggggggcctacctgggcgacgaggggatcgccaagggggtgcgtgcgaaggtgtcgtcgtggcgccgacacgacccgaacgtgatccctccggccgccaaggtgaccggaggctacgtcaactcggcgctcgccaaggccgaggcgatcaaggccggctacgacgaagccattctcctctccccgcaaggctacgtctccgagtgcacaggggagaacctgttcgcggtgttcgacggcgcgatcgtgacgccaccgatcgcggcgggggcgctcgcgggcatcacgcgacagaccatcatgacgctggcggccgacgccgggatcccggtgcgcgaggccaacttgctccggtccgatctctacatcgccgacgaggtcttcttgtcgggcaccgccgccgaagtcgtaccgatcgcctccgtcgacgatcggcccgtcggtaccggagaacccggtccactcgcccgagagctgcaacggcgctactacgcggcggtgcacggcgaagatccgcagcacgagtcctggctcacctatgtccacggctgacgtcctatgagcgcagggttccccgcagaggtcgagatctacgacacgaccctgcgcgacggttcccagcaggaggggatctcgctctcggtcgacgacaagctgaaggttgcgcgccagctcgacgccctcggtgttcactacatcgagggagggtggcccggcgcgaacccgaaggacgcagcgttcttcgccagggctcgcgacgaactcgcgctccacaccgcacagctcgtcgccttcggatccacccgacgagcctcgacgaccgcggagagcgaccccaacctggctgcactcaccaatgccggcgtcggcctggcctgcatcgtggccaaggcgtgggacgttcacgtcatccatgcgctccgcacctccctgccagaagcggtcgccatggttgcggactcggttcgctggctcgtcgaccacgggatccgcgtcatgctggacgcagagcacttcttcgacggttggcgtcacgaccggtcctttgccctcgacgtcctcgccgcagccgccgacgccggagccgaacgcttggtcttgtgcgacaccaacggcggcacgctgcctgatgacgtcggacccatcgtcgacgacgtacgagctgccgtcgcaacaccgctcggggtccacttccacaacgactcggggtgcgcggtcgccaactcgctcctcgcggtggcccacggcgtgatccaggtgcaagggtgcatgaacggctatggcgagcgcacgggcaacgcgaacctcgtacccgtgatcgcggggctcagcctcaagcgatcggtacgcacgattccgccggagaacctcgagctgctcacgaccgtatcgcgccacatcgccgagctcaccaatcaacccctgccgccacagagcccctacgttggggcctcggccttcacgcacaaggcgggcctccacgtcagcgcgatcgcacgtcgtcgcgacgcctacgagcacatcgatcccacactcgtcggcaacaccacgaggttcgtcgtctccgagatggccggacgccagagcattcagctcaaagccacgcaactcgggatcgacctcggcgaggacgacatcgccgaggtgctccgccgtctcaaggatctcgagcatcgtggctaccacttcgaagccgccgacggctcgctcgagctcctgctgcgacgcgcgagcggctggacgctcgacgacgtcgccgtcgagtcctatcgcacgatctccgactgcatgaccgacggaccccgggccaccgaagccaccgtcaagctcacggtgaacgatcggcgtgtcatcgcgaccgccgagggcaacggtccggtgaacgccctcgatgaagccttacgcgcagccctcgaccccgccttccccctcctcaagacggtcaagctgacggacttcaaagtacgtgtcctcgactcagaccagggcacggacgccaccgtccgtgtcctcatcgacttccaagacccagaagacacctggacgacgaccggcgtctcgaccaacgtcatcgacgcttcgttcgaagccctcctcgacggcctcatcgtggcgatcgctcgcgcccgcgaccgaggcgaggaatggtagagcaggaggaaccatggcccaaccagaccccaccatcgtccccgagcgcgacgtcgcacccgccttctgggccgaggaggtcgatcgcgccccgctggctcgccccgcggcgctgcgtggacgtcgactcgacaccgggcccgctcgcgggcgaccgggccccgatcaagggtggggctaccatctgttgaccctggtcgaaggcgagctcgatctcgtcgctggcgaacagcaccaggacatcacggctggggtcgccgccattgctgcagccctcgccgcgctcgaaggccgcgcgcccgtcctcgccgacgtcacccgagtcatcgacgcctaccatctccgcggaggcgcctcctcggacgacctgcgcaagcgagggcgcttccgcggcgtcgcccacgacgcgctccgtcgacgcctcctcgtcgacgcgaccctcgccgagctcagcgccgtccccacggcgcgttagaccgcggcctccgcgaccggtcggccggcactcgctgcgtgacggcccctcagccaggctgcgcccgcgaccactccccaagcgatctcgagcgcgagcagtaggtccgcggccacccgaacacgaaggacccatgagcgagccgtcgcgatccgccgctgcacggatgacacctctgcttcgaagacgacgacacgcccctcgaccgacgcgagggtccgaccaccggccgcgacctccgacgcgacagggccgaggccacggcacagcgaacctgcctgcggcaccagctgctggacgagcccgccgacaccacttgcgcacgccgcctcggcaacactgacctcgtgctcagcactcccgaccgcgacacgcagtccgcgcgcaccgttgctcacgcgctcgaggaccccagccacgcgcaccagctcaccgtgcccgtgatccagttcgcgaactaccgaccccagcaccggcgacggacccaccacgatcaagccgagcccgatgagcgtcacgaagaccaccccgagcacccgctgtagcacgcgcatcgcaacctccgaatccgggccagacacagtcccaacgcctcgacacagccccaacgcacgacgagccgggatcccgaaggatcccggctcgtcacgaaagcccggtcggcggcgccctactctcccagggggtctccccccaagtaccatcggcgctggtgggcttaacggccgtgttcggaatgggaacgggtgtttccccaccgccatggccaccgcccggacgatctgcggcgtcgagcgctccagagcgagcacgaggagctccaagtcctcggccgattagtaccggtcggctgaacacgttgccgtgcgtacacctccggcctatcaacgtggtcgtctaccacgggccttaccaggttgaccctgtgggaaacctcatcttgagacgagcttcgcgcttatatgctttcagcgcttatcccttccgtaggtcgctaaccagccgtgcccttggcaggacaactggcacacgagcgctacgtccgtcccggtcctctcgtactagggacagcctctctcaagtttcctacggctgcatcggatagggaccgaactgtctcacgacgttctaaacccagctcgcgtaccgctttaatgggcgaacagcccaacccttgggaccgacttcagccccaggatgcgacgagccgacatcgaggtgccaaaccttgccgtcgatatggactcttgggcaagatgagcctgttatccccggggtaccttttatccgttgagcgacggcgcttccacatgcgaccgccggatcactatgccctgctttcgcacctgctcgacatgtgggtctcgcagtcaagctcccttgtgccattgcactcgacgactgattgccaaccagtctgagggaacctttgggcgcctccgttactctttaggaggcgaccgccccagtcaaactgcccacctgacgcggtcccggacccggattcacgggtcgcggttagagctccagcaccgacagggtggtatttcaaggacgcctccagggaagctagcgctcccctttcgcaggctcccacctatcctacacaatcggaaccaaagctcaacatcaagctacagtaaaggtccacggggtctttccgtcctgatgcagctaacgagcatctttactcgtacttcaatttcgccgggtctgtggttgagacagtggggaagtcgttacgccattcgtgcgggtcggaacttacccgacaaggaatttcgctaccttagcaccgttatagttacggcggccgtttaccggggcttaggttcagagcttcgcccttgcgggctaacccctccccgtaaccttccggcaccgggcaggcgtcacagcgtatacatcgtcttggcgacttggcacgctgctgtgtttttagtaaacagtcgcttccccctggtttgtgacaccccctcgggctccgggcgcgaggcccttcaccctaccgaggtcttccttatcccgaagttacggaagtaatttgccgagttccttaaccacagttctcccgctcgccttggtattctctacctgcctacctgtgtcggtttggggtacgggcgcctcgatcactcgctagaagcttttctcggcagcatgggatcagtgacttcgcccgaagtgggctcggagtcgcgtctcaggcttcgtgaggtccggatttgcctggccctcgccctacacgctttccccaggaacgaccaacgcctgggatcacctaccctcctgcgtccctccatcgctcaaacgcgatcggggcggtaccggaatatgaaccggttgtgcatcgactacgccttgcggcctcgccttagctcccgactcaccctgggtggacgagccttgcccaggaaccctgaggcattcggcggaggggattctcacccctcgttcgctactcatgccagcattctcactcgagcgcgctccagctcggctcacgcctcaccttcacggcacgctcgacgctcccctaccgcccggtgacgtacgtcaccggacccgcagcttcggtgaccggcttagccccgttacattatccgcgcggaaccactcgaccagtgagctattacgcactctttgaagggtggctgcttctaagccaacctcctggctgtctgggcggttccacatcgttttccacttagccggtactttgggaccttagctggcggtctgggctgtttccctctcgaccacgaagctcatcccccgtggtctcactgccaggctctggagcatcggcattcggagtttggttgggatcagtaaggctgtgggcccccatagcccatccagtgctctacctccgatgctgaacacctgacgctgcacctcaatgcatttcggggagaaccagctatcaccgagtttgattggcctttcacccctatccacaggtcatcccccctgttttcaaccagggtgggttcggccctccacgggatcttacccccgcttcagcctgcccatggatagatcactcggcttcgggtctaccgcaggcaactctcgtcgccctgttcagactcgctttcgcttcggctcccccacgcatgggttaacctcgctacctacggtaactcgctggctcattcttcaaaaggcacgccatcgccctcgcgggctctgactgcttgtagaccaacggtttcaggatctgtttcactcccctctcggggtgcttttcacctttccctcacggtactagttcgctatcggtcgcctgggagtacttagccttacgaggtggtcctcgcagattcacacgggctttcccggatcccgcgctacttgggtggcgacggggaggcagctcgcttcgcctacggggctgtcaccccctgtggcgcgacgttccagtcgcttcggctcacgcgctgcttggtaactccctggaggggctggcgcaccctcctcgtcgctcccgctacccccggacggcaacgccgccaggcttgacaccgcccgggtttgggctgatccccgttcgctcgccgctactaggggagtcgcggttgctttcctctcctgggggtactgagatgtttcaattccccccgttccctcctcctgccctatgtgttcaggcaggggtgacgtggcattccccacgccgggtttccccattcggacatccatggatcaacgcttggtcgacagctccccatggcttatcgcagtcgcccacgtccttcatcggctccaggcgccaaggcattcaccgttggcccttcgtaccttggagttgtgatactcgtgctcgctctggagttctcaagctgccgcgcagcaggtgcttcgcgaagagggagccagtgcttcgactgggtgcggccactcgttgtggccactccttagaaaggaggtgatccagccgcaccttccggtacggctaccttgttacgacttcaccccaatcgccgaccccaccttcgacggctccctcccttgcgggttgggccaccggcttcgggtgttgccgactttcgtggtgtgacgggcggtgtgtacaaggcccgggaacgtattcaccccggcgtgctgatccgggattactagcgactccgacttcacgcagtcgagttgcagactgcgatccgaactgagaccggttttttgggattggctccccctcgcgggttggcgaccctttgtaccggccattgtagcatgcgtgcagccctggacgtaaggggcatgatgacttgacgtcgtccccaccttcctccgaattaactccggcagtcccctacgagtccccggcatgacccgctggcaacatagggcaagggttgcgctcgttgcgggacttaacccaacatctcacgacacgagctgacgacagccatgcaccacctgtgaagggccccgaaggacaccgcatctctgcggcttttccctccatgtcaagcccaggtgaggttcttcgcgttgcatcgaattaagccgcatgctccgccgcttgtgcgggcccccgtcaattcctttgagttttagccttgcggccgtactccccaggcggggcacttaatgcgttagcgtcggcacggagcccgtcgaatgaggccccacacctagtgcccaacgtttagggcgtggactaccagggtatctaatcctgttcgctccccacgctttcgctcctcagcgtcagtaccggcccagatcgctgccttcgccattggtgttcctcctgatatctgcgcatttcaccgctacaccaggaattccacgatcctctaccggactcaagccatggcagtatcggatggcgacaccaggttgagcctggtgatttcacatccgacttgccaagccgcctacgagctctttacgcccagtaaatccggacaacgctcgccccctacgtcttaccgcggctgctggcacgtagttagccggggcttcttctgcaggtaccgtcagtttcgtccctgctgaaaggagtttacaacccgaaggccttcgtcctccacgcggcgttgctgcgtcaggctttcgcccattgcgcaatattccccactgctgcctcccgtaggagtctgggccgtgtctcagtcccagtgtggctgatcgtcctctcagaccagctacccgtcgtcgccttggtgggccgttaccccaccaacaagctgataggccgcgaggccgtcccgtcgcgcccgaaggctttgctccctcgaccatgcggtcaggggagcacatgcggtattagcaccggtttcccggtgttatcccccacgtcggggtgggttcctcacgtgttacgcacccgttcgccactcggtggcaagccaccgcgtacgacttgcatgtgttaggcacgccgccagcgttcgtcctgagccaggatcaaactctccattggagatcgttccgagggtggagtccaccctcgctcgcctcgccccgggacacgtgggtctcgggtgggggagagtcgatcatggttggtgggtttggtcccaccgtttgtgttgtcggggtgacaccgagcttgtgctcgggtcgcccgcactggcttgtcttccctcttcgcgatgtcaacctgcgcccctgtcggggctctgccacgagggcacccgaagctgctcgtcgtggctggtgggttgccccacccccagcggtgctcttggagcacgtgggattcatcagtgtagcggggtcggaacgggtcgtgcacggttggggggcaaaaaatcgccacggaccctgtgcgaagtccggcaacgcggctctcgccgctggcgtcgcgcccccaatgcgagcttgggtgactcacccggccacctcggtgggcagcacagtgctgtcactcgccccgggaccaggctcgtcgagacctcgatcctcgcggccgaacccaccaactccttcagggagatcggcgttcacgatcgaactcggcgcgacacaccaacacctagccctcgccccccacaccacgccaagagggacggccccgaggcgaccgaagctgcggcgtagacgcctgcagtgcaatgccatccagcacgtgggctgaaggcacacacccggcggcggcatccatcggccagcgcgcgtcggcgcgcactccgaacgccatggtccgttggctcgagaacgtagaagcgcccacgaaatgccagaaggtgatgtcgccactcagggtcccggcgagtcgctcgttcccggagacgggtcgcctaccagatccagccgacactgcgcgacatcgagccgcccgcctggcgacgacccctcgtgcccggtgggacgacgctctcagtgctccatgacgacatgcaggcagccctggggtgggccgacgcccacgtgcacgagttcgagaacgatggcgtgcgctatgcgatgccggacatggctgacgactgggacacggaccgcgggtggccgatcgacgggttcgcctctctcgggtggccggcgaggacagccggttcctcgaccgctacgacttcggcgacgactggcgagaggatgtcctcatcgagaaggggttccccgccgaacccgacaggcgttaccttgcgagcatcgacgggcgccgcggcggacagcccgaggattgcggcgagcctctcgggtacgcggaacacctcgaggtccgagccgaccgcgcggaacctcggcaccgtgaataccgcgactgggtgggcgacttcttcgatcccgaggcgttcgaccccgcggacttcgacgagcacgtgcggacgctgcgcgcattgcgccaatggtgagacgacccattgcgtggcgggatagccaggtcgagagataggcgacccacaccgcaggccttcacggggctgccacaggttcgtggaggcctggccagcctgacggacgtcaactcgcgccaccgccaaccacgcgtctggtgcgctcccacgccaagactcggcacgctcgaagcgaccgcacgttcgatccgtcgtgctcccgagcccaccaccgttcaggcgatcttcaacccacgaccgcgacagggcgcccggcgcgaggccactcgtcgtcgccgaaccgctcagccggatgcgtccccgacatcggcggttcctcgtcgctagttcccacgagcgagctcgttcccttcgatgccgccttcgagctgcggtctaaccccccagaatgacccgcgggcccttgccccacgacagatagtgccacgaccagttcatgagcacggacgccttgttcctcgaaccaaggagaaaggcgacgtgcaacagcagccacgagacccatgcgggggttccgtgaagccgcacgcctcctgcaagctccgcgacggcagcgcggcgtccgatcgtcgccatgatgcccttgtcccggtagcggaacggctccgtctcgctaccagcgagcaaggcgaggatctggcgtgctgcgtgctcgcctccttgcagggcgggctgcgcgagctggggcaagggcgcgccgtcacgattcgtcgacagcgcgacgtccccgaccgcgaagatccgatccgatccgacgacgcgcagatccgagcccaccatgatgcgcccaccgcggcccgtgggcagaccgagcttcgacaccaccggcggaacggcgatgcctgcagcccacagcacgagcccgttgcggatctcacgtccgctcttgaggacgatcaagccctcctcaaccgactcgaccgtctcgttcagcagcaccgtcacgccacgcgctcgcagctctcgacgggcgtactccgagagatcctcgtggaacgcctcgaggagacgcccacgctgctcgatcaggacgaccttcacgtcgtccggccccagcatggtgaaatcggtgtagagcgcccgatgtgcgagttcagcgatcgcgcctgcgagctcgacgccggtcgcgccaccaccgacgacgacgaaggtcagcacgccgtcgtgcacgccgtggctcgctgcatactcgaagcgctggaagatatggttccgaacgtcgacggcggcgtccagcgtgtagatcgtgtgggaccgttcctccgcacccgggatgccgaagaacgatgcgctcgccccgatcccgagaatgaggtagtcgtagtcgacgatacgaccatcctcgagtccgatgaagcgacgcttagcgtcgacctcggccaacgtcccttggatgaagtgcgcgtgacgcgctctgcgcaacacggtgcgcaacggataggcgacgtcaccggcgttcagtcccgcagtcgcgacctggtagagcaacggctggaacgtggtgaagttgtggcgatccacgacgaccagctcgaccggcgcatcccgaaggacctcgatcgcggccaatcccgcaaagcccgcacccaccacgaccacccgtggacgagaaccctggcgcaggtcaccggactgtgattgtgtcgactgatcctgatccacggtcttgaccatcgcaactcctcacatcgtgcccgctcgctggagagtctacgaggaaccccgcccaggtcgcgtggcccgagtcagccgtgagccctgaaccgcgaagcgcaccgctcccgaaacctcgactggacgtcgaccgacgacgaggactgcgcccccgatcgactcgcgaaggacgcgatcgaacacctccggcaccacgtctgcgtcctcgacccacaacagcctcgcgaccgccgggcggaccagggccatggccagctcgagtcgcgcgcgcgcacgcggtgagagatcgaccgcgacggcgccgtctcgcccctccaatccgcttgcccgaagcacgtccgcgaacgagggaaccggcgccgaaccgactcggcgcgcgagcctgacggcgagcacgaggtgctcggcgaccgtcaggccctccaccggctcgaaatcgcgagccgcgaccgcacccatcgcgcggccttcgagcgtcccaagccgcgcaccccgcacacgaagcgccccgccggcctccgtgtcaccacgagcgagctcaaagaacgcgccggggtcttcgagcacaagcacggcccgctccttccccacgagcgtcagctccgtcagtgacaccggaccgccaggctgccagagctgcccctcgccccagaggagcgcatcacgctcgcgagtcacggccccaccaactcgcgaacgacacgcccgcgagaccgacgaccacaccaaacgaggccgcagcggccacatcctcgaggatcagcgcgtgctgcgcgaggccgaggttggcctgcacggcaggggccgtcacgaacagcgcgccagcgagcatggcgacgatcgggatgaccgggttccgagtccacacgtcgcgatcatggagcaccgcgatgacgcacgcgacaccggtcgtggcagcagcgatgccgacgaggccgaccacgaccaccgacgacgcaagcccgagcggcaccggagcgagcagaccacccgctagcacagcgacggccaggacgaggaggtccgctgccgcactcacccgaacgacgcgcgatcgacgcaccggcagcagggcaacgagccctcgcgagtcgaggaatcccccgagcggacgtccaacgacgagaccgagcgcgaggaccccgaccaccaccggcaccgcgcccgcagggtcgccacgtacgagcgccgccagccccgcaacggtcgcggtccccgctaggagcagcgcaacaccggccgcggcacgaccgcgtccgaggccgagccatgtactcgtggcgatcggggcacgcagcaggcccgcctccacgacaccgtgcggtcgatcggcaccgcgacgtggtcccgacggccgcacgtcaaggcgcccgacgccgatgcgcaacgcgagcgcgaggatcccgaggccgacgaccgccacggcatcggtgcgacccaacagccatgcaccgacgctcgcagcgagcgcaccgctcgggacgcgaccagccaccacgacagcgatcacgagcatgccgacgatcaccgcacgacgccgactccgcgcaccccggcgaacgatcccgagcacggcgccgagcgagacgccaaccgcaatccacgtcccgcgaaccacgtccgagcgatgtccatgggcaagcgggagcacgagtgcggcccccgcaaccacgccaacgatcagctccgcggcgaccgagcgcgcgctgtcgtgctccgcggctggcatcgcgatcccgatcgccacgagcgcgatcaccgtcgccgcgacgactcgtgccacccaagccaggctgtcaccgccgagcaggtggagatcacgctcgagaacggcctccccgacgacgagcgtcacgagcccccagagaccggggcgaaccagtgctctcgggctcacccacccgagacctggtcgagcttggtcgccgacgccaggaacggcatcattgcgcgcagatctcgaccaacctgttcgatctgggcctcgcgcgcctcacgccgcaaggcctcgaaacgggggcggcctgccgcgatctcgtcgaccagctcggaggcgaacgctccggagcgaatctcgtcgagcacgcgacgcatctcggctctggtctcgtcgttgacgatgcgcggtccgcgggtcaggccgccatactcggcggtctctgacaccgagaaccacatgccagacaagccgtgctcatagagaagatcgacaatgagcttgagctcgtgcaggcactcgaagtaggcactctctggctgatacccagcctccacgagcgtgtcgaaccctgcgcgaacgagttgcgagagtccaccgcacagcacgacctgctcaccgaagaggtcggtctcggtctcctcggcaaaggtggtgtcgagcacaccggcacgcgtcgatccgatcgcccaggcgtacgcgagcgccgtgtcgtgggcgcgaccactggcgtcgttggcgactgcaatgagcgacgggatcccgccgccctcctcgtaggttctgcgaagcaagtggcccggacccttcggggcgatcatgatcacgtcgacgctcggatcgggctcgatcaatccaaagcgaatgttgaagccgtgcgcgaacgcgaccgcgctcccgggctggaggttgggggcaacctgctcgcgccacaacgtcggcgccgtcgtgtccgggacgagcagcatgacgagatcggcccagcgaacggcgtcggccacactggagacctcgagtccactggcacgggccttgtcggccgacgcggacccttcgcggagccccacacgtaccggcacccccgagtcgagcaggttcagcgcgtgcgcatgaccttgggacccgtagccgatgatggcgacgcgccggtcagtgatgagagcgggattcgcgtccttgtcgtagtacatctgagccacgcgtcagctcacctttcctcgtcgtgccactcgtctgactggcttgggtagtctggccagcgcaatcctaccgctgcgctgcacctcgacgatcccgaactctccaaggagcgcctcgacgtcgtcaagtgccgacggcgcgagcgcgaacatcaaggtcagccgttcggcgttcacgtcgagcacctggccgcggaacaactcggcgagctcgagtgctcgtgaccgggacccaccctcggccacgatcgtcaccaacatggactcgacctcgacggcgtccgacgggtcgagctcggtgatcttgaggacgttgatgagcttgtggagctgcttcgtgatctgctcgagcggcgcggtctcgacgtcgacgaccatggtgatccgagagaagcgctcgtcgtccgtgggtgcgaccgctaacgagtagatgttgaacccccgtcgtgagaacaggagcgcgacccgagcgagcacccccgccttgttctcgacgaggaccgagagaatatggtgccgcccgtggacgggctggcgaattgcgccgatggggaccagattcgacgaggcgctcatcgaccatcccccacgaggtgaggcggcagcacgatgtcatcgttcgatgctccggccggcaccatcgggtacaccttctcgaaggtatcgacccgaaagtcgatgacgacgggccggtcgtccacctcgttggccttctcgatggcagcgtcgacctcctcgggggcgtcgacccgcatgcccaccgcccccatcgcctcggcccagcgcacgtagtcgggcaggtccggcgagagatagacctcgctgtagcgctcgtcgtagaacatctcctgccactgacggaccatgccgagatagccgttgttcaagatggccactttgatcgggatgcgctctgccgatgcggtgacgatctcctgcgccgtcatctggaagctgccatcaccatcgatcgcccagaccatctgccgaggccgggcagccttggcgccgaccgccgccggcacggcgaaacccatcgtcccgagcccacccgagttgatccactggcgtggcgcacggaacgtccagaactgcgaggcccacatctgatgctgacccacgccagccaccaaaatcgtgtcgtccggcgtcaatgctcgcaaccgctccacgacgaactggggcttcgtcgcagagcctggctcgctcgggacgtacgacagcggatagcgctgctgccactcggcgatcgtcgcacgccaggccccaaggtcggccggctcggccggcaagcgccgaagcagctccggcaagacgttgcgcaggtccccgacgatcggtacgtcggcacggcgcaccttccccaactcggccggatcgacatcgacgtggatgaccttcgcctcgggagcaaacgcgctgacacggccggtcacgcgatcgtcgaagcgtgctccaagggtgatgagcaggtcagcgcgctgcatggccatgacggcggcataggtgccgtgcatgccaggcatgccgagcgcgagcggatggtcgtcggggatgatgccccgagcgagcagggtggtcaccaccgggatacctgtgcgttccgcgagcgctcggagctctcgctcggcccccgcacggaccaggccgccccccgcatagatgaccggccgccgagccgcggtgatgagcgccgcagcctgttcgatcatcttggggtggcccttggtcacgggctgatacccgggcaggtcgagacggcgcggccagtaccactcgagctcgccagttgagacatccttcgggaggtcgatgagcacggggcccggacgtccagtggtggcgacgtggaacgcctccgccaccacgcgcgggatgtctgccgggtcggtcacgagccagttgtgcttcgtgaccgacatggtgatgccggtcgtgtcgacttcttggaaggcgtcagagccgatcgccccggtcgggacctggccggtgatcaccaccatgggcacggagtcgatcgcggcgtcggcgaccgccgtcacgatgttggtcgccgccggaccgctcgtgacgatggcgacgcccggacgaccgctcgcctgcgcatagccctccgccatgtggccagcaccttgctcgtgacgcacgagcacatgccggatgggggaatcgagcaacgggtcgtagaccggaaggatcgcgccccccggcaacccgaagaccacgtcgacgccctccatctcgagggcgcgcaccagcgcctgtgctcccgtcaaccgcatgtcgtgacccccttgtgctcggcgctcgccgccaactcctcctcagaccgtctaccgcgacccggatagcaaaagacctcccgcaagggaggtccgatgggcacgacgacggaggacgccgtgccctagcgaaggagtacgagcgaattcgtcgccatggcacccaacctagcgcgagtcgtcgtcgaatcctgccgaggtcaccgccccaacatcggcaccgcgcacgagcgccgcgaacttcgcgagcgcaccgctcgtgtagcgagggggcaagggcgcgaacgacgctcgtcgtcgctcaagctcgtccggggcgacgagtagatcgatcgcatggttcgggacgtcgatgcgaatccggtccccgtcgcgcacgagcgcgatcgggccgccgtcggcggcctcgggagccacgtgaccgacgcacagtccatgggtgccccccgaaaagcgaccgtcggtgacgagcgccgcgtccgaaccgcgtcccgcccccttcatcgcaccggtcacggcgagcatctcgcgcatgccgggcccgcccttcgggccctcgtagcggatcacgacgacgtcgccagcgcggatctccccggccaagatggcggtcagggcagcttcctcgcggtcgaacacccgggccgtcccctcgaagacatcctggtcgatgccggccaccttcacgaccgatccgcgcggcgcgaggcttcccgtcagcacggcgatacccccgacggcatgaatcgggtcgtcgagacggtgaatcacgactccatcggccgctggcggatcatacgcatcgagttcatcaccgagggttcgccccgtggccgtgagtacgtcggtgtggacgagacccgcctcggccagctcacgcagcacgaccgggaccccgccgacgcggtcgatgtcggtcatgtagaacttgccgtgcggcttggtgtcggcgaggtgcggaaccctcgcggcgatccggttgaagtcatcgagccgcagctcgacacgggcctcgttcgcgatcgccatcaggtgcaagacggcgttcgtcgacccgccgagcgccatgacggttgcgatggcgttctcgaaggcctccttggtgaggatgcgtcgcgccgtgatcccgagctcgagctggcgcatgacgagttcgcccgcctcgaacgccgcgtctgcacgacggcgatccaccgctggcgcggacgccgacccgagcggcgccaagcccagcgcttcggacaccgaggccatggtgttggcggtgtacatacccgcgcacgaaccgggcgtcgggcacgcgttgcgctcgatcgcgctcagttcgtcctggctgatctgtccggcagcatatgcaccgaccgcctcgaacaccgagacgatgtcgagccgctgatccttcagatgacccgggaggatggagccgccgtagacgaacacgctcgctaggtccagccgtgccgcggccatcatcatgccggggagcgacttgtcgcacccggcaagcgtcacgagtccgtccatgcgctcggcgtgcaccatgagctccaccgaatccgcgatgacctcgcgcgacacgagggacgagtgcatcccctcatgacccatggagatgccgtccgataccgcgatggttgcgaactcgagcggcacgccgccggctgaccgcacgccagccttgacccgcttggcgagctcaccgagcggcaaattacatggtgtcacctcgttccacgatgaggcgaccgcaatctgcggcttgtcgaagtcctcctcgaccagcccaaccgcgcgaagcatcgcgcgcgctggtgctcgcgtcggcccctcggtgacgtcccggctccgaaccttcagctgccgccgctccacgttgacaccccctgctctgcgacgtcggcgacaacgccgacagctcgtttgccgtgcgggcccgcccgaaccgcttaccctacgtcgaactacgctccgacgaggcgcgctcgtcgagcgcacggcgggcgagctgaccagggaccttaccacccgaacggcgcaccacctgtcctacgaggaaccccgcgatcttggcgtcgcccgccacgaagcgcccccactcctcgggcgccgacgccgcgacctcctctgccaacctcgcagcctcggcttcgagcccttcccgtccgcccgccacggccgcgacgagggcctcgatcggatccgaacgctcggcagcgatacgcagcacctctcggacctgctgggcgagcagcaggccgtctgcctcggccttgaggacctcgaccacgcgcgcgggatcgatctcgacgccctgcgagcgcacctgcgcgatctcgttggcgactcgcctcgcaacgagtgtcgctggaagtccggcgtcgagcgcaactcgggtgtaggcccacagctcctccgacaccgccgtctcgcgcacgtctgggctgacggccgcgtcggcgaggcgagcacggcgtgtgcgcggcagcgaggcgacgagtaggtccgacatcgcctcgacggcggcctgatcgaccacgagtggcgggaggtccggctcggggaagtagcgatagtcctcggcggcctccttggtccgcaagccgacggtcgcaccgcgagcctcgtcccagtggcgcgtttgctgcaccacgggctcaccgcgctcatagctctcgatctggcgcatcgcctcggcggcgatggcacgctgcaacgagcgcaacgaattgaggttcttcagctcgacacgggtccgcagctcctccgaaccgatcggtcggacggaaacgttcgcgtcgacacgcagggacccctcctccatgcgcccgtcgctcgcaccgacggcgaccacgatcgcacggagctcgctgacgtaggcgcgtacctcgtcagggtcgcgcagatcaggggccgacacgatctcgagcagcggcacgcccgctcggttgtagtcgatcagggtccgctcggccgactcgatgcggccccctccacccacgtgtgtgagcttgccggtgtcctcctccagatgagcccgctcgatgcgaatccgtcgacccccatcgagctcgaccgcaccgcccgcacagatcggcacgtcgtactgcgagatctggtagttctttggcatgtccgggtagaagtagttcttgcggtggaactggctgctctggacgcgcgatcccagggcggctccgaccgccatggcgatctcgacgcagcgcgcgttcacgaccgggaggctccccgggaggccgagacagaccggacacacgttcgtgttgggtgcctgcccgaatgcgttggcacacccacagaacagcttcgtcgcggtccgcagctccacatggacctcgaggccgatcacgagctcgaatccgcgctcgagccacggccacctcatcgctcggctcccgcctcgagcgctcgcgccgccaccaacatgcgcgcatcctcccacgcaggtgccatcacctggatcccgatcggcaagcgatcagcgtcgtagccgaagggcactgacaccgcaggcccaccgaccaggttcgacggcaccgtacagacatcggaccggtacatggccaccggatcggcgacccgctctcccaggcggaacgccgtcgtcggcgacgtcggggtgatcagcacgtcgacatcggcaaaggcacgagccaagccggcagccagccacgtgcgcacgcgctgagcctggacatagagggcgtcgcgatagcccgccgacagcgcgtaggtgccgagcatgatgcgtcgcttcacctcgtcgccgaagcctgcggaacgtgtcgccaccatcatctcgtcagtggtgagcgcctcgacgcggagtccgtagcggacgccatcgaagcgcgcgaggttcgacgacgcctcagccggggcgaccacgtagtacgcagcgagtgcggctgccacctcggggatcgacacggagacgacgctcgcacccaggcgctcgaggtggcgggcggccgcctcgagcgcggccgccaccgccggatccgcggtctcggcgagctccgtcaccacgccgacggtccagccagcaacgtcgcgatcggatggatcgctcacgatcgggccgcggggtgcactcgtggcgtcacgcgggtcgtgcccgctcagtaccgccagcaacgccgcggcgtcgtccaccgtcgccgcgaaggggccgatctgatcgagggatgaggcgaaggcgatcaaaccgtagcgtgagatcgcgccgtaggtcggcttcacgccgaccacgccacagagggaggcgggctggcgaatggatcctccggtgtcagaaccgagcgcaagcgcgctgaagcgggccgccaccgcggccgcagacccgccagaggagcctcccggaacacggtcgagatcgtgcgggttgcgagtcggcccaaaggcagagttttcggtcgacgatcccatggcgaactcgtcgagattggtcttgccgacgatgacgccgccagcggcgagcacccggtcgacgaccgtcgcactgtagggcgacacccacccttccaggatccgcgagcccgccgtggtcgggactccctcttggacgatgttgtccttgatcgcgatcggtacaccggcgagcggacccggatcatgaccggcccgcacggcggcgtcgacagccgccgcccggcggcgcgccgcgtcgaagtcgagatggaggaaggcatggacctcgggctcttcgaccgcgacctgcgcctcgtaggcctcgagcacctcctcggcccgcacagcaccctcgcggaccgcacgagcgatgtcgaccgcccccagatcgagaatcgcctccgagttcacgcgtcgagctccacgatcggcggcaccaccagcagctgctcctggttgaggcgatccccgctggccaacccggcggggccgagacttgcctggacgacatcagggcgtagcgacgacgactccgatgggacgtgctccatcggggccacgcccgcaagatcgagccgagcgatctcgtcgatcagcgccaacaccccagagagctggtcgcggtagtgcgcgagttcaccgtcatcgagacgcagccgcgcgagccgggccacgtggagtacttgctcagtggagatgccgtcctgcacgcgcgccatcctagcgacgcggccacgaccgactaagacgtgatcgcacgcaggatcgccgtcacgcgctcgtcccgggtcgcgaagacctgcgccagcccgagcagcttcgtgatgtcaccgttcacggtgacgcggccggcgaggaacgcctcgacggctcgctgggggtccatgtcgacgaacatggccttggcggtctcgtaatcgatcgtgatggtgagatccgcctcgtccacgaggcccaagccgatctccaagatgcccgaggtggtatcgatgtgagccgtgatcggttcggggccgaacggcgtcccactgatcagctggttcatccgcagcggcaccgacacgctgatgggctcgataccgagccgactcgtcaggttgtcgaactcctcgagccatgcctgcgacaagaactcgtgtttcgcaagcccctcgaggatttcgggatcgaacgactccatgccccacttcctgaccggcgttactgcgtgcagcctacgagttcggggcgagcaccaagttcaccgcgctcccgaccgggacctcggtgccagccggctcaccctgggcgacgacgaccgccgaggtgccgaggtaggacgcaacgccgttcaacgacaggccgcccggcgtcgtgagctggccataggtcaggtgatccgcctggagcgcagcgaccgcttgcgcaaaggtgtcgtcgaagaggttcgggaccgcgacgtcggggggaccttgcgagatcacgagcgccacagtgctgccgaacggagccaccgtgcccgcacccggcgattcgctgacgacatcgcccgatgggaccgaggtcgagtacgcctgcgacgtcgtgacggcgaatccagccgcgcggagggcggctgctgcagtcgcctctggctctcccgcgaccgccggcacggcgcgcggcggcggtccagcggacacgatcagcacgacgacgccgtgccaccggacgcgttggccagccaggggctctcggatcacggtgccggccgagacggtggccgagtaggcccgatcgagccgcacaccaagaccgacacgcgagagcgcgcgtcgagcatcggaggcgatgaagccgacgacgtcaggggcgaccaccggcgcatggccgcgtgacacgaggatctcgacgaccgcgagcggatggagggcaacccctgcaccaggcacggtccccacgacgcgtccgggcgcgaccgtggcgctgtaggtctcgcccgtccgaatgcggaagaagccgagctcggagaggcgtgctcgtgctgcggcaggttcgaggtctgccagccgcggcacgctcaggcgtcgaacggcaaggtaccaggttgcacccagggcggccacgaccacgatgacgagcagcatgagccacacacgccgccgacgtcgcgctggagggcgtgcctcgatgctcgtcagcgacgccgtgcggccctgatccggggggacgaacgcgaccgacaacgaacttgggtcgaggacggcctcaggatcgtgcgcaggattttcgagcggtagcggtgacggcgccgggagcgcgcgcaccagttcgtcgatgagacgatgcagcgtctcatcgtccggtcgctcggcgggatcccgacgcgtcatgcgaaccaccacgtcgagcagctgtcgtccgggctcagggttgaccacgtccttcgtgaggcgttggcgcgcgacctcctcgatcgacccgccctcgaacgggaacgagccagtggcgagctcatagagcacgagcccgagcgcgtaggtgtcggccggggcctcactgcgagacgccagctcgtcgtgtgcacccagggccgagcgcagctgttcgggcgctgcgtatctcggtgtgccggcgtggcgcccaccggaggtctccgatgcgtgacgcaccagcccgaagtcagccaggcgcacgtggcccgtctcgtcgagcaagatgttcccgggcttgacgtcccgatgggtcagaccgtgcgcatgggcggcagccagcgcgctcgcgacctcttgggcgatccgggcgacttgcgcatcgtcgagacggcgaccacggcggacgagatccttcagcgatccgttcggcatgtactccatcacgagcacgagcccgatcggcgggccaacgtcgaggaggtcgagcacacgaacgacgtggggatgctgcatctgcgagatgacctgcgcttcgcgccgcagctctcgaacaaaggtgccatcggtgcgcagctccggccgcagcaccttgagcgcgacgggcgcaccgagtcgaaggtcgagcgcgacgtagacgacaccggcaccaccggtgccgaggcgccgctggacgacgtagcgaccaaccagggtccgacctgtgatgtcatccatcggcgacgtcacgctgaccaacgggctcccacctcgatcccgcgatcgacggtatcacgcatccgacccgcctcgacggtcgatgagctctcggagcccatcgaggtcgatgacggggatcccccgagcgcgggcctcgtcgagcttcgaccccggtgatgcccccgccaccacgtagctcgtccgctggctcaccgacgtacgcacctggccgccgtgctcctcgatgagcgcagcgagctccgcacggccaatgcccggcacggtgcccgtcagcacgaagctgaggccctccaggggtccaccggccgcgcgcgggcgatcggctgaggctccgaccccagcacgttcgagcttgtcgaggatctcgcgcccgaggtcgctgtctcgaaacgcgacgacgctcgccgcaacgaccgggccgatcccctcgacgcgacagagctcgtcctctgtcacggttcgaaggccactgagtgagccgacgacgtcagccacgagcatgccgacgtgctgaccgacgttgtcgatggcgagggcgaagatgacacgcccgagcgggcgcgaccgcgacgcctcgatgccagctcggaggcgctcgatgctccggtggcgcaccccagggagccgtgccaggtcgtcgtccgtgagtcggtacagatccggcgggacgaccacgagccctgcctcgacgagctggcgcgcgcgttgttctcccaatccatcgatatccatggcgtcgcgactggcgaagtggatgaggcgctgcacgagctgctcgggacagcgacggttgggacagcgccagtcgacctcgccgcgatcgcgcacgaggggcgtatgacacaccgggcaggtcgtggggaagacccatggcaccgcgtcgtcgggacgcagctcgagtaccggacgaaccacctcgggaatcacctcaccggctcggcgaacgatcacggtgtcgccgacacgaacgtcgagccgtgcgatctggtctgcgttgtgcagcgtcgcgcgactgacggtcgagccgccgacccggaccggatcgagcaccgcgaacggcgtcaccttgcccgacttgcccaccgacacctcgatccccacgagccgggtcggacgctcctcggcggggaacttgtaggcgatcatccaccgtggcgcgtgcgtcgtcgtgccgagacgcacgcgatcctcgaggcggtcgaccttgatgaccgcaccgtcgatgtcgtagtcgagcccgtcacgagcctcggcgagccacgcgagcttgtcggcgagctcgtcgaggccgaccggggtggcgtgtgcttcgacctgaaaaccaacctcgccgagccactggagcgcttcgtggtggtagtcgaagctcggcccctcttcgagctggtaggcgaagaaggagagcccgcggtcgcgggtgagcgccggatccttctggcgaaggctcccggcagcggcgttgcgaggattggcgaacggtcgctccacgcgctcgttcagggcccgaaaggccgagcggggcaggaagagttcgccgcgcacctcgacgagcccaggtcccgtgacgcccttgagacgacgtgggatcgcgtcgacgacgagggcgttcgccgtcacgtcctcgcccacctcgccgtcgccgcgagtggcagcttgggccagacggccatctacataggtcagcgagagcgcaaggccgtcgatcttgagctcgaagaagagcgcagggtcgtggccaagaccgcgccgcgtccgctcgacccaggcgtcgagctcgtcggcgtcgaagacgttgtccagcgagagcatcggcgttcgatggcgcactggagcgaagctcgatccgggaggcgcgcctaccctctcggtgggcgagtccggagaacggagttcggggtgggccgcttccaacgcccgcagctcgaggaccagcccgtcaaactcatcgtcgctcatgatcggatcatcagcgacgtagtacgcctcgctcgctcgctggatgagcgagcgcagcgcggcaacgcgggcagcggccgactcagtcatcgtcgacgacccgtgccgaggcgagtacccgatccttggcgtcgtagaggacgactcgctgcccgggagcgacgcgacgagcaggctcgtcgaaggcgaccgccgcctcggacagcgacccaggaagcgcgacgccatgcgctgcagtttggacgaggccccgaagcggctcgctccggggcacgtaggacaccagatcctcgatcggctgggctgcgaccaagagatcgctcgcactgccgacgcgaacagccgtccgagacttcgcgatcacgtagcgcggggtggaccccgagcgaccgggttcgcgaagccgctggcccacggtcgccagctcgaacggcagcgtgaccccgaccggctcacccgcgacgtcgcggacgggtacatcggtcaagccgacggccgcggacacgaacgccgctcgcccgtggggcacgaaacacacgtcctgcgaatcgcgcttgtcccacaccggcaatccggccgcgtgggcacgggtgcgcacctcgtccttggagagctcgccgagcggcagccagagacgcgcgagcacctccgggggcacgtccgccaacacgtacgactgatccttacgccgatcccgcccccgaacgagcatcggccgcgacccatcgaggaccgtcgcatagtgaccggtcaccaagcgggaggcgccgagtcgctgtgcccaagccgcgagggcggtgaccttgacgtagcggttgcacgacatgcatggattcggtgtccagcctcgccgatgggcgtcgagatagggttcgaccacggcgcggtggaactccgctcgcatgtcggccacgatgtggttgatgccgagcagggctgccacggtgcgcgcgtcctcgacgtccccaaccgagcagcagccgcggtcacctgcggcttccgtcaggcgcaaggtgacgccgatcacgtcgtgaccagcctcacgcgccatgagcgccgcaaccgaggagtcgacgcccccggacatcgcgaccacgacacgcgccaccgaccctcccctcgacgtgccccacgctagtggcgtgcctgccgcgacgatcgaccgagcgcgcgcgagaggagccccgggacgtcggtgatgatggcgtcgacaccaaggctgtcaaggaacgtcgcctcggcgacatcgttgatcgtccacacccacacctcgcaaccgagcgcgtgcgcgtcccgaacgcgccgctcggtgagcagtggaacgccacgatacgaacgcggtaccgacaacacgcgccaggggggtcgacgctggcgcgaaccagcgatccaggctgccacctcactgggggcagcggtggtccgcacgccgggccagcgcgacctcacccgctccagaaccccccgatgaaagctggcgaccacgcagcgctcgagggcccccgcatccgtgagcgtcgcgatgacgcgtgcctcgaggtcgcccgagggcccatcgtcgtccttgatgtcgatggaacacgcgaggccctcggtcaccgccagcacctcctcgagtcgagcgagcgatgcctcgtgggtgccgcacgggagccgaatcgtcgcgagttgctcccaggtcgccgatgcgatggagagcgccacaccagcggtccgatccagcgtcgggtcgtgatggaccaccagcaccccatcggcactcttgcgcacgtcgagctcgaccccagtagcaccgcgcgccgctgcactcgcaaaggattcgcgggtcgactcgcacgcctctcccatgcccccgcgatgcgccacgatgagcggcgtgctgcgcccgtccacgcccgcggatcctaacgactaggctcgacgccaaggcatgctccaccacgttctcttcgacctcatcggatccctgcgcgcaagcctcaaagacgccatgcttgagggcggcggactcgacgagcagcttcacgtcgacatcctgctgggggacacaacctacgaaacgtcggcaagcctcccgggtgaggaagcgccgccacgtgtgcgcgcggacatctcgctggagtggtcgacctgggctcagagtgcctatcgatcctggacgctcggtgagggactcgacgaacccatcgacgttgtcctcgaggtcgcgcttcgcgtgtcgggccttcggggccccgccatgagcgccgcggcgttccggtcatcgctgccatcgcagtcgcctccgctcgtcaatcacgaggtgctcgagctgcgaaccgtctcggccgaaaccaccatcgaccccgacgaggatctcgaggaactcagcctcgaggcggtctacgacgtgaccttgtccctcgacgagaacgagctcgagcaccccgactcgctccacgaggccctgcggcgactctcgggctggatcgcgagcgcactcgtcgcagcgagtgacctcacggcacgacaccgcgcaccctgagatcgcgttgcgcgagtcgacgtgccatcccgtaggctgaccacagagacgagggggtgccgtgaagccaatcccggttgagttccacctggggccgcttgtgctccacacgtacggattcggcctcggcgtcaccttctggttcgcctactggtacctcggcaagcgcttccgccggttcggtctctcgagcacctggctcgagcgtggtttcatccctatcatcgtgatggccatcgtcggtgcccgcgtcgtgcacgttgtcgcgaacatcgaggcctatctccacaacccaatcggggtgttcgaggtgtggcaaggcggtctgtcgtcgtacgggggcctcgcaggcggcattccgaccgcgttgtggtatctccaccgcgacatgccgaacctccgtttccgccgggccttcgacatcgcagcaccggtcctgctcgcctcgtggtccatgggacgccttctcggtcctcagctgatgtacgccggcggtggcctgccgacgaaggcgtggtacggcatgtactacaccggcgagatcggcaagcgcattccggtgccgatctttcagtcgatcgaggacttcacctgcttcctcctcacgctctggatcgcacgccactttgcccgctggcgcatgccggcaggctccgtcgcggtcgccgccctcggattgtggtcgatcgagcggttcttcgacgagttcctgtggctcgcccgtccgcgggtctgggatgccgtcgaggtcttcgcgctcatctgtctcgccttctgcgccgccacgctcgccgtgctgacgtcacggcgaggccgtacgaccgaggtggtcgacctcccgaagctcgtggccacaggaccaaccgcgtgagctcgaccgcgctgctcaccgaccgttacgagctcaccatgctcgagactgcgatcgcgagcggccttgcagaggttccggccaccttcgaggtcttcgcacgctcgctcggcggtcgtggcttcggtgtggtcggtggcaccggccggctcgccgaggcgcttcgagcctttcgcttcgacgacgagatcgtgcgttggctcgtcgacgagcgcgtcatcgggtcaccgaccgctcgctacctcgagcactttcgcttcagcggctccatcgccgcctaccccgacggagagctctacttccctggttcgccgatcctacgggtcgacgcgccgttcggcgaaggcctgctcatcgagacgctcatcctgtcgattctcaacttcgacacggcggtcgcgacagctgcagctcggttacggctcgcggcgggcacggccacactcatcgagatgggctctcgacgcgtccacgagcgcgctgcggttgccgcagcacgtgcagcatggatcgcaggcttcgactccacctccaacctcgccgcgggtcaacgctacggcgttcccaccggtggcacgatggggcatgcgttggtgcttgcccatccgagcgagcgggccgcgttcgaggctcaggccgccgtgatcggatcctcgaccaccgccctcgtcgatacctacgacatcgggcacggtattcgccaggcgatcgaggcgttcggcaccgatctcgcggcgatccgcatcgactccggcaacccattcgtcgaggtacggcgtgctcgtacgctgctcgacgagctcggagccacgaagacgcgcatcctgatctccggggacctcgacgaggggctcgtcaggcgcctggtcgctgagccggtcgatggattcggcgtcgggaccaaggtcgtcaccgggggtggggtgcccacggcacaactcgtctacaagctcgtcgccgtcgaacgcaacggcgttgcggagcccgtcgccaagctctcggcgaacaaggagacgtctggaggccgcaaggctgggtaccgacgcctccgcaaccatcgcatcgtcgaggagttctcgatcgacccagccgtgaccgtcgagccgaccgacgactcgaccctgatggccctcgaggtccccgtcatggtcgagggagacatcctcgatccggagtctgcggcccagagtcgtcagaggctcgccgaccgtctcccgaccctcggcgaggacctcgacgcgatcctcgatgcaacggagcccctgttcgtctgccaccacctcggtccgtcgctgccacgttccgggcacggccagcacgaccagtagcgtgtcgagatggacaccacgtcgctcacgcgagcccatccgagcagcctcggcttcgacgcgcacgtgctcgagcgccttcggcgaaccctcgacacctggatcgaaacccaacgcctcgctggcctcgcggtcgccatcactcgcgacggtgaggtcgccttcgagcactacaccggatgggccgatcgagcgcgcaacgtcccggtcacgccgcagacgctctttcggatctactcgatgaccaaacccatcacctcgatcgcggcgctccagctggtcgaggagggacggatccgcctcgacgatccgatcgcaacggtcttgcccgccttcgccgaaccacgcgtactcgtctctggcggtgcgccagggggctacgcgccagcggtgacgcgcggggcgatcgaacccattcggctctggcatctgctcacccacaccgccggtctcacctacgacttccatcgccagagcgcggtggacgcgatgtaccgcaagctccagcgcaccctcgacggcgccgaccttggagcctgggtcgacgcacacgccgagctcccgctcctgttcgacccgggcacgcactggaactactccatcgccaccgacgtcgtcggccacctggtcgcgacgctgcgaggcgcaccgctcgccgacgtcctcacaaccttcgtcctctcgcctctcggcatgcacgacacgacgttcgaggttccggcctcagaggccgatcgcatcgccgcgatcgtcacccctggtggcgacgggacgctccatcgcctcgggcccgtgcagccggagacccgcgtggcgccgatcgactccggtggcggcgggttgttctcgaccctcgaggactacacacgcttcagcatcgcactcgccctcggtggccgcctcggggacgcacgcctggtcggaccgctcacactcgatgcgatgcgatccaaccaccttcccggaggttcggacatccccaccatggcgatcgccaggccacaacccggcgaccgcccagggaccggcttcggccttggcttctcggtcgtcgatgatccgattgcctcacaccgactcggtccgcgaggttcctacggttggggcggcatggcctcgacgaccttcttcgtgtggccggctcaacgcgtgagtgtcgtgttcatgacacagcttgtgccgtcgaacacgtacccgctcgccgaggaactcgagacgttcgtcgcagcagcgctcacgcggccctgagtcgcacgcccgagccgggctcgcgtgtggcgacccgacgagcctcgcggactcaggcctgtcgggcctcagccgcctgcgcctccgcgatctgacgacgcacgtcgtccatgtcgagggcaaggacctgcgagatcaggtcgtcgagcgcctccttcgggagcgctccaggctgggagtacagcaagatctgctcgcggaagatcatcagcgtcgggatcgacatgatcccgaacgccgctgcgagctgctgctcggcttcggtgtcgactttgccgaagacgatctccggatggacctcggacgcctgctcgtagatgggcgcaaacatcctgcagggaccacaccacgccgcccagaaatcgacgaagacgatgtcgttctcctgaatcgtcgcctcgaagtcgctgagcgtcagattgcgggtcgccatgatacctcttcctctcgatgagttcgctctggcctaacgccaatacccataagggtattccgtgtgcccggagcgggagtcgaacccgcacggccagcggcccggagggtttaagccccctgcgtctaccgtttcgccatccgggccttgtctcgacaccacgaccaggctagccctcggcgccgctcacgcctccacgtcggtgagcagctcggcgagcgacgggtcgagcgcgaccacggcagcagccgtccacaccccaaccggcgagaacccccctgccagccacagtgcaaggtgagcatgcaggcacttcacgccagcgcgcgcaccagcgatccgtggatgcgggacgtggcgtcgggcagaggcatgggcgtgttgggccaactcgagtgcgcgagggtcgacgagctcctcggccctacgaacccctcgtcgagcctcgactcgagcaaccgcctgcacgagtcggcgatcgacaagccaaaaccagttcgattgaggacggccctgccggtcgtattcggccagttcgatgacgatgggccaaccctcgcgagagcgtgcggcaacggtgtagggaatgctgggcaggcgaccaagctggtcggacacccacgcctcgtcctcctcacgcaccacggccacggcgtcctcgccggcgcagcagaatcgcgacgaccaccgccacagcgatcacgggagcgagcgcccggcgagcgagcggacgccagcccacaccgagcacgtcgagcggcgggttgtcggcaggcgttcgaacggcaggcgccgtcgtcgcatcggacacgggctctgcctcggtcgatgcggagtcggtggcctcacccgcctcgtcgctcgccgacgacgcttcgctcccgacctcgccgggaggcgtctgcaagaggtcggcgagccgatcggcgaactcacgcatgagctcggcagacacatccgcaaggactccacgaccgaactgtgcgacgcggccagcgatctgcagatcgaccacgacgtccacgtgcgttccctcgccgtgcggtgtcagcgtcgccgtcaccgtcgccgatgcccgtccttgtccccgctgctctcgaccctcggcgcgaaggacggcaacgccgtgctcctcgtcgagcgagacgaacgacgcctcacccttgtacgaagcggtgatcggtccgaccttgaccttcaccgtgccaaggaagcgatctgcgtcgcgcccggtcaacgccgcacccggcaggcacggagcgatgcgttcgagatcggtcaagacgctccaagcgaccgccggactcgccggcacgtcgaacgcgtttcggatctccaccgctatcctccctctccctcatcagctcgttcctcggcgcgcgagagatcgtgcctcgtatcgacgtccatcgggtcaccttgacacgagaccgacaccaccgtcaggtcccttcgggcgaagagtgctctcgctccgacgtctcctgagactgggagtgcaccgaagaggcgcctcgcgatgcgcacgggattcgctcgcgacccagcatacgtcgccaccgcgagatcgacctcctcgggagccgcggccacggcgtcccacgcctgcgccgtgatgaacggctgatctgcgagcccgacgaccatgccactcgccccgtctgcctcggcccacgccgccgcgagcgcaagcgaactcgcaaggccgcgctcgggatggggattcacgatcacctcgaaaccggtcggcacgagatcgtcgaagcgatcccgaccgaccacgaccgcgcgcgcggccagcagacgtgcgtcggcacacgcgctgagcgcccatgtcaacaaggcgcgaccaccgagaggagtccgcagcttcgcacccggtggatcgaatctggtcgctcgacctgccgcgaggaccgctccgacccacctcaccatgtgaacgcaccagcggcgtgaatgtcgccgtccgtcgccgagagaggcgtaccgctcctgccctctcgacgagcgatgatctcggcaacgatcgcgatcgccgtctcctccggcgtcctcgcgccgaggtcgagcccgatcggcgccgccactctcgcatcgacctcgtcgagatcgacgcccgcctcccgcagacgctcacgacgatcgcgctgggtccgacgcgagcccatcacaccgatatagccagcccgcgtggcaagggcagcctggatggcgggcacgtcgaacttcgggtcatgcgtcagcacgcagatcgcatcgcgcgcctggatctcgtcgcgatgcgcctccaaccacgcgtgaggccatgcgaccacgacctcatcggccatggggaagcgctctctcgtcgcaaagagcgcacgcgcatcgacgacgagcacgcgatagccgagcaatctggcggttcgggcaagcgcatcggcaaagtccaccgcgccgagtaccaccatggtggggggcggcgcctcaacggccaagaccaccgagacctcgcgcgagcgcgtctcgccgagtcgaccgagctcgcggcgcgtacccctcgctgcgtcgatggcccctgccgcctctctcgcgacgacccgatccaacgactcgttgccgaggctaccgaagcgtcgaccatcgccgaggaccgccaacgtcgcgccgaccttgggcatcgcgacgcccacgtggtcggcggcgaagtagtcatcgactgacgagtccacctgccacacgaacgcgaggctcgccgcgacaccgtggccgatggcgtcgacgacctcgtccaagaagtctggcggatcaggatcgacgagaatgtggaacgtaccgccacaggtcagaccgacggcgatggcctcgtcgtccgagtagccaaaggcgagcgtggccgccccccgctccacggagcccgtgatgccgatcgacgcaaggaccgcttcgggggcatcgagccgcgcgagcgcctcggcaacgacggccccctcgacgcacccacccgacaccgacccgacgacctcagctcgctcggagaccgccatcatggtgcccggttcccgcggtcctgatccttcgaccgcgacgacggtggcgagcgccgcgcgcacgccagcccttcgccacgcgacgaccgcctcgagtgcctcacgcacggcccgcctcctccacgatcctcaccgctgcccgctcgagcgacgcaacgctctcacccgcgaccaaggcatccacgtactcgagtgctgccgccatcccgcgcgcgaggggcgcgtagccatccaggccagccagcggattcacccacacgatcgcggcgctgcgccgacggagcgaggccatcgctcggcgcatctgctcgggatcgccccggtcccaaccatcagagcacaccaccacgaccgctgagcgcaagctgcgccgcacgccatggacgaaggcttcgatccctgcaccgaggcgtgtcccgccaccccagtcagcgaccagcgcgaccgcttcctccacggcgacgtcaggatcccgcccaccgagcgctcgactgatgcgggtggcacgggtcccgagcgcccacgcctcgaccttggcgacagcggcgaacacccacgcgagacggagcatggccacggcgtagggctgcatcgagccggaaacgtccagtagaaagaccacgggacgcggaaccgtcgtggctgctcgataccgacgctcgatgggttcgaggtcagtcgcgaaggcagcgcgcatggtcgcccgcgcatcgagctgtccgcgaggtgcggaacggcggcgcgcgctccgtcgcatcggaggggcaagacgaagcgccgcgagcgcctccatcgcctcggcgcgctcggtggcgtcgagcgtgccgaggtcggccgagtgcaggcgctcgaccgccgagtagcgaacgacacgctccgcgcgacgctcggtctcgttctcgccggcaccgtcgtcgccgtcgtcgagggccaccatggtcggcagcacgaccttcgacgcgttcggtgcgacgatcccgagataggaggccgctagctcgaggtaacgagggacgtcgtcagcacgcttgacgaacgtggcgagtccggtctcgagtaccactcgccgacttccaacgcccacgacgtccaaggcttgctcgaaatcgatcgtactcgaggtcgaaacgcgcaatccgccgctgcggaggtgatcgacgaacccgacgacgaagcgttcagctcgacccaccatcgccgtccaccacgccagcacgctcgcgaatcgtccgcacgccgatcgcctcgatgcgctcgagatcttctcgtcccttgacgacgagtccgagcgtggcatcgacgagctcatcgtcgaggtcgtcgatgccgaggcgcacgagcgcctccgcccaatcgatcgtctcggagattccgggaggcttgaacaggccctctcgccgaagtgccgcgacgacacgggcgatctccgtggcaagccgagcgctcacatccgggacgtgtcgacgcacgatctcggcctccaacgacggaccgggggcgtcaacccagaggtagaggcagcgcctcgccagggcctcgtggagttcacgcgtccgattcgacgtgagcacgacgatcgggatcacctgggccccacgagcgccgagctccggaatggtcacggtccaggtggagagcacttcgagcaggtaggcctcgaacgcctcgtctgcacggtcgacctcatcgagcagcagcaccggtggacgggcaggatcctcgccgccgagtgcccggagtaccgctcgctcgacgaggaaccgaggtgagaacagctccgcctcgatgtcatcgacctcgcgaccgcgcagagcatctcgcgcgagcgcctcgagcgtgcgcacgtgcaagaactggcgtccccagtcccagtcgtagacggcctgatggacgtcgattccctcgtagcactgcagccgctccagcgacccgccgaagacgcgcgcgagcgcataggcaagctcggtcttgccgacaccgggctccccctccaagagcagcggtcgctgcagcgagaccgcgaggaacccagacagcgccacccgtggcgaggccaggtagccaacggcgtcgagtgcacgacgcagatcctctggtcgttcgatgccgtgcgctcgaagcggctccggagacctaggcaagctcacgcagtgctcgtgccaccaggacctcggcaaggtgacggcggtagtcggcagacgcgttgacgtcgctcggcggttcgagcccctcggcggcacgtcgggctgcctcgtcgacgccagcaccgctcgcgagcgcctcctcgacgcccatcgcacgtactggcgtcggtgccatgttgacgaacgcaacccgcgtgctcccgttgcgcaccgcgacgactcccacgatcgcccagtcctgcgcccgacggttgagcttctggaacgagtagtcccgcaccgccggcacgcggatctcggtgaggacctcgtcaggcgcgagtgccgtctcgaggaagccccgaaagaaagtgctcgccgggatgcgccgctcgcccccgccgccgcgtgccaccatcgtcgcctcgagcgcgagcagcgcagcaggcagatcggcagcaccgtcaccgtgagcgacggagccaccgatcgtcccgcgatggcgtacggacggatcgccaatctggcccgccaccgcagcgagaaccggcacccgacgccgaagcacctcagaggtcgcgaggtcatgatgacgagtcagggccccgatcgcgacctcgtctccatcgtcgcgcacgtacgagaggtccgggaggtggccgatgtccacgagcaacgacggtgaggccagacgcagcttcatgagtggcagcagcgagtgaccgccagcgaggaacttggcgtcgtcgtgctcgccgaccaaggcgatcgccgcgtcgatcgactgcgctcggtggtagtcaaagggcgctggaaacatgcatcctccctgtcaggcccgatgggccgttgcatcggcgatcaggcgccagactcgttcgggggtggccggcatgggcacatcgcgcacgccgagcggagccaaggcatcgaccacggcattgatcaccgcaggtgcggacccgatcgttccggcttcgcccacacccttgacgccgagcggattggtcggcgacggcgtcacggtcgatcccatggtgaagctcggtacctcggcggctgacggcaccaggtagtcggccagcgacgcggtcacgagcgtgccagcctcgtcgtacaccgcctcctcccagagtgcctgcgcgacaccttgcacgatgcccccgtgcagctggccctcgacgatcattgggttcacctggttcccgcagtcgtcgaccgcgatgtaggagacgagatcgacccgacctgtctcttcgtcgacctcgaccacggcgatgtgggtgccgaacggaaacgtaaagttcggcggatcccacgtgacctgggcctcgaggttcggctccgtgccgtccggcaggttgtgggcggtgaaggcctcgaacgcgatggcgccgagaggaagctccttggtgggcgaacccttgacacggaaggtcccctgggcaaattcgagatcttcctcggctgcctcgagctggtgagccgcaatgcgcttggccttctcgagcacgcgttccgtggcgaggtagaccgcggtaccgccgaccgagagcgaccggctcccgtaggtgtccatgccgagtggcgcgatcgccgtgtcggagtgcaagacatcgacgtcggcgacgtcgatgccgagtcgatccgcgacgatctgggaccaactggtttcgtgaccctgtccgtgcggcgccgtgccggtgaccacctgcaccttgccggtcgggagaatgcgcacagtggcagcctcccagccgcccgcgccgtagctcaacgacgccaacacccgcgacggcgcaaggccgcacatctccacgtagcacgacacgccgatcccgaggagccgtcgctcgccagcggcacgccgtcgcgtctgctcgagacgcagctcgtcgtagcgagccagtgccagcgccttggcgaggttgtcgtggtagttacccgagtcgaacacgaggccaggtgccgagctgtaggggaactgctcggccttgatgaagttccgtcgacgcagctcggccgggtcgaggtcgagttcgcgcgcgagcgcgtccatggcacgctcgatggcataggtcgcctccggccggcccgccccacggtaggcatccgtcggcgtcttgttcgtgaacagtccggtgcactcgaatgagtaggcaggaacgtcgtagaccccgtgatagaggaaggcaccgagcaggggaacccccggggtgacgagctggaggtaggcccccatgtcggcgaggagacgcacccgtatcgccgtcacccgtccctcggccgtcgctgccagctcgatgtactgaacctgtccacgaccctgaatcgtcgctaccgtgttctcgccgcgctcctcggtccacctcaccggcacgccgagacgtcgagcgaggacgaaacacaccagctcttcggagtagacgtcgagcttcgagccgaaacccccaccgacggcgggggcaaccactcggacgtggtgctccggcacgcccatcgtgagcgccaacatcagcttgaggatgtgggggatctgcgtcgcggagtacaccgtgaacgagccgtcgaccggcgacggcacgacgaccacgcctcgcggctccatggctgacggaatgagccgctgctgcacgtagcgctcgctcacggtgaccgccgcctcgcgaaacgcgcgctcgaccgcctcctcgtccggcttcaacgaccagacgaagctcacgttcgacgcgaggtcctcgtgcgctcgtggtccgcccgctgcggccgcctcaagatcgaggaccggatcgagctcggcgaagtcgagctcgacggccgctgccgcatcgacggcctgttggcgtgtctcggcgacgaccaccgcgaccggttcgccctggtagtgcacggcgtcgatcgccaggggatagtgggcaggattgaccatgtccggcgtgaccggccatgcacacggcatgggcgcggcccactcggatgccaggtctgccccggtcaggaccgcacgcacgccaggcatcgcggccgcttccgtggtcgacaccgacgtgatccgaccatgggcaatcggcgagcgcacgagcaccgcccagagcgcacccggaacgacgaggtcatcggtgaaccgcgcctggccggtcaggaggcggggatcctccttgcgaagaacccgctgcccgatcaccccgcccgttgcctgcggctccatcgtcgtggtcatgcctggacccccatgcgctcgtgcgcggcgagaaccgcgcgaacgatgttgtggtaacccgtgcaccgacacaggttgccctcgagcccgagtcgcaccgttgcctcgtcgagcaccgggttctcacggatcagcgacagcgacgccatcaccatcccgggcgtgcagtagccgcactgaagtgcgtgatgctccatgaaggctgcctgaaccggatgaagcgctccgtcgggcccggcaagaccctcaatcgtggtcacctcctcaccggcaacctgcgcggcaaggacggtacaactcttcaccgactcgccgttcaccaagaccgtgcacgcaccgcacgacgaggtgtcgcagccgatattggtcccagtcaggcccagcgcatcgcgcaggaacgaaacgagcagggttcgaggctcgacgtcagcgtgtcgcctttggccgttcacggtcatctcgatcagcatgcggggcctcccttggccttcgatcagatcgtcggagtcgggccccgacgggggcaccgagcggaccttaccacacgccacccagctcgtcacggatctctcctccgcgagccccggctcatgaccgtcagaacgccgacttcggtccccgaggtctcgcttcgccgtggcggaccgcgagtgaccccttgctcttgccgccgagttgtcaatgtgccgtagggctacactggaagccgaggaggcaccatgctcttcgtcatgatcgcgttcgtcgcagcggccgccctcatcgccgtggcgatccactttggtccgcatggctccgtcgtctccggtgtgatcgggctcgtcctcggtctcgtcatcgcctggtccgcgcaggcagcgatcagcacggtcggcgcctgggccctcggtgctggtgtcgtcgtcgtcggccttgcgctcgccggcattggcctacgaggggttcgaggcctcaacactcgcgctgcgatcgccgcaccgtcaccgcttgcacgcctacttggtgaggaagccgtcgtcgaacgcgatctgagtcccatcggcgccattcacgtccatggcgagtcctggaccgcgaccaccgagacgggcgagtccgtcccggcgggtacacacgtcttcatcacgcgagtcgacgggctgcgcgtctgggttgttccggctgccaggccggaagatcgccaacggcactccgcctagaaggagggatcccatggccccgctcatcgttctcggcatcatcgtccttgcggcgctcatcctcatcgcacgaggtgtgcgcatcgtcagggagtatcagcgcgtcgtcgtgttcaggcttggtcgcgcaatcggcgccaagggtccaggactcaccctgatcaaccccgtgatcgaccgtctgagcctcgtcgacctgcgcgagcaatacctggagatcccgcatcagacggcgatcacaaaggacaacgcccccatctcgatcgacttcatcatgttctacaaggtgatcgacccggtcacgagcgtcgtcgccgtgcgcgatttctcgggcgctgcgctgaacgtcgccgcgacgacgcttcgcagcatcgtcggtgacatgtcgctcgatgacgtgctctcgcgtcgcgaggacatgaacgccacgctgcgagtcaagctcgacgaggtcaccgagcgctggggcgtcaaggtctcgaacgtcgaggtacgagagatcaacccaccgccagccgtccaagaggcgatgacgcgccagatgtcggcagaacgaagccgtcgagcgctcgtgaccgagtccgagggtcagcgccaagccgccgtgacggtcgcagagggcgagaagcaggcggcgatcttggcggcagaaggtcagaagcaggcggcgatcttggcggccgaggcagaacgccaagcggccaaactccgtgcccaaggcctcgccgatgcgctcagtgccatcatgcctgaagcacgcaacgccgactcgcgcaccatcatgctccagtacctggacgcactacgcgagcttgcgcgctcgggagccaccacgtacgtcattccagctgagttgaccgggttcctcggacagctcgcgggtgccctcagcgccagtccaaccgaaccctccacgaacggcgtcacaggtcattgacggcggagcgccactcgtagacacagacgggccctccgtcggtgcatcccttcgaacgacggctgaacgcgctcgctgccgaggtcgtcacgctccctgacctcagctggcggctcgttggcgcctcgatgctggccaggacaccccggtgctgagcctggccggtaccacgatgtgcgcttgtgatcgtggcgccatgacgcactgggcgctcgtgcccggcagcgatcggtaccgcgaccacttgcgaccatgtggcgccgctcagctcccgtgtgaagacgggaagctgaacggcgctctcacgcatttgtcgactaaggcccaaggtaggaccagcccaccgcgtcccgccaaccggccgaaggcacgaccccgccggcaatcctggcgcgagcgaggccgtacccactatgacggtggacttcgtcacgcgccgtccaaggcactacctcatgtcccggcgtcgcagacgccactcggtgcggagggcgcgccatcgaagcacacgacccgagacacgtcgttccgcgatcgtcgacaccggctcggcggtcctcacccgccccaaccgagctctctcgtatcgacaccaaacgcccctgccaggccaaccctggcaggggcgcgcgcatgtgaggccgcgccaggcaacgtcagcgccgtgcttcggctccctgccgacgtcgtgtcagcgaatcgacggtcacggccgcaagcaagaccagcgccgtcacgatgtactcggctgccgcactgacgcccaacaatccgaggccgttgtagatggccgcgatgatgatgccaccaagcacggcgtgcaccatcttgccgcgcccgccgaacaggctcgtgccgccgatcactgctgccgcgaccccatagagcacgagcgtgccgccgtcgatgttctccgagatcgatccgaggcgcgaggcgtagacgacccccgcgatacccgcagtcaagcccgagagcgcgaaggccgcgatccgaacccgcgagagattgatgccggcgcgacgagcggcctcggcgttgccaccgatggcgtagatgtaacggccgaaccgggtccgattcaggacgaatgtgtagagaccaagcacccccacgagaatggggacgacgaacggtacgccctcgagcgtgacggtcaccccgcggttggtgttcgccacgatcagcaacacgaccgcagccacggcaccgagcgcaatacgcagcgcaatgacaccccgcggaggcgccgagagcccagcccgccgcatccgctcggcaccgaagaacatccacgcaccccagagcgcgaccaccaccgctgcgatgacccaccctgcgaccaccgagagattgccgttgacaatatcgttgaggatgttcgacgagatcgagatcacaccgccggccgcgggcgccgcgtggtcgatcatgtagagcatgaccccttcccaccccagcagaccagccagggtgacgacgaaggacggcaagttgagcttcgtgatgaggattccctgcaccacgccgatgagggtggagaccgcaaggccagcgagtagcgcgacccaccacggctccttggcgatgatcggcgaagccaggatcgccatgacggaggccccaacaccggccacgtacccaaccgacagatcgatctcgccgagcagcaagacgaacacttcagccatgccgagcaggacgaacgtcgcgccttgcaccagcaagttgacgagattgccggcggagagaaacaaggagttctccgcctggaagatgatcacgatgacgacgaggccggccaacaccggcaacatgccgctctcacccgaacgcacgcgccgccaccagctggagatccagcttcgggtgtccgtgagcacgatctcggcaccctgggcaggtgcgctcgccggtgccgccgccggcgcatgtccattcgacgaaggggcctcctcgacatcaacggggagttgctctcgttccaccatcagactgaggcctccttcgcaccacgcggggcacccgactccagcgattgacccgtcatcagttcgacgacgcgaccaggctcgaactcggctcgatctccctgggcgaccatccgcccgagatgcaaaatggcaatccgatcggccgttgagaagacgtcttgcaggttgtgggagatcaggatgaccgacatgccgctcgcggcgaggtcacgaatgatgcccagcacgacccgcgtctggctcacgccgagagccgcggtcggctcgtcgaagagcaccacgcgcgagttccacagcacggcgcgcgccaccgcgaccgcttggcgctgacctcccgacagcgagcccaccggctggcgaatcgaacgaaccgtcacgaccgacagacccgcgagggtcgagcgcaccttctgctccatcgtcgcctcgtccaagatcccacgacgacgcggctcgcgcccgaggaacatgttctgaacgatgtccagattgtcgcagagggcgagatcctggtacacggtggtgatgcccaaacgctccgcgtcccgtggatcatgaatgtcgacccgctggccatcgatcaggatctctccaccgtcgatccgatggataccagagatcaccttgatgagggtgctcttgcctgccccgttgtcgccgacgagcgcggtgaccttgccggggacgacggtcaagtcgacgtgttcgagcgccttcaccgcaccgaagttcttctcgacgccccgcagctcgaggagagcgccggacactgcctgggtcattggacctcccatcaggctcgtgacgaaggcggggtgcgcagacgactgtccgcgcaccccgctcgtgagagacgctaggccttgatgcccgcggccgcgcacgccgaggcataggtgcccgagcacagctgcgacgccggcacgaagttgtcagcgatcacggtcgacgccatgttcttggtggtgacccactcgggcgtcagcaacaccgacgggatgttgttgcccgagaccggatcatgggtggtgccgttcaagagagctgccggaggcgtcttaccagcgcgcaggtagagcgcgagggagacggccgcctgggcctcctgatagatgggcttgtacacggtcccgcactggtaaccagccaggatgttctgcaatccttggagcgtcgcgtcctgtccggtgaatgggatcgtcttcggcgcgatgtggagcgactgcaggtacgagatgatcggcgcagcattctcatcgttcggcgtcaccacggcgttgatgttgggatgcgccgtgtacatctgctggaactccgtcaacgctaccgacggcgtccacgtccctggaggcgtcccgaccaaggtccacttgcccgacttgaagtacggatcgatcaccgaatcgtacccctcggcaaagagggtggcgttgttgtcggtcggtgcgccacgcatgaccagcacgttcggatgcgtcacgtgccacgcggcgacgcaggcgacgaatccctggccaatcagctgtccgacgcggacgttgttgaagctgacgtaataatcgctcggcgaggagcccagcgtgagacggtcatagttgatgacgcgaacaccgtgctgagcggcgtacttctcgatctcgacaccgacgcccgagtcgagcggatcgaagatgatgacgctcgccccacggctgatcgcgctctgggccatcgacagctcggtcgcgtcggagccctgggcgttctcgacgatgtactggttggacttcaggccagccaactggaaggccttcgtgaggaacggcgcatcgaactcggtgtagcgagccgaggacaccgtatcgggcaagatggcagccacgagacccttgcccttggccgccagcgagctcaggctgctcatggcggtgaagttccggttgaacgaggccgctgtcaccaccggcgtggacgcactcgtggaacccgaggatccaccgctcgagctcgaactggtcgagccacaggccgcgatcgccatcgcggccccagcgaccacgagcgacgctcgcgagaacgacgacattcgcacagacaacccccttgtcgtggcggggacggttccccgcgcctctgcgatggtacgcaggcgtgtgtaaacgaggggtaaacacttgggtcgggacgtgaaaaatctgtaaacggccttacgccgcgtcccgcaccagccgatagccagcacgcggttgcgtgaggatcaacggtgcgtccccgggcgcctcgagcttggccctgaggcgccggatgtagacgcgaaggtactcagtctcggtctcgtaaccgcgaccccacaccgcacgcaacaacgccgcgtgcgacagcagccgaccgtcgccacggatgagttcggcgagcaacgcaaactcggttggcgtcaggtgcactggcacaccatctcgctcgacgagctgacgttcgagatcgaccacgagacccgggcgtaagacgatcgtgcccttgtcggactggctcgccgcgggtcgcgttcgccggagcgtcgccgtgatcctcgccatcagctcttcgatgccgaagggtttggtgaggtaatcgtcagcgcccgcgttcagtgccgtcaccttgtcctgctcgccacgccgtgctgacaccacgatgagtcccgcggaggtgcgctcgcgaatctcgtagcacagctcgaagctctcgacgccggggatcatgaggtcgagcaggatgatctccggccgccgtgcttcgagcgcagccaacgcttccgaccggtcggaagcggccgcgacctgatagccgcgcacgagaagattcgcacggatcaggtccacgatgttcggatcgtcctcgaccaccaggaccgacgtcatgagcgctccatcccgaggacggcgtcagccgctgcctcatcggcctctgggagctggacctcgaatcgcttgccgacgtctcgcggcacgagccgcaggacgccgccgtgggcggcaacgatgctcgatgagatcgcgaggccgaggccattgccagtgccttcgcgatgacgctgcgcgagctcctcgacgctcaccccggccgggagcggcgccccgtcatcctcgaccgcgatgaccaccccgccatcgtcgtcgcgtcgtgccgtcacacgcacgtgcgttccaggcggattgtgagacgcggcgttgtgaagcaggttcacgagcacctgctcgatacggtcgtggtcgacgaagacgggcgggacgtcgtcgaggtcgacgtccaccaccacctccggtacgcaggcaacggccgcctcgacgatgtaggcaacctccgcccagtctcgccgcaccctgagggtgcccgactcgatcgcggagaggtcgaggagatcaccgacgagacgggccagacgctgtgactcggcgacgatgcgttgcaagaatcggcgctcggactccgtgtcccaacgcacgtcttcggcaagcaggctggaagcgtaccccgtgatcgccgtcaggggcgtgcgcaactcgtgactgagccgctgcacgaaggcaacttgcagtgcctgcgatcgccgcaaggccgccgcctcgcgttcggcctgctccacgcgccggcgctccagggcgagccggacggaactcgcagccgcagataggagctctgcagcctcatcgggcggggcgtcgtccccaagcgtggcgaggagcgcagtcgactcggcgccgtcgagttcgatcacgcgcgcaagggtccccggcactcggtccagccgcgcctcgatcaacgccgcgccctcgacgagttcgagttcgaccgccccgagaccatccttcagcacggacagcgccgcgtccagcgccggttcgacacgcgcaccccccgccagcacctcgaggaagcgttgaagcacctcgagcacgtggttgcgctgctcaagggcgtggagcacgcgttcgcgctccaccgtcgtggcgatggtcgcggcatagagcgaggcgagctgtgcccgagtgcgatcgtgctcgagcggacgcccgacgatgacggccagtaccccgatcgctccgcgcggtccgagcatcggaacggcccagagcgagcgacgttctccgtcgagctcgagctctccgtcgcgagctgctccgacggtcagcgcctcggcgatcgggccatcagcgtcgacgatcgcctgctcgagtcgcgtctgcgcgagcggatcgaggccgtgagcgctcacgacacggagggcccccatcgactcgccgaggagcgccgcgaccggtacagcgccgagggcgacggaacacgctgccgtgatcgccgtgacgccggtaccctcgtcgatggcggccacctgctcgacgaggctcgcaaagcgagccagctgacgtcgtgaactctcctgggaggacccggcgacgatgagctccccgagttcttccggccccaccgtgccgccgtcgaccgtcgcgacgaccttgccatggtgcagcacgacgacacgatccgacgcactcgcgacgaggccgagatcatgcgacaccagcaagactccgacaccacgctcccgaatgcgcgcaacgagcgccatcacggccgcggcctcgagcgcaccgagcgaggccgtcggctcgtcgagaaggagatagtccggctccctcgcgacctggcgcgcaatggcgacgagccgccgctgtccaccggagagcgttcgcaggggtcgcgagagatcgtcgatggcgaggccgactctcgcaaggacctcgtgggcggctgcgtgcgtccgacgaggcgacaccaggcgacgaccttcgcgaccgagaacgaggttttcggcgatgctcaggctctcgacgagctcgacgtcttgccagaccacggcgacgtcacgatcacgaggctgaatcgaccctgcctggatcgccagctccccagcgatggccttgacgagcgtggtcttgcctgccccgttgtcgccgacgaggccgacgagctccccagggtggatcacgagcgagacgtcgtcgagcaccacgacggagccgtaacccacgcgcagaccacgcaggtccaatgctcgagcatcaccgtccaacgcggccgccaccaccggctcgagtttaggtgtcatcagcgcgtccgagagacttcgtaggctggtgccgtgccgcccacgatcgatcacctcgtcgccgaagcactgagcccgcacgccaaccggatcgcccccgtacccgtggcgctcgccctcgccacgggcgcagcccgcgcccacggcgtcgccgtgagcgctacggggatccttgcgaccgcagcgcgcctcgatggggcgctcatcggtcgcccagccctccgggaactcggcgcgcgcggccgagggatcgcgacgctgctggacgccgtcgacgatgcccttggcgaccgaggccttgcccgcagggagcgagtcatgcacgacctcgtcgccaggtcggcgccggcctcgatcgagaccacggtgccagacgacacgagccttggcgtcgggctcacgctgccgacactgctcacactggcactcgtcgtcgagttcgcgccaaaggctcgcctcgcggtcgacgtcgttgcatcgcccatcggcgatcgagtcgtcgcagagctggagcgtcgttcgcgccacgctggggcgtcgatcgacctccgacctgcgccactgccgctcgagatcgatgcccaccggctgccgacgcagctggacgaggcccgctggctcgcaacggccatcgagaacacctccatggccggtcgtcgcaccgaggtggtcgccgcaccaggtgatccacttgccgacctggtcatcgctgccctcggccggcgaggtcaggcggtcgtcgacgaacgaccggtcctccttcgcgacacagcactgtggcgactcgctcgcgatggcctcatcctcggcaccctggggagcctgcccggtgagcctcggagggagcgccgcctacgtcggatcgggcccccgccggcgaacctcggcgacctcgagacctggctcgacgaggcccgctggacgctcaatgcggaggatctgccaccggagggcgcagaagaggccgcggcggcgctgctcttcggagcagcgcgggcaacgcgcgccacggatccgacgagttccgcactggcggtgatggccgacctcggtcggataggcctggagcgcgaccgtcagcccgatgccgccgttcgcgtcaccgcgacgccgcaggacggcttcgagggccaccgattcatcgtgggcgccgacgccgaacgcttcccggtgcccatcagcgatgatccggtgctgccactggatcgggcggtgcgcctcgagctctcgctcggccctgaggccgctgccgtggccgcatggtaccgcggagccatgacgctcgtgggcgcgcgatgggtgacggtcacgatggcacacacggtcgaggctcagctcacccgaccgtcaccactgctcgatgacctcggcatcgagatcgccgaccgtcaccgacagacacgcccgccgggaccatgggcacgccgagctggcgtcatctcggcgctccgccgtcgcgcgactccgagcccctggacctgggacatcggtgcgcaccatctccctcgctcgctcagcgtcacgcagctcgaagaagctgcttcgtgcggcgcacgcttcgcgctctcgaccctgctccgcgtgagcgaaccagagcccgaagggcgacaggcctcgtcggcgaccatggggacccttgcccacgccctgctcgagcaggacgacctcgtcctcgatgcggaggcgttgttcgccgcactcaccgacctcgtccgttcgcacccgtcaccgcgggtgcgcacggaactcactcgagaccccctcggcgtgcatcgactccgagacctcgccagtcaccttgcgcgagtcctcgcaagcgaggacctccgccccatcggggaggtccaccgcgaaatcccgttcgaactcgagctctgcggaactcgactccgggcgcgcttcgaccgactggaacggcagggctccacgtggcgtgtcctcgactacaagctccgtgcctcgaggcccgagtcctggccgatcgcctcctccgatcgaccggtacagctgtgtgcctacgcgctgctcgcagccaaggggtcgagccctcgcctccctgaccggcagcccccgacgagcgtgacggcggcatgggtgctccttcgcgcgcgcgacgcgcacgtcatcgccccctccctgcctgatctcgccgtcatcgacgacgagatctgcacgctcatcgagcgactcgatcgcggccagctcgacctcgaccctggcggccgcggcgcaccgtgccgtctgtgcagacgccgcgcaacctgcggtgtcgcgtggcaaggcgagggccgctagtggaactcacccaagcgcaggatcgcgccgctcgccatcagggaccgcttgccgtcatcgccggtgccgggaccggcaagacactgaccatggtggagcgctatctgcgcctcgtcgccgatggggtcgagccctcggccatcgtcgcggtcacctttacccgtgcggccgcagccgagcttcgcgctcgcgtgcgcgcagcactgctcggcaacgatgcctcgctcggtgcctcggtcgacgccgcactcatcaccaccttcgacggcctcaaccatcacctcgtccgcgcctacccgtgggcgcacgacctcggcaccgacgtcgaggtcgccgaccccgagatcggcgcagcgacggcttccatcgaggccggcgcgctcctcgctgctgcactcggcaccacgacgctcccaagctcgctgacactggttcaggcactcgccgacgaggcccagcgacaaccagagcgcaccctcgccgccctgtccgtccccatggagccggcacgcgatgatcacgtccggcgagcgcgcgcattctggcgtgacgttgcgctgcgtctcggcactgcacttgctgcgtcgaacgccgcaaccgacgcccagcgtcgcttcctcacccaggcccagctcctcgcgaacgccatcgatgcatggctcgactcgccccacaccgacgcctcgggcctggtcgcagacgcgcggtcgatcgggctccgatctcgcggcgccggcatcgaccaggtgcgatccgtcatccaggagctgcgtgaagcactcgacgatccggctcgccgctggcaggcgctcggctggaccagagccgatgaactggtcaccgtacgtcaacctcagctcgccacgatcgccgcatcggtgatccgcgcgggcgacgagcgtcgccggcgggtcggtgaggccagcttcagtgccatcgagcgcgcggccctcgccgtcctcgaagattcgaccgctcgcgccgaactctcggatcgctggcacgctctgatcgtcgacgagttccaggacgtctccgagaaccagctccgactggtggagctcctcaccagcgtggtccaaggacgcgccgccgtggtcggtgatccgaagcaagccatctacgccttccgaggcgcgcggcccgaactcgcgacaagcttcgccgagcggtcggccgtgatcgagctcgaacagtcctttcgctctctgccacgcatcatcgacctcgccaatgattatgcccagcgagccctcggggcctccgagcgcctcaggccgacgcgaagcgcgccgtcgagcgatgggtccatcgccgtggtccaagtcgtcgggggcagggccgtcgaacgacgccgaggagcagctcgcgccgtcgcggctcgcatcaagcgcgacatcaccgatggcacgctccgtgctcgcgacatcgccgtcgtcgcacgtcgctgggccgacctcgacgactaccggcgtgagctcggctcggtcggcgtcgccgccatcgcgagcggtggcggcagccttctcgacacgaacgtcgggctcctcgtgtcatccatcctgcgctggctcgccgacccgagcgacgacgccgccgcgatcgccgtcgctcgagcagacgtcatagggtttcgagacgacgagctggttgcgtacgcccacgaacgcgacctgacccggccgtggtcgacgttcctcgaagcactcgacgatccacgctcacgacgtcttcggaccctgcgggacaacacgcgcggcgcgagtgcctcctgcgcgatcgtcgcagcgtgcgagctgctcgagatcgacgacgcgctcgccgagggcccggaccctgagcgaaccctcgccgatctgcacgccatggtcggcctcatcgcgcgcctggcgacgggtcgctcgctcggggaggtggtcgcgctgctcgaacgcttgcggactacgggagtctcactcccccgaccacccgtcgctggtgcggacgccatcacgctcaccacggtgcacggtgccaagggtctcgagtggcccatggtcgtcgccgtcggtctcgaagccgacccacacccggcgctgcccgaggggttggtgctccacccgaccctcggcgtcgcctggcgcgaccgggacgaacagaacccgtcctcacgcgcgctcgagatcggcgctcacctcgcccacgagcgcgagcaggaacaacgtcgcctcacctacgtcgcgctgacacgggcccgggacacggtcctcgtcgttctcgacggcgacgcggactccgcgctgcgcgagagcctgcacgcggtcgggacgaacgagtggacgaccatcgatgtgctcgccgacgaaccagatcgcgacggcgcagccgacggcgccgatgcagtgcccatgccgtcgtcgccgccccccgatagcggggccagcgaggccgacgagcccgcacccgtgccaccgccgaccgccccgccacggtcgatcgctggtctggccgctaccctcacctgcccatggctcgcacactggtgtggccccgagggggccgacgccctacgccatccgaccgacgggctggtgcgggtgcccgcagagagcgcggcactgtgcggggtggacccgacggtcccactggcccccgtcgttcgcgacgtgcacctcgggacgtggacggtgaccgcggtcgcgctcgccgtgaccgacgccgccgtgatcgtgcccgtacggagtgtgcgcgcagccgaaccagaagctcgtctggcggcggcactcagcgcacacgcccttgagcgacggagcgccgtgctgctcgcgctggacgaaggcgtcgcgacggcgatcgaagcggtcgccccagaggacgtcccggtcgcggcggcccctccctgtcggcgctgtcgctttcgacaccgttgcccgggatcgcgagtcacgttcgactcggttgtccacaccgcggtcgtcgacgaagcctaggctggtgacgtggcagcgatcgatgtggccggtttcgtcaccgacctgaaggaccacgcgctcgaccatggattccacgtccacgatgagcgccacttcgtcgagacctactccctcaggcagtggtgggaggtcgatctccatccagaggaggggtgcggacagcccgtcgacctccatctcgcgctcgacgtcgacccgcgcgtgttgctcgcgttcgaggacaccatggccaccttgcccgatgacgccgaaccgcccgacgacttccatttcccgctgaccttcacctggtcgctgccgccgcttccggtcgacaccgacatcttgcggctggccgtcgagctcgcaggcgtgaccggtccggcgctcccgctcgagatcgcggcaaccgacgtcgtctcctccccgaccgacgctccagaacgacggatcgtcatcacggcacgctgggccatctcactgtcgcgagtcgtcagcggcaaggagtcgctctgcgagctcttcgaccgatcgcgagaggtcagcctctacttgctcgagcactacacgcgctggcaagccgacgaccgctagccatccgccgaggtcgactgcagcgaaggacaggcatggagggttggacggacgcgagcgacgcatcgctcgccgttggcatcggtcgatggcacgaagcagcgctgcaggaggcgtaccgacgctacgcgtcgacggtctggggcatcgctcgacgcgtcacgcgcgacgcgatgatcgccgaggagatcactcaagaggtcttcctgaccctgtggcgcgaaccggaacgcttcgatccggcacgaggatccctgcgcacctggctcgcaacccttgcacaccgacgggccgtcgacgccgtccgccacgacgcagccctcaggcgacgcgaggaccgcgaccatcaactcacgaggccgccgacgaccgccgagatcgaggtggtgatggatcgcgtcatcgttgccgacgcactggcctctctctccgagcaagaacgtcgcgccatcgaactcgcctacttcgacggcctcacctaccgcgaggtcgcagcgcgcctcgaagaacccgaaggaacggtgaagtccagaattcgaggagcgctgacgaagctgcatcggcagatggtctcgacgagaactccggaggcatgatggagcacgaggaagccgcatcactgcttggcgcctgggcgctcgacgctctcgaccccgacgaggccaaggccctggaggcgcacctcgcggtctgcacgcagtgtgcgctcgaagccgacgaactcagggctgcagctggcctgctcgcgaccaccacgaccgagcccgccccggatctgtgggactccatcgccggacatctcggccaatcgccagccgaacctcgccaaccaaccgtccacgcacctcgacgcccgagggcggggcaccgacgcggtcgcatcgccaccgtcgtcgcgggcctcgcactcgccgttgccggcgcgggcatcgggggcgtcgtggccctggcacacgaggtccacacattgaaccagcacgcagccagcctcggcacggcggcctccaccatcgccgcgacccccggcaccaccgtgatcgatctcacagactcgcacgacatcccgaccgccacgctcgcgctcactccgtcggggaccgcggtcctcaccgccgtacggctaccggcactcagtcgttcgaagacctaccaggtgtgggccatcacgacccaaggcgtgatctccatcgggctcctcggcgcaaatccgacggtcacggtcctgcacgcgccgacgcgtggcctgcacgcggtcgcgatcaccgcagaaccggcgagcggcagccctacgccgacgagcgctcctctcgcggaggcgcgccttacctaactctcgtgcacggcgcgcaccgagcgcgacggcactcccaggcggccaagtcagggcctgcgcgctcaacagcgcgcccgtcccaccatggtacgtcccagggagctaggcgagcgtactccgcgaccgttcgcccgggaaccgcatcgccacgacggaaccgtctcgctccaccacgagcactcgaacaccgcgggcagcttgcgccgccgactcgctgagtcctcggaatcgaacgttcgacccgagagcagccgtgaacgtgactccgtccggttcgacgacggtcacggacgaggtcgtgagcgactgcagggtcccgcgcacccacgaccaggtcacgacgcccgagggccgatcgacctcgaaggatccggagaaaccacggaaccagcgatggtgtccatgatggcccaggtgggacgtcgcggcggtggtctgcgtcacgaccggcgtgagcgccgagctcacagcggcgccgcccccacgcagctcgaccatcccggctgcaagggctcccacggagatcgcggcggcagccccgagcacgagatattgcttcttcataccagggagcctacggcacccgaagccacccgagcccgccaggtctgtcagggaactgtgagggttgctgccccgccgtggtccctcgacaccgacgactcgacgccgacagctgccgcgtggctctgcgtcatgggctgcggcgtgggctcgaggtcccgctcgggtgccccacagcgccgagccacccgcgcgccgcgatgggcacgtcggtgatgattgccgtcgggtggaccgacagggcacgcgagaacgcctcctcgtcgttcaccgtccagacgccgacgtcccagctcgccacggcgggcggccgccaaccctcacgcagcaggtcgaccccgacgaggagccaccggagaccgagctcctcgagatcgcgcagcgtcgactccgccggtgcctcctcgacgatgagtcccgcccgcgccccagaggcgagacacgctcgcaccgcgcgctcgtcgaacgacgagatcagggcgtcgcgttcgcgaaccaactccaccagccgcaccgaggcctcgacggccgcacgcacgcccgtctctggcagcagcttcaactcgatgtcgagcatcgacgaccccacgacctcgagcacgtcctcgagggtcgggagtcgacgaagcgacgtgctgggggcgcgctggatcgtgacgccgtcgacgtcaggatcgtgatggaggacgaaggcaccgtccgtcgtcggccagacgtcgatctcgatgccgtccgcacctcccctgagcgctgcctcgacagcgcccaccgtgttctccgtgagcgccgagccgtcgagacggccacggtgcgaccacagcgcgaccgcggctgcgtgctgcgctacgcccatgggacccgcacacctcggaacctgcgaacgaggcgtcgcagatgacgacgaccacgccgcaggctccagcacccttgcgcccctgcgacccggagcgtccggacgaggtgccggtgggggaaggccgtcacctcgcccggacgctccgcccgcagcccccaaggggtcgtcgcgtcacgccgaaccctcgctgagcgcggaccccgtcgagaccgaccatcctggtcgcgaacgtccatgaccagcaccctacggatgcgacgtgaacagccggcgaaggcgcagcatcaatcaggcgtctggttggtgaacgctgcgccgacgactcctgtccgagccgcacgcagcgcggccaccacacgctccggtgtcgtcggcatggcgatgtcgcgcacgccgagcggtcggagcgcgtcgaggaccgcgttccacaccgccggcgtcgctccgatcgttcccgactcaccgattccctttgctcccagcggattgaccggggtcggcgtctcctcgtgcacgacccggaaactcggcagctccggagccgagatcatctcgtagctcgccagcgtgccggtgagcggcgcaccatcgggcgcgtagacgaactcctcgagcaccgcttgggcgatcccctgcgcgagcccaccgtggacctgaccctcggcgagcaacggattgaggatacgtcccgcgtcgtcgaccgcgacgtagtcgacgacctcgacggcaccggtgtcgaggtccacctcgaccacgcacgcatgcgccccgaacgggaaggtcggccccggcggctcgaagtccaccgtcgctgcaagctggataccgcgcgcccgtgcctcggtcgcgagcgtggcccacgacaccaccgaactcgggaccccgacaacaccgataccggactcgccgaccacgagatcctcgggtgcggcttcgagcatcgtgctcgcgagctcacgcgcagcggccgcaacctcgaccgacgcgaggtgcacggcgacaccacccgtctggaccgaacgagaaccaaaggtccccacgccccgtggcacggcgtcggtgtcaccggtcaccacccggatccgatcgaggggcataccgagctgctcggcggcgatcatcgcccacgtcgtgtggtgaccttgcccgtgcggcgaggtacctgaccacaccgtgagcgtgccatcgtcggccacctccacgcgtgcgtactcggacgatgtgtagccgttcgtgatctcgacgtaactcgacaacccgatgccgagcagacggcgagcgccccgctcgaggcgccgagcctgctcggctcgcaacgtgtcgtagccaaccgcctcgagcgcacgctccagcgcgagccgatagcgaccggagtcgtacctggcaccggtacgcgtctcgtacgggaaggcatcgtcggcgatcagattgcgccgccgaagctccgccgggtcgatgtcgagctcgtgggcgagcaggtcgaccgcgtgctcgatggctgccgccgcctccggtcggcccgcgccccggtacgcggagatcggcacggtattggtgaggacggatcggtaggccacgcgcacccgcgggatctcgtaggtaccctgggccatgagggtggtgagccgcgggagcatcggaccgaggaggggccaggcccccacgtcctggaggacgtcgacggagagcgcgacgatggcgccgtcacgacgagcaccgatggccacctgctggacttgtccccggccgtgcgcgagcccgagcatcgaggcactgcgcgtctcgatccaccgaatcggacgcccgagtcgaagcgccgcagcgcacaccgcgagatcctccgggtagaccgcagccttggccccgaagccgccgccgacgtcgcccgcacgcaccaccaccgcgccatcggcgagcccgagcacgcgcacgatctccgctttgagtcggtgggccgattgggtcgatgcgaagatctcgaggcgcccgtcggccgtcggcacggcagccagggctcgggcctccatcggcgctggggccaagcgctggttcaccaaccgtgcgcgcacgacgacgtcggcgtcggcgaagaagtcctccggttctggctccccaccctcggacaccaggttcgacccctcgtgcacgagctggaggtcctcgagtgctcgctctggatcgatcacgggatcggtctccaccaggtcgagatcgaccagttcggcggcgtcctctgcgacctggggcgaggttgcgagcacgagagcgatcggctccccgacgtaacggacgcgaccacgcgcgaggagaggtcgcgcgaggtcgccacggccgcgcagcggacttggcatctcgagctccccgaggtcatcggccgtgacgatcgcgacgacaccatcgagcgccatggcctccgacacgtcgatccctgcgatggtcgcactggcgaccggcgatgtcacgaaccacgccgcgagcgagccatccaagggcacgttggcgacgtaggagccctgacctcgcaggaggtgttcgtcctcaacccgacgcacgtcgtttccgagaatgctcacccgacctcctctcctgacgacgcacgtgagcaaggacctgccaaaagccatccgttgcgccttcgggcgtgcgacgtcgtgctccagcgcccaccgggccgcgatcgcacgtgcgctccgcttgggacagctgcgaccttagccgaactcgggcgcgctgagctctcgggcccgtgcgccgggacggggagcgagctggtgacgccgactaggtcgacgacgaggaatcatcgtcggagccgtaggtgccctcgggcatcgggccagccgccgcgggatctgacgccgacgacgcctcgggagccgaactcccggcctgcgcagacggtgtgcccgggctccccccgaccccgcctgggatccaactgccgctactgcccggcggcggtgttgccggcgtcacgacgacgctgacacccttggcctcgaggtcgccgagctcgtccatgatggccgcgacgcgtgccgagtccgcagcagtcgcccgatgctggtggtcggcccagacgagccctccgagctcgagcaagagcgcatcggcttgcttcttcgcctgatattggtcgagtcgcgccgtcgccgaaccgtaaccctgctgcgcttgatcggcaagcaccgctgcctgctgcttcagtcgctcgaccgtttcaccaagtccactcaaacgatccttgaaccccatcgggccctctcccttccccgagtgccttcgccacccctagcgcccgagcatgtcgccgaggatccccccgagggaaccgcctgcaacgccaccggcgacgccaccagcgaccgcatccgaggcgccaaggtagggcccgagcgcctgggcgagcaccgccagcggcatcgactggagccagacctggccgggcccgacgagctgcaccagccaatgaccatcaccacccgcccagcgattgacgatccccggtacccgtgtcacctggaactgaaccgtctcagcgaacgcgccaacgtggccagggtgaaccagcagctgttggccctcggcgagctgatagttgaccatctcgcccccgagttcgatccatgccgtaccatgtccttcgagccgctggaggatgaacccctccttcccgaagagcgccccaccgagcgactgctggaaggccatggaagcgacgacatcgcccgtcccacagacccagccatcgcgatgcacgaggtaggcctgcccctgcgcgatctcgagcggaacgatgtgaccggggagcttggcaccgaaggcgacgaatcccggtccgcccgtggcctcgaagtgcgtgagcagcagactccccccgccagcgacgcgcttcaacgcgcccatcaagccgccccctgcagctccggtcgtctgggtcatgcgcacgttggccgacatccacgacagctcgccgcgatcgctcacgagatggtccccgggatcgaggacgatctcgagcaccggcatcgtcgaacccttgatggatgcctgcacgcctgcctccttccgccacgccgtcgccaagcgtaccacaggccgcctcgcagatcccgggaccggcccacgaggtcacacgtggcgacggctcgtcgaggttgcggacgtcgacctgtgcggcggcgcgggatcgaccggtcgatacagcggcgagctcggcagcacctggaccgcgaccgtgccccgcgggaccatcccgtcctcttgctcagcgaggtgctcctgataggcgaccgtgccgacgacagcgatctcgtgggtgaggcgcgcgttgtcggctcgaaccgtggcgagctgggctctgagtgcctgttcgctcgcgtggagatcgaggatggtcccggtgggcaggacccaggctccgtaggccagggcgagacctgcagtcagcgtgccgacgagtatgcgccgacggcccttcggcgtcatcgttgggcccgagtccagtcgacgtagcgcgcacccggaccgagctcgcgctcgatcgcgagcagacggttgtacttggcggcgcgttctgagcgagcgggcgcaccggtcttgatctggcccgtaccgaggccaaccgcgaggtcggcgatggtcgtgtcctcggtctcgccggagcggtgcgagatcacgctccgatacccacttcgcgtcgccaggtccaccacatcgagggtctcggtgagcgtgccgatctggttgagcttgatgaggatcgcgttggcgacaccacgctcgatccccttgccgagcagcccagggttcgtgacgaagatgtcatcaccgaccagttggacccgcgaagcgagccgctcggtcaagatcgaccaaccgtcccagtcctcttccgccatggcgtcctcgagcgagacgatcgggaactggtccaccaggcgcgccatgtactcgacgaggccgtcggcctcgagctcgaggccctggccgaccatcacgtaacgaccctcgcgccagaactcgctcgcggcagcgtcgaggccgagcgagcagtcacgtccgggtacgagacccgacgcctcgatcgcagcgaccatgagctcgagcgcctcctcgtggctcccgaggtctggggcgaacccaccctcgtcaccgaccgcgaccgagtggcccttcgccagcagctcgctgcgcagtcgatggtagatctccacgccccatcgcagcgcctcgccaaaggtcgccgcaccgtgtgggatgatgagaaactcctggatatcgaggttgttggaggcgtggacgcctccgttgatcacgttgagcatgggcaccggcaaccggtgcgcacccaccccaccgaggtagcgatacagcggcacgtcgagcgctcctgcggccgcccttgccgtcgcgagcgacaccgcgagcatcgcgttcgctccgattcggtgcttgtcgtcagtaccgtccgcgacgatcatggcttcgtcgatgagccgctgctccgtcgcgtccatacccacgaccattgtcgcgagctcaccaccgacggccgcgatcgcaccactgacacccttgccgttccactcggttccaccgtcgcgccgttccaccgcctcgtgcgttcccgtcgacgcaccagacggcacgattgcttctccgacggccccgccttcgagcacgacccgggcgccgacggttggattggccctcgaatccaacgcgagaaacccctcgacgctcctgatctgcgtccgtgtcccagccgccatggtgccgcctcctctctgcgggccgatgctagctcgttccgtcgccattccctgggcgccccgcatcgacgtcgacctcgccgagcgcgcgctcgaggcgacgagccgcatctcggagcgcctcatcgacgtcgacacccgagagagcggcctcgacgagcacgcccgcgaggtcatcgccccgtcccaacgaggccgcgcgcacgtcacgcgcccgggcgcgccgagccagcttggcgaggcggagcgacgccgggagccccacgggaaccggccgagacccaggctgctccgcggccttgatcgcctcccatcgctgctccacctcgccggcactgcgggcgaccgcgtcaccgaagacgtgagggtggcgtcggatgagcttgtcggtgagggcgcgagcgatcgcgatcagatcgaaactgccgtcctcgtcggcgatggtggcgtgcatgagcacctgcagcaagacatcgccgagttcctcgacgacgtggtcgcgatcgtgtccatcggcctcgtaggcatcgagcgcgtcgaccgcctcgtaggcctcctcgatgagatgacgtgccaacgaccggtgcgtctgggacgcatcccatggacatgccgaacgcaacgtgctcaccacctcgccaaggcgtcccaacgcgaccgacggtggctcgaagtcggtgagcacgacgctgctcaggtgatcgaccgcggcgagcctctcatccccggagtcgacctcggcgacgacctcatcatcgagaccgaggtggtgcgcgaggaccgcccgcgccccgctgcgctccgcgaggacgaccaggtcgcgtgccagcggctcatgccagacctgcagtgcgacgaccgtaccgctcgcgatccaggggttggcgtggagcgcttcggcgtcgaccacgctcaatccctcgaggggatcgacaccgaaacgttcgatgatcagctcgagcactccgcgtccagccagaatctcgacgtcgatgtcgtcggcccgacgcagcaacaccaccgtgcgttcggccacctgtggcgaacccgggaccacgtagcccacagggccacccgtctcgaacgcgaggtcccgcagacgctccacgatgcgctcgtagcactcctcgaaagtcgtggacgccgcgtagagatcgtcgcacgtcaggatcggagcgtccagtgtcccgagcgcctcggcgagtcccgggtgctccagggacctcgcaaccaccgccacgcacccctcgagggcatctccgagcgccgctgcctccgcgcggccagcaccacacccaacgacccgaacgatcggtttcacaccctctcaccctacctacccagaggagctgcaagaggccctcaagaaccagcactctccgtgccgattccacatttagtgacctatcgccccatctcgcttcccggattgaccaccagtcaccactggatgtggcgcatcatcgccgcgtccgtcgcaggaacctccggcgtcggcgcgacctctctcgcgctgcacgcccttaccggctcgacgacctcgtcacgtgccgcggccatcgttcgccacgatgcgcgagtcggccgtgccccggagccgatgccgacgccgcagcgccctcggagctcatcgccatcgcatccagcaccaccgaccccggctccacaggctccgtcgacgccctcacccaccagcgcgacgagcccaccagcgtcggccgcaccaccagcgacgccgccggcgaacccacccgtcgtcgcctcgtcgacgccaccgccggcttcggcgctcgcggacccaccggccaacatcgccccgaccccgaactttgcctcgatctgcgcctcgagcatcagcgctggccctgacggcccaacctgcgagagcgccgccgtcgaggcgatcgacgccgcccgcgcccaggaagggctcggtccactcaccctccctcccaacttcaccgatctcagcccgacgacgcagctgctgtggctgatcaacgaggagcgcaccgcgcgcggcctggccccggcggctggtgtcgtcgacaccctctcggcactcgccgaggacggtgccgcctcgaacagcgatccgcccctcgggtcgctcacgactgggggaccctgggcggtctccgcagaggccaattgggccgcggactactccacggcagcatccatgtacgactggatgtacgacgacggctggggtgggtcctcggccgcgacgacgaacgagacctgcacgtcgccgaccgcagcaggctgctgggagcaccgagccaacatcctcgcgaccgcccccgcgggctacgtgccggtgctcgggctcgccagccaacccgagccatcagggacgtcgctgtcggggctcgagtcggacgcgatggtcctcaccttcgtgcccacgagcgcgctcagctcactctcgttcgtcacgacctggccatagcaccgtgccgtggcggaagagcagcgtggcgagcccgacgccgcgagacccgtcagccaacccgttcgggcgtcacgatctggcgtgcgagcgccgcacccttcggcacggtgggcaccacgctgagcactcccttctggaccacgatccgaccaagggcccgattcacgtggatgttggccgtgtgaacggtgcgcgccaggtagtcgttgaggagcgtctgaccgtgactcaccatggtgtcggccgcgaggagctcggcctgcgagaacggtatctcgctgcgagaggtgatctcgaacacagcaaacccgttgggcacctgtacgacccctgatggcgtacccacaggaaggctcgtcaccgaggtcgcaacccctgatccgaagctggatgcgtactggccctcggtcccgcagccgagcgcgccaccgccagcggcgttctgggtcgacgacgacttcgccacggcagcgaacgactgacccttgtgcagcttcgcaaccaccgcttcggcttccgtaggcgtaccgaccaggatctccgatccgcagtagctctcgaaatcagccgggtgcgcgcggtagtacgcctggacgccactcgtggtcaagctcacgtggccgagcgccgcctcgagctcgacgatgtcgacgctgtcgcggatgaggcgttgctgataggagcgcggaaagccactgaagacggtttgaccgccagcggactgctccgccagggccgtgccaaggctcgttgcgacagcgctcggctggacgtgcatccgcccgagcgctgcctggacccgcatgatcgtgatccgtcgagagaggatgttgtccacgaagagcgcggtgtagctctggtcatggggaccccacaccggctcgtggctcgcgacgagttcgctcacgaacgccttgttcgcagcgacgtccgcgagctccgcttcgagctgcgacgtcgtcagcgtacggttcccgaccgtcgccgcgacgctcgcggaaccacagctcgcgagcaccacggccccggcgagtgggatgagtccgaaccagcgacgatgcacacctacctccaggagcccacggccatgctactggggagaacctactccaggcgatggcgcgccttcgaggatctccagcagtgcctcgagacgtccaagcgcgtcctcccggcgcgcaaggggaaccgcaaggtcgtcgccacgactcacgacgccatggagccgacgctctagacgcagccgggtcgccaccgacggctggagcggaccgacgacgagctcgagtcgtgcgctgcgtgggttgcgccgaacgagcgcatgatcggcaccgagggtcgcaagccgacgccgtgccttcgcgagggacaccaaggcgagcgcttcggccggcggcggcccgaagcgatcgcgcagctcttcaaggaactgatcgaactccgcctggctccgcgccctcgcgagacgccggtagaggtccatccgagtctcggcttcggcaacgtagtcctcggcgagcagcgccgataccggcacgtcgagcgccacctcccgatcgggcgtcggctcctcgacgccgtccatgcgcgccacctcttccgcgacgagccgcacgtacagctcgtagccgacctcgctgacgtgtcccgactgtcgcatgccgagcaccgtgcccgccccgcgaagttcgagatctcgcatcgcgatccggtaacccgccccgaggtcggtgttctctgccaccgtccgcagtcgctcgagggcgatgtcggagatcccgccggtggtcgaggtgagcaggtaggcatacgcctgccgcccggagcgcccgacgcgcccgcgaagctggtggagctgggcgaggccgagctgctcggcacggtcgacgatcagggtgttcgcacgcgcgaggtcgatcccgttctcgacgatcgtggtggcgacgagcacgtcggcctctccgtgccagaactgggccatcgtccgctcgagcgcagcgggcggtagttgcccgtgcgccacgagcaccctggcctcggggacgaggtcggcgaccagacgggccgaggcctcgatgtcgcgcacgcggttgtgcacgaagaacacttgaccttcgcgtaggagttcccgacggatggcctcggtcacgaccgcgggatcgaagggcccgacgtgcgtgaggatcggatggcgatcgacgggcgcggtccgcagcacggacagatccctgatgcccacgagcgacagttcgaggctgcgcgggatcggggtggccgagagcacgagcacgtcgacgccggggaacgcctccttgagctgctccttgtgtcggaccccgaagcgctgctcctcgtcgatcacgaggagcccgagcctggcgaaccgagtcgacgcgccgagcgcagcgtgcgtcgcgatgcacacgtcgagctcgccacttgcgagctcggcgcggatgctcgcagcctcacgagccgtgctgaggcgcgagagcatgcccacgcgaatcggcgtgccctcgaagcgctcccggaacacctccgcatgctgggcagcgagcagggtcgtcggcgcgaggacgagcacctgacggccctcggatgccacggcgaacgcggcgcgcagcgcgatctcggtcttcccgaagcccacgtcgccacagacgaggcgatccatcggcaccggcttggcgagatcagcgagcacctcggcaatggtgcgctcctgatcacgcgtgagctcataggggaaccgttcggcgaactccgagagcagcaccgggtccggcgtgatgctcgaaccggtcgcggccaagcgacgctgatagagcaccaccagctcctgggcgacctcctgcgccgcgcgacgagcacgatggacctgacgctgccagtctccgcctcgcagacgggtgaggcgaggctcctcggagccgacgtagggggcaacgagcgcgagatgctcgaacggaaggaagatccgatccgcgctcgcgaactcgagctcgaggtactcccgcgagacgccatcgaccacctggcgcacgaggccccgatagcgcgcgacgccgtaggcctcgtggacgacgaagctgccctcgacgaggtcgtcgaagctcagacccccggtcgtacgggtgggcaccgaagcgcgaggagccgtcggccgtacgagactcgcatccgcgatcaccaccaacgatgccggctcgagctcgacgctctcgacgaggtcgagccccgcggccactcgaacgccgtgaccctcgaggcaggtggcgaccgaggccagctgcacgtcgatgccctcctcgccaaggcgttgggcgacatgacgtgcacgttccgagccatgcgtggcgacgacgacgtgaactccgtcgcgccgcgcactccgaatgcgaccgaacacccctgcgaggtcgcgatggctcacaccgaggcgagcaccaaagccggctggatctgccgatacgaggcgggcgcgcactgcgcgcagccgttccggctcggccatgagactgaccgacccgagcgcgtcagcctcgagtccccaggtcggagcgagcgcctcccgaatggagcgctcctcagcgacgaggcgatcggcgatgaccgcgtccatacccttcgccgggacgagaacgaggtcggcctcgtcgacgatgtcgaggaccgtcggtgcgacatcgccgagcacgagtggcacgagcggctcagggggctctcgacccgcgagcacggcctccacccgatcggccaccgctggaacgcgtgcagccagggcctcgagttgcttggcgaggtcggtgtcgatccgaacttcgcgagccgggaagagctcgacgcgctcgaggtcgccgaccgagcgctgcgtcgtcggatcgaagaaagcgagccgatccacctcgtctccgaacaggtcgatccgcaccggcgacgccaagcccgggtcggcgacgtcgacgatcgatccgcgcaccgcgtactcacccgcggccgagacctgaggctcacgcacgtagccagcgtcctcgagccaagtgatgagctcgtcacggacgagctcatcacctcgcgccacgatcagacgctccaggcgcgccgcggaggcgacgagcttcgtcaaggcggctcgcacggtcgtgaccacgacgatgccctcgtcaggcggatcgacgatggacgcgagcgctcgcagacgcgctgcggtcgtgcccatgctcggaaccacgcgctcgaacggcaaggtatcccacggtggcaacagcgcgacagggatccgaggcagccaccaccgcagatcgttggcgatggcctcggcttctcgatcaccctcggccacgacgaccatccgtcgcggagcgagtcggtgccaggcgagggcgacgccagccgcgctcagggccggcggatcttccaccgtcgccgcgagctcttcgacgagcgcggcgagcggcgcctcatgcggatcgatcgacgccacgggcgttgtaggtggtcatggcgcgctccggaccaagcgacacgagatcgacgacggcatcggcaccccgctcgacaccgacgtcgaaggaggtccgctccgggccgcgtacctcggtgaggacccaatcgacgacggcctgacggccggccgggcgtccgatgccaatacgcacgcgccagaagtctcgcgtgccgatgtgggcgacgatggagcgcaggccgttgtggccagcgagcccgcccccgtacttgagctgtacgcgaccgagcacgagatcgagctcgtcgtgaaccacgaccagctgcgtcacagggtcagcgtggaagtagcgcagcaccgccccaacggcggcacctgagtcattcatgtaggtctggggcactgcgagcaccgctcggtgatcgccaagtcgcccactgccgacgatcgagcggtgacccggcgtcaacctcacgtcgaggcgtcgagcgagcagatcgacggtcagcgcgcctgcgttgtggcgagtgaagcggtaacgagcgccagggttcccgagaccaacgacgatgatcggctcagcgggtgctggaggcgtgagctcaggcctcctcgaccgtcgccaccaccgtctccggcgcctccacgaggctcaccccagccggaagtgggagtgcccccgccgtcacggagccatcggcgagcaggtcggcgccgacgtgaatcgacgacggcaccgatgtcggggtgccggacaccgccacgagacccacgaccagccgtactccctcgcccgcctcgagcgggacctgcacctcgaccgtctccgacgcaccgaccgcaagaaaatcgaggtgagagagttcccgtcggacggggtgtcgaacgacagcctggagcttgaccgttcggacctcaccgtcgatctcgatgtcgagcagttggccgacgaccgcgtgctgaccgagcgccgtgaggaagccatgccggtccagcgtgaccgcaactggctcagtgagcccggccccgtagacgatcccgggtaccttgcccgctcgacgcagacgacgtgccgcggccgagccacgagcatcgcgtcgctcggcgaccaccttcaccatcgagacctctcctctgtgccgggcgcacggcgcctccgcgcgcgagggagcagcctaccgccccagtcgggacctcgatgcggctaggagaggttctccccctggaacagctccgacaccgacccatcctcgaagacggcggcgatcgcgtcggcgatgaccttcgcgatcgagaccacctcgagcttggcgatggctcgttcgggtggaaccggcagggtgttcgtgaccacgacgcgcgagatgggcgcgtccatgagccgcttgggcgcggggcccgagagcacggcgtgggtcgccataacccagatctcatcagctccgcgcgagcgaagcagttccgccgcggccgtgaccgtgcccgctgtgtcgatcagatcgtccacgatcacgcagtgacgacccgccacgtcgcccacgacctcgagggccgtcacgacgttggccgttcccttggggcggctcttgtggaccaacgccagtccagcgccgaggcgctgtgcaaaccgctcggcaaccttcacacgaccggcatcgggagcgacgatgaccgcgtcacgaggagcgaacgcacggaggtactccaccagcacctgactggccgtgagatgatcgaccggcccatcgaagaagccctgaatctgacccgaatgcaggtcgacggcgatgatgcgatcggctcccgctgcgtgcagcatgtcggcgaccaacttggcggtgatcggctcgcgacccgatgccttgcggtcctggcgcgagtatccgtagtacgggcagaccgcagtgatgcgcttcgccgaggcacgcttcgcagcgtccaccatgatgagctgctcgaagattgcgtcgttgacaggcccagcgtggctttggatgacgaagatgtccttgcctcggacggactggtcgaatcgggagtagatctcgccatcggaaaactcccgcagcgtgatcgcgcccaactcgacgtcgaggtgctcggcgacctcccgggcaagctgcggatgcgaacgtcccgagaacagggcgagtcgcttgcgggggacgagctccatgcctcacctttcgtggcgcgtcgacgccgcaccatcctaggctccgcgtcacggcgacgtaccgccccctgtggctgtcgcagagacgcccgaacgctcgacggctacgaacggtgggagagcgcgcgtcgatgacccgggctgcgtgggcccgatggctcgacggtgcagtcgatcgctcagaacatgccgaaccgaacgctcctcgcgctggtgttcgtcgggccctctcgctcacctcggtcgatgcgttgctgacacgggcgagttcttgagggtccgctcgttcgggccgaggtcgcggacaacgtcagcaagggcgcggtggttggtctcgttcatccccttcctcctgcacctggagcaggtgtcaaccgggaagggcacggccatccctctgcagctgtcgacgccgttcgaaaactgaacgatttcgccggtgaaaagtgaacacccgagcatggaggggtgatcactgtggaagactgggcactcatcaggcggctggtggccgagggcgtccccaaggctcgcatcgccaagcggctcgaggtctccgatcgacagcgtgcccggtcgcgagccagccaagcgccacgcatcctcatcaccacagccagagtcagaaggtctccgcgccccaggtcatcgacgcctccggggcccaggcgggaggcgtgagcacatcgagtctcgcatcgatggtggcctcggttgcggagcgacagccaccgacaccagcgcatctggccacagcccctcagggaagcccctccatgatcgtcgggacgcatgcgatcgtggtcgcacggtgcgcgagacgagacgctccgttgggggtagcaatggtttgttcccgaggcagtcgatcgccgacttcccacccacggtgcgcagctcgaggaatggggactctgcggcgcggcaccagtggcaaccccgatgctcaacgccgccatgggagccgcggcagctcacggggtccggccgcgatgagtgcgacgaggtcagactcggcgacagggtaaccaccccatgcatcgacgccgacgttgatcatcctcccgtgctgtcgccacttctcatggacatgaccgtgcaggagccaggcccctcgatccttcggacgcaacgctgggaagcgttccacctcttgactatcgccttcgtatgggaagtgggatacgaccacctccacatgcccaagctgcagcgcaagctcgccatcgaggaccgtcaagcctgcagcctcgtagctacgacgccaccgatcgacctggttcttctgcttccttcgcaagccctcccagcacttgtcatggttccctggaacgagaaacttcgtgccattgaagagctcgaccaactcaagcatctccgctactggacccatggcgaggtcgccgaggatgtagacctcgtccgcaggatcaacgcgctcgttccagcgctcgatgaggtcgacattcatcgtctcggtatcgccataggggcgctgtgtatgagcgaggattcccgcatgaccgaggtgcagatctgaggtccaccaccgccgactcatcgatctgagtgtacttcgaggggtgggcacgacgatgatctgccacaggcggcgtcaggaccctggcacttcacgaccacggcacttcacgaccacggcacttcacgaccacggcagagaggccgttcggcattctccctctccagtcttgcgtccttgacgacctctgaccattgcgatccaggtcgccgcctgctcgcggaccaagcgtcacgtcagactccggagcggtcccggacgagcaacctgcagctcgccgtcgaaacccttctaccagctcctcgaggatgcgcgttcgtcgcaggacagcagcgacaagcgatgaccgacggtcccagcgcctgcgggttcaacgacgagaccatccgtacgggtcgacgggcgcgtcgaacgctcccgcctcggcggtcgactgacgtcgggcaccgagcacccgctcaccgccggggccagtcgaccacagctcacgatggaatcttggacgtgcgaacggtcacctagggcaggcgcgcgaacggcggaaccgtacccttcggttcgacgaccgctccagtctcgagcacgctgaaggggcccacggtggcccactctccaatcgtcgcacagcacgcatccaccgcccggagctgggcgccctggcccaccacggtgtcgacgagacgagaatgagcgccgatgagggcattggcctcgatccgtgtcgctccgagcaaggcgacctgcggttcgatgaccacgccctcggccacgcgcacgcgggcgtcgacggtcacggtggaggggtgctgaatctggacaccctcgtgcaggagacgacgtacgatgcgcgcccgcatgcgctcggcgacgtcggcgagctgcagccgatcgttgacgccgagcgcttcggtcgggtcatccaacacgagcgtcccgacccgatagcccgactcggcgagcagggcgatcgagtcggtcaggtagtactcccgctggcgattggtcggcgcgaggagccgcaacgccgaggggagcacagcgagatcgaagacgtagacgcccgtgttgacttcgcgggtggcctcgccccgatcatcgtcgaggtcggcctgctcgacgatggcgcgcaccttcccgtctcgggcccgcaggattcggccatagcccgatggatcgtcgagctccatcgtcaacaccgtcgccgcgttgccttgggctgcgtgggttgcgagcaaggccctcagcgacgtcgccgtcagcagcggcgcgtcggacggcacgaccaccacctcggcaccgctggagccgacaccaggcaggagatccggcaaacgggtgagcgcgacccgaaccgcgtcaccggtcccgcgttggtcgaactgataggccgtcacgacctcgacgccgctcggagcatgtcgctgcacctctgcctcgacggcctcggcctcgtgaccgacgaccacgacgatgcgcgacagatcatcaaggtcgcccagcgcagcgagcacgtggccgaccatgctgagaccgcacacctcgacgagcggcttcgggcggtccgaccgcatgcgagtccccttgccggcggcgagcacaacgccgtagcgcatagcgcaacctcctcgtcgcaaggctagcttcgggcagtccgcaccacgtaggtcgtcaccgaatcgggcgtgagcagcgccaccacgctgtgcgcgtcgacgtccggcagcgccgtcggctggagcgacttggtcggattcgtcaccaccgcgcccatggcctggaccccgtcaagtcccgggggaagctgcacctcgagaggcaagggggctgagccaggggcggtcaagttgatggcgatcagtacgagacgcccaggtgcacgccccgcgagcatctccacccgcgcatccgacgtcgtcaccggcacgagacccatgcccggacggaggtagcgagagaactgtcccagcacgtcgtagcgcttggtcaggtagagcgtgtggtcgccgtcgcgtgcaccgttcaggtcgaagtagatgagtccgtcgttgcgcccgagtgggttgatgtctcgaaagcacccagggtcggccgcaggactgcagccgagatccggtgagagtgccagccaccagtcgaacaccgaggcgttctcgaccatgaggtcgttgtagatcgtctgggcgagccagaggcccgacgtcatggttgggtcgtactggtagccgaacccctccccgtcatagcagcagatctccgtgtcccagatcggcacgccccatcgacgtccgagcaacgcgacctggtggagcaccgcccgcgaggggtagtcgtagccatggaccgcgagggcggcgagcgaggcacgcacgcccggatacgtcagccaccgtggcgcctgccggagcagttgcgtggcgtaggaggactcgtcggcgatcacgcgcgcccacggcgcaacacgcgccagatcgcgcgcgaggtccacgacgagcggaccacgctctgccaccggaacagccattccctcttggcgacaggccgcttgcgaacccaccggctcgttcatgggcgacacgtagcgcagcttgacgtggtcgacgcgccacagacccgccacggtcagcgcgagctcgtccgcgtacgcagcgacatcgccagcgaggagcgtaccgccgcagctgcggtggttcgatgtgaactgcgggggtgctgcgttgacgaaccccacaagatcgcgcaccccccacgaggccgcttgacgggcaaagagcaccccctggggatcggcgtggaagtcgaacgtaccgttggcttggtagaagctcggcggcgccttccaccacgtcgtcacacccacgccgccgccgccgatgttgaagcggaactgcgacagctccaacccgcgcgacgagtagagcagccggcccacctgcgcgatcgtggcggagccgagcgctgcgaccggtcgcgaccaccaggcgccactcgccccgatcccgaccagcgtgtggcttggacgtggccccacgtctgcgacgacgagcggctggcgcggcggcgacgacggcgaggcgggcggcggagcgagcacgttcgcgccagcgacgatggcaaccccggccgcgacggccgtggtgacggacacgacggctcggaccaggctccctacgaccgcccgccgacccacgtcacgcatcgccgcgccacgctacccggcacggggtgagggcagcctgatgcccctgcgacctggcccctcgagcgccaaccttgcactaacctcgacgcgtgaacggagccgaactcgccgcgttgaccctgagcgatctcggcgtcggggtagtcttcgccaatcccggtacgagcgaactggttctcgtcgatgccctggagcgacgtgggccgcgcccgattctcgttacccacgaactcgtcgcgatgggagcggccgatgcacacggtcggctcggcaggctcggggcggcgctcgtccacctgggtccgggtctctcgaacggcctcgccttcgtccacgacgcgcgccgagcccacaccccgatgctcgtgctggtcggcgaacatccgcgctcccatcgggcgctcgatacgccgctcaccatgcggatcgcgtcccttgccgaggccatcgacgtcccgatgatcgcgatcgacgaccctgcgctgatcgccccccaactccgcgcagccgcgaccatcgccaccacgcagcgcacgccggtcgtcgtcacgctcgatgccgtggcgatggaacgcgaagcgacaccctccgaccccagcgccccacccacgaccgcgcacgaggcgccttccatcccccgagcgcgcctcgaagccgcgatcgacctggtgcgcgctggagagtgcaccttgctcctcggcgctcgcgttctcgagcccgacgcacgcgcgctcgcacgtgccatcgccgatgacacgggcctgcggctcttggcggagaccttcccggcgtcgcatcgctacggagaaggggcggggcgcatcgagcgccttgcctacctgcccctcatggcgcgcccgcagctcgccacggcgcgtagcgtgctcgttctcggaaccgatgccccgtcggcgtggttcgcccacctcgagcaggatccgcggctctggccgctcgctgcgcccctcgtacgcctcgacggccaggacgaggacccacgcgtcgtgctcgagcacctcgccaaggcgctcggggtcacaccggctcctccaccgacatcgcaacccattccggcgccggacccccacgcagcgctcgacgggtcgacgctcgcagccgtcatcgcacgagccgtgcaggccgacgacgtcgtcatcgacgaagcgcgcacggctgcccccgcgctctacgaacaactcgccgacgcgcgacgccaccactacatcggtcaccctggcggtgccatcggggaaggggcgtcgctcgcgctgggggcagccacgctcggcgcttccgtcctcgctgtggtggccgacggagggttcctctatgcgccgcaggccatctggaccatggttcgcgagcacctcgacgtcaccgtggtactcgcggtgaacggcggctaccgcatcctcgagatcgagcagaccatcgctgggctcgacctccacccggagctcacccgcctcgacgacccaggctgggacttcgctggcctggctgctgcgatgggcgcacgaacgacgaccgccacaacggtcgcagagctcgaggcggcgctacgagatcgacatggcgtccacgtcatcgtcgcgaccgtctcccaatgaccggtgggcgcccaccccacctcggaacgagccccgtcacgaggcggcgagtccaaggtgttggctgaggaactcgacgcgagccctcgctaccgcctcgagatcgtcgggtcgccgtggcccgtgacgactctcgaggagcgggaggaatcgtaggtcgatcccgaggtgcgcggcacgctcgagcagtcggagcgagtgaccgacgtgcacgttctcgtcgaccatgccgtggatgacgagcaccttgggagcatctggacctgcgagtccttcgatcccgtgcaggacgctcgcctgctcgtagcgtggatcgtcgaccaagccgaggtagcgctccgtgtagcccgtgtcgtaccagcgaaagtccacgaccggtgcacctgcgaccccgacccggaagcgtgacggatgtcgcgaggtcgcgagcagggtcaggtacccgccgtagctccacccgaagatccccacgcgagtggtgtcgatgccgaggtgggccgctgcccaatcgatggcggcgagctggtcgtcgagctccacggtgccgaatcccctggcgatcggctcctcgaaggcccggccacggttcgccgaccctctcccgtcgagcttgacgacgacggcgccgcttcgtgcgagccactggcaggtgagatctgcggtgagcgaccatgcatcttgtaccagctgcacgtgcggccctccatagaccgcgagcaccagcggacgaccctcggtcgacccttccccttggtagaccgcggcgtagcgccggacgccatcaccgaagtccgcttccacgaggcgaggggtcggcacgacgacctcgggctccgatcgcacgagcacctccaggtcggctccgatccgaaggagctcgggagcacgctccacggacgacctgaccgcgacgattgcccgatcgccagcggcagcgaccccgaacacgccgcccgcgagcacctcgtcgggcgacgacccatccagcggtacgcgccacagggagcgccgtgtcggatcgtcgacgtagccgatcgcgaccaccgacccaccgaccacgccgacgatggccgtcgccacgagtgccggggccagcgcacgtgcaccctcatccgtgatcgccgtcacgcgccagaagccgtcgaaacgctgactcctcgtgacgaggacgccgtcggcaccgatgagcacgcccggcacgtcgacccagggttcgtggtgctcgcgatcgatgcgcgtcgcttcaccatcgcccatcgacacgcgccagcgggtgagctcgtgctgcgcccgatcgaggatccctgccacgaacgtctcgtcgtcgagccagagggcctcgacgaggtaaccgtcaccgatcggcaggtcgacgatcgtcgcgccacctccgtcgagcgtggcgatcgcgatctcgaccaccgcgttcgccgcgccgacgaaggggtagcgatgccgctcgacacgctcgggaaagggtccgtgatgcacgatgaggtgctcagggaccttggactcgtccaccacggtccaggccactgaacggccattcggcgagagccagagcccgtcgtgacgatcgaattcctcctgagcgatgtagtcggcgagcccgatggtgcgatccgtggcgatcgcgagacgttggcgctcgcccggccccgcaagccacacctctgagccactcgccgcgaccacacgatccgagccagcgcacgtcgccacggcgaccgcgccatcgaggtcatagcccacgactggccgaccagtccgatcgaccacgctccaacgaccgccggtcgacaccgcaagtcccgcggtacccaccagccgaaacgagctgaccccatcccaggaacgtcggaggcgctgggcttcgagctcgtcggcctcggtcggtcgcgcctcgtcgtccggtccaaccagcaccacgggcgaggagtctcccgccgcccaccgaacgagcgaggcgcggtcgtcgtcgccggtacggagcgcgaggaccgatgcgccatcgatcggatcgatggccacgagtccgacctcgaccacgcccggcaaccgtcggcgccacaggtcatcgaaacgaagttcgcgcatcatgcgagcaccttacgtgccgaggcgccctggtgcgtcagcgtacgagacagcgaaccagactgcgggccgcctctcgtgcccaccgactcggctcgtacaatgacgccaaacctcgtggtcgaagacccgggccggttgagcgctgagcggttctcgtggtgacacgcatggccggagacgatcctccgaaccctcaccaatggcccacgccaggactgcactcccctggggccgggacgaggcggcgtccgatctgagggggaggtctgcgaaacggtcaccacgctcgctcccggccaccctcaccatcgactcgatccggcggagcttgagcgctaggtcgccgacgcctcgtcacgcggctccggccgcggacgctcgggcagcgcgtcgcgacgccacaccaagaccttgcgccgaaaggagacgacctcctgaccatcttggttgtagccgcgggtctcgacctccaccacaccgcggtccggcttcgatcgcgacggcacgaccgcaaggacggtgctctcagcgtagatcgtgtcaccatggaacgttgggtacaggtgacggaggttgttgacctcgagattggcgatggccgagcccgacacatccggcacgctcatgccgagaacgagcgagtacaccaggttccccacgaccacgttgcgcccgtgcaccgtggcgagctctgcgaaccgctcatcgatgtggagcggatgatggttcattgtgagcaggcagaagagatggtcgtcggcctcggtgatggtcttgcccggccagtgccgaagcacgtcaccgacgacgaagtcctcgagacagcgcccgaacgggcgctcgtgggtggccaccgaactagtcgagtggtcgtggccccgagggcatcggtgctggacctgtcggaccgttcgcgggtcctccttgctggggcatctgtggtggcgcgagcgtcgagaacgacgcgtaccagtcctcgcccgactcaccgtcgaccacgagctgccaacggtaccgcgagttggcgggaagcgggaggggcccgatcgtcaccgccagattgagcgggatatccgaaccgagcggcacgccctgcggggtacccaactggaagtcaccacggatctcgaccggctgagggccctccggagtctcgatcgtgacctgttccccggcttcgtcctggaggaacagctcccagtgatgcggattcggcgcttcgccccaggcgagctccagtcgcatcgcgatcgccatcggcgcaagaccagcgacggtcatcgaccaaccgcctccgaggatgtagagcttgccgtcgcagacttgcgcggcgtcacagagcatgagggaagccttcacggcgccaacgctagccgccggcacacctcgggtcagcgcacgagagcgcccgtgccgagcagggcgaccacggccgtgaggttgaacgccgcgtgcgccacgatggatggtccgagtcgtccggtacgcgagacgatgatggcgaggatcacgccgaagacgaacaggccgagaaattggagcggctcgaagtgtgcaatcgcaaacagcagggcgctggcgacgacgggaaccccgatgcgaagcagcgagggccacccggccgcacggagctcgtagagccgcagggtcacgccgcggaagaagatctcctcacacaggggcgccccgatgacgatgatcgcaacgacggcgaggaaatcgtggccgacgccgacgccgagcagctggacggctggcttggagatcgaccgacgcgcagccgggtcaacggcctcgacagggagatagagcagcggaaccacgacgagctggccgaggacgccgacgccgatcccgaccggaaggtcgacgaggcgcatccgaaagcgcacgaagcggaggaacgaccccgcgccccaccagcgcgcaccgagcacagcagcgccgacgaacacgacccacaggcccgcttcgtcggcggcgagcaacgacgggctgaggccagcgaccgtggtcggcaccgctcgatgctgcagcgctgcggtgccgtcgagcgccaggatgctgcacacgaaggcgaccgcgagagcgacgacggggaacgcgagcgcaccccagctgacggtgccgagggagtcgcggtcttccgtcacggcttccctccttgcgcagcctcgatgggtaccacgccgttcgctgacgaccgtacacgagcccaaccccacggagtaggcaggcctgcctcgcaccgcatcacgacatctcgaacgtgagcagcaaccctgaggcatcgctcaatgccgcctccagggtaaccaggactcctcgaccgaagctcccgtacgtgcaggaactcgcctagcataggcagggtatgatgccatcgtcccaacgcccctcgccacgaggctcgcgtcagtcgccgtcgcccgaccagcgcgggcgcattgccttcgcgatcctcgcaacgctcgtcgtcgccgtgctgctactgactctcttcagccacgccccgagcggacagccccttggctacagcaccttcatccacgacgtacaggccaagcaggttcgcacggccgtcctcaacaacaccacgggtcagatcaccggctcgctgacgaacggtactgcctacagcgtcaccggtccgctgccctacacctcgagcgaactcagcacgctctcgaaggcccacgtccaggtgagctacatcacccccgggcctggcatcgcgtccaccatcatcgagtacgtcatcttcttcgggatcttcatcgggatctgggtctacctcacgcggcgcacgcaggggtcggtcaacggcatcatgagcgtgggtcgctcgcgcgcgaagacctacaccacggaacgcccgaagacgacgttcgacgacgtggccggctaccagggcgtcaagggtgaggtgaaggaggtcgtcgacttcctccgcgatcccagccgcttctcgcagctcggtgctcggatcccgaagggcatcttgctcgtcggtcctccgggaaccggcaagacgctgctcgcccgtgccgtcgcgggcgaggctggcgtgccgttcatgtccgtgtccggttccgacttcatggagatgttcgtgggagtcggcgccgcacgcgtccgcgacctgttccagacggctcggcgccagtccccgtcgatcatcttcatcgacgagatcgactccatcggtcgtaagcgcgggacaggtctcggcggcggacacgacgagcgcgagcagaccctgaaccagatgctctcggagatggacgggttcgatccggctgagggcatcgtcgtgatggccgccaccaaccgtcccgacatcctcgacccggcgctgctgcgcccgggacgcttcgaccgtcagatcgtcgttccgctccccgatctccccgaacggctcgccatcttgcaggtccacacgagaggcaagcgcctcgcgcccgacgtcgatctcgaggtcatggcgaagggcacgccggggatgagcggtgccgatctcgccaacttggtcaacgaggctgcgctcaacgccgtccgcaggggcgcgaccgacatcgccatggcagacttcgactctgcacgagatcgcatcatcatgggccagcgccgcgaggccaccatcctctccgacgaggagaaggagcgtgtcgcgttccacgaaggcggacacgccgtgctggcctatgtgctcgattactcagatcccgtccacaaggtcaccatcctcccgaccggcatggccctcggcgtcacccagcagctcccagagcgcgatcgacacctctatccgcgcgagtacatcgaggacacgctcgtggttcggatgggaggtcgcgtcgccgagctgctggtctacggggatctctcgacgggagccgccaacgacctccagggcaacaccgagctcgctcgcaggatggttcgcgagtggggcatgagcgagcgactcgggccgatggcgtggggttcgcagaacgtcgtcttcctcggcgaggacctcctccactcggccgagtactccgaccgcacggctcgcctcgtcgacgaagaggtcgaacgcatcctgcgcgaacaggaggaacgcgcgaccgagctgctccgccagcacctcccgggcctcatcgcggtggcgcacgcactcctcgaacgcgagaccatctcgggcgaagaggtcgggcgtctggtggacgaggcggcaggccacccgatccaccccgacggcaagcgggtcctgccgatcgccaagctcccggagtacgccgagctcgagcagttcaccgtcacgaacggcaacaatcacgctgcatcgcacgacgacaccgaccccgtcagctgagacacccgtgcgcgagttggtcgtcgtcgccgagttcctcgggttgacggaggcgcacacctccgggggtttcctcgccctcgaccgtggcctcgcgaccagtgctcgactcgtggtggcgggcccgtgggcccccgaggtcgtccgtcgctaccgaggccaggaccttggtgtcacgctgacgctgacctcggcccatccgatcctgcgactctccccgctcaccgcggcaccaacgctggcgagcggggatggcggactcccggtcgcggccgccgacctcgtcgaacacgccgacgccgaggaggcagcgctcgagttgcgcacccagctcgaacgggccatctggtggggcatcagcccgagccacgtggcactcttggacgaggggatcctgcgccgcgccgacctgttcgacgtggtcgcctcgctcgccgaggagtacggtctcgtccttcgcctcacgccgagcgccgacgaggcacacctcggctacgacgcctgggggatcgctcgcgaccgcggcatccgcaccatcgacgccgcgatccccgtcgacccggcgacgctgaccgacgcgggcgccctgctggatctcgtccgctcgagtgcccacgccctcccagagggcatcagcgagctcggcctcccactcgcgatcgacagtcccgagctcgcggcctgggtcgcgagcggcggtgccgccccggcccccgtccggctcctcgagcacatcgaacgcctctggggggcactcgagcagcgctccatccaccggacgagctaccgcgacctcagtcgccgagtcgatcgaagtccgtccgacgggcgagctcctgctcaagggttcggtacgccggcgacgccgtaatgggcagcagagccacgagcagatcgaggttgccctcgacctccaggcgcccttcgagaaacgccgtcgtcggatcgagctctccccgctgcatcgcacgcgcgatctcgacgtccaccgtgatcgagacgtccgggttcgggtgctcgccaagcccggcgtcggcgagctgcccgtcctcgatcacccagtagtacggacgctcgacgtcggcaagcacgtagtactgcaccacgccgttcgcaccctcctggcgaggcatcgccgcaccgagttccttcgtatcggcgacccacgcgctcgagagccatgcccccatcacatcctcctcaccatcgggtctcgaggctcgccggctccagcagcagatcggcgaagagatcgtccaccacgacgccggctggctgaccgacgatgtggtagtcgtccgtcggccacagctcctccagctccgaagcccccagcgcgaaccaccacggcgatgccgggtccacctgcgatgcgtgggcacggagcgcctcgtgggcacgctcgatgaagccggtgacgtcgacacgcgccccgacgagctcgtcctggcccgggcgatccgtgcgagcccaaggaacctcgatcccccgtgcccgaagcgcctcggcaatgcggacggagcgctcccggacccacagtgaccacgcccaccgcggcactcgccacggtgggccgagctccggcaacaccgtgggctctggcgccaaggcgagcgcgaggcgcgtcgcttcgaagacacggagatggtccgggtgcggatagcccgcctggtcctcgggataggagatgacgacgtgaggtcgcacgcgcctgaacgtggcgatcaagccacgcgccgcctcaagcagtggcaccgaaccgaaggcgcgtggatgacgcgccgtgggagagcccggcatcccggagtcgcgaaacccaaggcgcacgatctcggcatagcccgcgatggccgccgccttgtcgagctcctcacgccgcatccgtgccatgcgctccggccgctccgtcgcgagctgagggttcaggtacgaaccctcctcgcccccggtcgccgtcacgagcacacagtggacaccggcatcggcgtagcgcgcgatagtggccgcacccttcgacgcttcgtcatcgggatgagcatgcaccgtcaccaggcggaacgttgcgatttggcgcgccgacgtctgggaactcacgccgccagcctaccgaggaaccactcctccagggcgccgtgctgccctcgaggcttacgccggcaccagcgtcaccgacccgctcacgctcacggtgccgacgccaggtcgaccggcgatcgcagcatcgaggacccgagcgagccccacgcgcgtcggcgttgcgccaagggcgtggatcgccccgaccatgttcagcccgaccacaacgccgagggtcgctgcacgagttccccctgcgcgtgcggacaaggtggcgacgagcggtgcccacgacggtggcagcgtcgtcggcacatcgctcacgaccgagaggcgtcgaggatcaatcccggcgctcaccgccagccatgcgccgtctctggcgggggcgagcatcgcgccgacgacaacgacggccttcggtgtcacgccagcctggacgagatcgtgcagcacggtcgcgtcggcgacaagatcgtcgccgacgacaagcgtggcgcccggattcgcgcgcacggcactcgcgagcgacatcgagctctcgccgatcgcgtcacgcacgcccgccggcagcacggtcatcgtcgtcccaggagggagccacagcaacgggcgcgcgcccagcgagccgtcgtgcatgagcacctggagctgcgcagcgaggggtggcagccagcctccagagacgatcgggaaggacgatgatgccccgatacgtgacgccaccgttgcaaccgtgctcgtcgctggcccgagactcgcgccgacgacggtgaacgcgtccaccgtcgtcagcgcatcgcgggtctcgatggccgctgcactcgacgtagctggcaccgtctccgcgatgaggtcgatgcggcgacctgcgacgccaccgtgctcgttcgcccacgtgagcgcctcgtcgatgccacggcgataggaggcagcgccaatgctccacggagactgagtggccgtcaccgtcgccactgcgacagagctcgcggtcacgccaggtgcgctcgccgccgggagcggcgtcgacacctgcgtactcgtgcacgccgcagcaacgaggccgagggcacaggggacgacgagatgacgacggcgcatcgcgcctcatgctatcgagcgccctactggaagtccctggagccaagggcgatggcctcaggaaggctcacgatccgatcagcgaccacggtcacgacggtcccggcccgctcgatcacgccgtcgaccagcaccgcgctgtggagtgcctgcgatcgatcgcgacgccagagccacggcttgaccaacacgttgacgaggcccgtctcatcttcgaggttcatgaagacgatgccacgcgccgtaccagggcgctggcgatgcgtcaccgtaccggccacgcgaacccgccgaccatggcgctggctcgccagctgatcggcgcgcacgacgccaagtgtcgacaaccgctcccgaacgaacgccatcgggtggtccccgaccagcaggccgagcgcgtcgacttccagcgctgcccgctcacgagggtcgagggcagggaagacgggctcgctcgagggaaacccgaggccatcgagcatccgatgccgacgtgccagctcgtcggcgaaccagatggcgcgctgccccgacggctcgagtgcacgcagggcaccagcgccagcgagacggcgaatctgctcgggcgtgagttcgacccgctggacgagatcgaggagcgagtcgaacggacgcatcgcgacgatgctcgacgccgtcgccgctgcgatccctcgaacggcgtcgagaccgagcgcaaggagctgctcgccatcgcgtacgacgacgtcggcgcgtgcgctcgaccgcgtcacatccggaccgaggaccccaacaccatgacgccgcgcatcgcgtacgagtgtctgcggcgaccagaaccccatgggctgagctcggagcagcccggcgtagaacgccgccgggtagtggaccttgaaccatgcactcacgtagaccagccacgcgaacgacgccgcgtggctctcgggaaacccgaagttcgcgaacgcctcgagctgcgtgacgacctgctcgcgcgcggccggatccacgcctcgagcggccatgcccgccatgagccggtcgtggagccgtgccatgcgcgcgctggagcgcttcgcccccatcgcctggcgcagctcgtcagcctcggcagcactgaaacccgcgacgtccatcgcgagctgcatcagctgctcctggaacagcggcacaccgagggtctttgcgagtgctcgctcagcgagcgggtgcggatagaccactggctcctcaccggctcggcgacgcaggtagggatggaccgacccaccttgaatcggaccggggcgaatgagcgcgacctccacgacgaggtcgtagaaccggctgggacgcagccgtgggagtgtcgccatctgcgcacgcgactcgacctggaacacacccaccgagtcagcacgagcaagcatctcgtagaccgccggatcctgttccagcgtggcgatgtcgacctcgacgccgacgcgctcgcgcacgagatcgaccatctcgtggatcgcctcgagcatgcccaacccgaggagatcgaacttcacgagacccatgcgcgcgcagtcatccttgtcccactggagcacgctgcgaccctcggcccgtgcccattccgtcggacacacgtccacgatggggcgatcacacaggaccatcccgcccacgtggaccccgaggtgccgaggagcgccctcgaggacgctcgccacctcagcaatcaccgcagggacctcgagcaacgggcgacccgcgccgtcacgttccgcgagtgagcgcgcgaccgaacctcggtgctcgacccccttcgaccacgccgcgagcgtggcctggtcgacaccgaagacccgcgcgctgtcgcgcagtgccgaccgagcacggtacgtgatcacgctggcgacctgcgccgcacgcgctcgtccatagcgggtatagacgtactggatgacctcttcacgacgacggctctcgatgtcgacgtcgatgtcgggaggaccgtctcgctcgggcgagaggaaccgctcgaagagcagaccgagcgccaccggatcgacgttcgtgatcccgagtgcgtagcacaccgccgagttcgccgccgagccgcgcccttggcagtagatgccctctcgcacgcaaaagtccacgatgtcagtgacgacgaggaagtagccggcaaaaccgagcgagcggatcacgtcgagctcgtggtcgatctgctcccacgcaccggggatccgcggcgcagctctcggaccgtagcgcctcggtgcccgctcggccacgagcgcgacgagggcctcgtcatcgtcgacgcccatcgcgacgacgtcacgaggcaggccaggggccaccagatcgacgttgaaggcgcaccgagcggccagctcgacggcggcgtcgaccacgccgggatagcggccgaaccgcgctcgcaacgcgcgcgctggccgcagcaccggcggccctgcgcctgggaggtagccatcgagctctccgagggtgcgccgtgcacggatcgcagcggcaactacggcggctcgctgggttcgcacgtcgatcgcgtgcacagcctgggtcgccaccaccggcaggccgtggtgcgcaccgatcgccgcgaggacgtcgttgcggaccgtgtcggcagggtcgagggtgtcgacgagttccaacaccaacgcatcgccgaagcgctcccacagcgagcgcacactgcgctccgcggcgctcggcccagcgtgcgcgagcgcacgccccggagggctcttgcgccaccccgcgagcacgaaccacccacctgatggggccgcctcagcgaggtcgtcgatcgtgagatcgaagcgtcccttctcgccggtacgcatgtgaccggtcgcgatgacacgcgacagcgctcgatagccctctggcgaggctgcgaggaccacgaggtgctccccttccgggtcggtcgcgccagctcgaggcgtcgtcgtcgccaacgtaagttcggcaccgacgagtgggacgacccccacacggcgagccgcctcgaggaagcggggtactccgtagagaccgttgtgatcggtcagcgcgagcgcacggtaacccgcgaccgccgcggcctcgacgagatcctctggatcgacgacgccgtcgaggaagctgaacgacgaatgggcatggagttcgacgaccgcctcgctcactcgtagctcccctcgagccaccatcgcccgtgctcccgtcgaacccagcaccaccgccgctcggtcgcgagcacgagtcgggcgtagcgagcacgacggcgctcccaccaccgctcgcgcaccacccacggcccatgagccgcctcgatgcgctcaggaccctctccgtcgtcgagcaccgccggtggagcgctcaagacgccatcacgatcgacctcgacggccataccatgcgcatcgagcagcacgacggcctggaggcgctccggaacccgcgtcggcgtgagtcccggaacatggccaggccacggggcgccagttccgaccctgtcgtcgacgaccggccaaaccccggtccaggacacccaaggacgtcgatcggcgaacccgcgacccaccggtcccggacctgcgacccgaaccgcctccggtccatagcgctgctggagcacgtgaaatgcctgacgtacggcctgacgtcgcgcgccaggcacgccatcgagggagagctgcgggggttgtggcacactccacgcaaggatctccacgccgacgcgtaccggtcgcccccgagcaccctcggcgcgatcgctcagcgcacgcaccgattcgaggatctccgccgccgtccctccgaccgggcgctcgacgacccgctcgagcgccacggctccctcgaggtcgacgaaggagcgccatcgggcaggcgcgacgtctgcgtgctcggcgagcacgagatcgagcgccccacggaggcgaaaccgcacgctctgggcatcctcgccttcctcgacgtcgatcgccaccgcgtccggctcgagtggaggggtgcgcacgagcggaagatcggcttccagtcgcacgagtcggtgccagcgcaggccacggtctccgaagcgagcggccaccgcagccgtgtcgatgcgctggaagccaccgacgcgacgcacgccgacgtcacgaagcggaccagcgagccaccggggcagcagctcgaccggctgggcagcgaaccacgcccgcgagcccacctcggccccgcctccatccgtcgtggcgccagcgacggtggcgatgagtgcgcccgcgatcgaagcacccagcgccactcgagtcggcacggtgccgtcgagggctgcccgcacgcgctcgacgagtgcgtactcggtcccgtagaagcggcgggcggcacgcgcttcgatcgcaaaggccccacgcacgcctgccacctgacccacgcccggcgagacgctccagagtgcccggtgcacgcgggccaaccaacgtgcctctgcgatcggatcgaccgcgaccacccggccatcaccgaggcgggcacgcaccatgggggcacgtgccccgagggggatcccagcagctcgagcacgggacccgacggcgacgacccgatcgcgacgatcgacgacgacgtcgaccgcatcagcaccaccatgtgcgatgagctcgagatcctcgatccacgcaacgacccctggccgcgcagcgaccagctcgatgccgtcgaggtcgatctcgtcgaggtcgatcaacccgccacctcgacggccgtgggcgtcgtcgtcaccagcgacgaacgacgcaagctgacgcgcacctcgcgcggcaggccagactcctcggcgaccgtcatcgaggcgacctcgagcgcacggatcgatcccgctgcggccagcacgcggtggcgctcgcgactgcacgcgcgttccagcaccacaacgatccctcgtcggcggcgcacacgcccgagaatgcgcggccaccggacgtcgacaacccgatcggagacgacgagcacgtcgaccacctctgcaaggttggacgccacgaccgccagctgcgctgtcggcaccgacacctgtgccacgtgtgtgagcgaccacccagccgcttcgagcgcggcggctggcaggtcctcgagaccgagcagcgccaccgccctgccctgatgagtactcggcgcgatcgcctcgagtgcaccccaacgcgcacccgggccgccgtgcatcaccagcgcggttccaggcgggacgccgtccccgaggcactggcccgccgagccgcccagctcgagtcgctggtctaccagctgcccagcagacaggaaggaggtcacatcgtgattttagaacatttgttcgttcatcacgacggctccccctccatgcgcccccactgcgcgatgaagtggatccgctcgggaagcagcagcgaccgccgatactcgaccggtcgcgccccggcgaacgtgcgccgctcgaccagcaagagcgcttgaccgacctcgacaccgaggagacgagccacctcgccgtcagcgttgacggccgagacctcgtccatccccgccgacacgtgcacgccggcgtgctgctccaagatctcgtagatcgatccctgctggagcttggcctcgagcaacacctcgccctcggggagcacgacgctcgcctcctcgagtgcgacgacgtcctcttcgacgccccggaggcgccggaccacgacgaacgactgcgcagggatctccaggcgctccgcagcccgagcatcgtcgcgcacctcgacactcagcagcgtcgcgacctccttgcccacgtcggcaaggcgcgccgccagcgagaatcgctgctgctggtacccctcgaactgcctcctgggcactacgaaggtacctcgtccctggcgagcgtcgaggtagccctccatgcgcagctgacggatcgcctcgcgaacggtcgcgcgcgacaccccgaaggcatcgcgcaattcgggctcggaggggagacgatggcgcacccgaccatcgtcgatcgccgagcgcagctcatcggcgagctgcacccacagcggcaccggcgaccccggatcgagacgagccggctgtagtcggtcagtcacgagatcccccatccgttcgaagcagccctgcaggtgtgctcacacccggcgcgctgatccgcccaacccatcggtccagcatacggtcggcgctcaacctgcaccgtcgagcgctccacgcgccagacatcccagctcgttgccccaccgcctggcggcgacacgagtcactgagaccaatgcatcgagacctcgtcacggagggcgatcgacacacgacgcctacgcgatcgcgaccgaccgctccggcgtacccgtcgcagagacgaccacgacgacaccggcgctccagcctcagcgatcgatctgacgcagccgtccttgatgcacctcgatgcggcgctctcccgcgaggatggcctggatcccacgtcccacgacgtcgtagcgccacccttcgagcaggctcccctcgccccgagacacgaagagctccacctcttcacgcgaaccgagcaacgagggctcgagttcgagctccagcgccactgcatggacgagcgcttgtgccgtgagcacgagcggcacctcgtggggatcgagcgcgcgatccatacgcacggcgccccgagccacgatggcatcgtcgtcacgcgcagctcgtacgacctcgagtagctcacgagcacgttccttcgccatgcggccgtcgaagccccgcacgctgcgcagctcggtgagcgagctcggacgcgccttggcgacactcgccacggcgagatccgagagcaccgtgcgcaccggaacgtcgtcgcgttgggcggtgcgctcgcgccaggccgccacgctcgctgcgatccgtctccccgtaggatcgaggccacgacactcccggatccgtgtccatgcgagctccggttcgatgtcccgacgccgccgctccacgagacgagccatctctgagcgagcccagtcctctcgtccacgagcgtgcagttcctcgagaagccggtcggcgagcgcagcgaggtagcggacgtcgttcgcggcgtaggcgagttgcccgggctcgagaggacgacgcagccaatccgaggtgcgctcagccttggagatgctcacgccgaggtagcgatcgagcaacgcgccgagactcgcgtgaccggccccgaggaatccacctgcgacctgggtgtcgaagatacgccgtgggcgtgcgccgaccgcgcgctcgatgatctcgaggtcctgatcggcagcgtgaaatacgagctccacctcgtcgaaccacgctgcgatcggcgagagatcgacccgcagcggatcgatcaaccacaccctccgatcgatcgcgacctgcaccaacgcgaggcgtggatagtacgtccgctcccgatggaactcagtgtcgatcgcgatgcgtggcaccccgagcccgacgccgacgagttcgtcgaggtccgactgtcgatcgagccagacgggctcgtcatcgctcacgaccgacgcactcagcgccatcagcacgacccgcccgtcgcccacacggcgctcgccgtcactctggccacgcctccagcctaggagcccttcgaaccagccctcccgtggggatggggctggtcagaggtgacctcagctcgcgagcaggccgagagcatcgtcgtgacctcgcctacagtccttggcaactcgggcaccatcgcaagatttccggtgttcgcggcggccaacacgggttgcctgctgcaccacaccacggcgaagacgttccgagtcgagagcgatcacctgagcgaccgacccaatgagccaccgccgcaggctgggcttccccccacttgcttgacagcctgattgaggccacggccgcctcccgacgggtccaggagagctcgtactcgacgggtggcacgtacccgaggctcgggtgcggtcagaccgcgctgtcgcacttgatccagacaacgagagcatgaccgagctcagggaggttcgccaaccgacgccgagtgaccagctcccgaatcgcgttcgcgaacgcgatttcggcctcaacgcaccaagcgcccgggacgaagcacagccccttcacgcgtgcgcagaccgccgtgccacgagagctcgtgcctgcgtccgtccgagcatgactcggccacggcggtcccccgccctacgctgtggccgtggaaggttgcgtgttttgtcatctccttgccacgagtgacccctatctcgtcacggcggaccacgacgtcgccgtcatcttggatcgcgcgccggtggctcccggtcacgcgctcgtcatcccgaccggccacgtccccaccttcgatgacgcgagccctgctcagttggcttccgtcacggtgaccgctcaacgactctcgcggggcttgcgctcgcacggcatcgcggacggcgcgctgatcctgaccaacgtggtcgtctcgcaatcggtgccgcactggcactgtcacgtggtgcctcgacatcgcggcgatgggcttcgaggcttgctctggcctcgacgtcgctacggcagcgacgatgaggtcacgctctggcgcacgaccctgcacgcgctcgtagcaccacagagctaggaaccctggctggcgcccctcaaacaagaccacccgcttcgtgagcgaccagaatggacgagtgggagggagaccacatgaagggcccgaagcgccataggccggagcagatcctccggaggctggccgagggggacagctgctgaaggcgggcgccacggtcgtcgaggtcgctcgggccttcgcacatcaccgagaccacctgggagcggctggctggccttcccccctccaggttgacacctgctctaggaggaagggatgagccagacaccgaacccaccaccgggcgacagccccgctcggcgacgacgcggccgctacccgagccagttcctcaaaggagccgcagcattggtcctcgaccagcgtcgcaccatcgctgaggtcgcccgcgagcttggcgtgaacgagcagacccttggcaactcgcgtgcaccaggaacgcatcgaccgcggtgagcgcgaaggtctcacgagcgccgagcgcgaggagctcactcgtctgcgccgccagctcaagcaggtgacgatggaacgtgagctgccgaagcgttgcccggcctttgcggatcctgcgagggcaaccagtgacccgctaccgctccggttgctcgtcaggaggccgatgggttctccgtagcggcagcggcacgagtcatcggagtctcgcgccaggcctacgacgcctggcgacgctggcgcgagcgcggccctgaccccgagcacctggtgctcgcgagcgagcttcgcgccatctggcgcgagagcgacggcacccacgccaagtcccagagtgacccacgagctgcgacacgcggtgagtgcgtcaaccacaagcgagtggaacgcatgatgcgcgagctcgagatagccgcctgcccaccccggcgcttcgtgcgtaccacgacgcctgcagaggacgcacccctcccggacctggtccagcgggacttcgcccctggcgagccagggcgttgctctgcgagcgacatcacctgcgtccgaaccgatgaggggttctgctacctcgccacggtggcagaccttggctcgaggcgcatcgtgggctgctcactccagcatcgcatgcctgatgacctggtggtcgaggcgatctgcggagctcttcggacccggggcagcgtggctggggcgatctttcacagcgatcgcgccaaccagtacctctcccggaaggtttgccagctctgcgcgacgctcgggcttcgccagtcggtgggcagggtcgcgacctcgcgacgacaacgctgtcgccgaggccttcttcggcagcctgaagcgcgagctggtgggtcgctaccgcttcgcgaacctcgccgaggcccgccctgccatcgcgagctggattcagcgctacaacacggtccgcctgcactcgagcctcgggtaccgaccgccaatcgagtacgagctcacctgggcccgtgcggaggcggccgtggcctacattcagactgtcaagcaaatggggggaaggccagcgatctggacccactagtgggtggtcgccactttctcggcgacctcggacagtcgggcctggaccttggacagattttcagccctgacaggattctcggtactcacatgcagaccaggtctcatgtcggcactatcaccgcgacgccgtactgggaggccgccgccgccatacggttgtcgtaggtgacgatgccgtcgagctcgtcacccagttccagagctgcggcaagatggagcgcgtccagactccgcaactcttcggggtcaagggtggccgcccgttcgagcgtggcagaggtgaggttgaacaaggtgagagcgtcaagtactgatcgagcgcgctgcatccgatcgggggccgcgcgccgggtcgcccgaaggagctcggtgcgcagcaagtcactggcaatcacctgggtttcgtggctggccgcccacgatgccatggcttctgacgccggttcggcgacaacgagcttggccgccgccgacgtgtcgaggtagaagaccatcagtagcgctccccgccacgcatggccgctacgacctccgacagcctgggctgctccgcacccgcgtcgggaggcgcgccgagagctgcgagcgagcccttcgccggccgagcccgacccgacgcgacgaaggcagcgactcgcccctccgggaccggaacgagctgggcgaccggtcttccccggtcagtgatggtcaccacctcgccggcggcggctctggccaccacctgcgaggcgttctgcttgagggcgcggatgcctaccgtactcatgttctacattgtagcactctgtcgctgaccgctccagggatcgatgtgctcccaggcgtgttgaaccgccccgggtttcgtgcacacttcgttatgtgtgaacggtctcggactcggccgccaggcggccatagtactcctgctcgacctcgacgggtggacggcgccccagccggtgcatgagcctccgcgtgtcgtaccagttcacccaggctgaggtcatctccttgagctccctgcgcagcctgatgagctcggtgcgctcctgcgccgtgaggggcgggctgccagtggcgctcgctgcctcgatccgcctgcgctcctcccgcacccatcgaaagatggctgtactccccgatcgcgagctcccgggccacctccccggcacgctccggccgctatcgataacccggtgggccgcctcgatgcggtactccagggtgaactgaccttctcccctccttctgacatcgtacgtgtgacgaacgacgtgtctacggaatctggggcggctcagacgtcggatctcacagtgagggtggactcggtgtggggggacggtcagagcgaatcagcgcacagcgcaagcgcaagctctctggggcgaggctgcgctaccgaggactcgtgcgcaaccgcctgcacttcgagctgctctgtgcgacctggaacctgagggtgctcccgcgtctcgggctcacccgagtaggtggcggctgggtgcttgccacctgagaggcgctcgggcccctcccctccttgcctccgaaggaggggacgaagagaagagggtgaggagctgggcgagcacgggtcagctggatccgttctctggcagggttggtgccctcagccaccacccgggaggggcttggtggggaggctgctagttcgcatcgttcagccgcaccaccacccaatcgcgcttgccgcgacgcagggtcagatggccatcggtgagatccgcctgcgacacacgctgaccctcgagtgctcgacgtccgtcgacatagaggcccccttgtgcgatgaggcgtcgtgcctcggaccgactcctcgcgagccctgctgcaagggcgagatcgatcacatcgatgccgtcgccaaacgccgcgcgctcgagggtgacgacgggcgcacccgcctccgcacgtccaccctcgaagagcgcacgagcggcctctgcagcctgatcggcagccgcctccccatgcacgaagcgcaccacttcccacgcgaggcgccgatgggcgatgcgccgagagggatcgtcctcgtgggcagttcggagcgcagcgatctcatcgaaagagagaaaggtgtagagggccacgtactccatgactttctggtcctcagcccgaacgaagaactgatagagctcgtacggcgacgtgcggtcttcgtcaagccagacgttaccccccatcgacttgccgaacttggtcccgtcggccttcgtcacgagcggccacgtgaggccgtggacctcgtgcccgtcgagacgtcgcacgagatcgatcccggcggcgatgttgccccactgatcggacccgccgagttgaagcgtgcacccgtagcggcggtggagctctacgaagtccaccgcctggaggatcatgtagctgaactcggtgaacgacaggccctcaccgccgaggcgcgtacggatcgactcgcgcgccagcattgcagagaccggcacgtgcttgccgatgtcacgcaagaacccgatcagggtgagcggctcgagccacgttcgattgtcctcgagcgtcacggcccccggcaccacgtcgccgaggagtcgttggagctgaccggcgatgcgggccgtgttgtgtcgcagtgtcgccggatccagcaagacccgctcgctcgagcgacccgagggatcaccgatcatgccggttgcgccgcccgcaacgaggatcgcccgatgacccgcatcgatcagtcggcgcgccagcacgattccgagcaggttgcccacgtgcagtgagtcggcggttggatcgaagccgatgtagaagacccgtggcccggcatcgaggagctgctcgagtggcgccgacgcatcttgaaccgcgccacgccacctgagctcctcagcgagcgacacttgatccccctgtcacgaccgtccggcagcctggtagagcctatcgagctcggcgttggtcgcctcgcgagtcgtgcccacgcgggccacgacgaacgcgcccgctcgggcgcgcgagagggccgtcttgacagaggccgcatccttgagcgtcatcacctcatggccgaggccttcgaggatgcgtcctggcgagtaccgtggcggcgtcacgaagaaggagcgctgcgtcgtggggtcgagcaagcgcgccggagcgacgcggtcgaagatgacgcctccttggttctcgagcaccacgaccagccctcgctcgggcaacggcagttgccacaaggccgagagtccgtagagcgcggtgaggtccccgacgacgaggacactgagcgctctcgacgcgtgggcgacgccgagccaggtggcgagggtgccgtcgatgccgttcagacctcggttcgcgaggacccggacgccagcaggggcgcgaccgccgaagacctcgaggtggcgaatgggcagcgacgacgcgacgacgagcgactctccgtcgtgcagtccctggaggacgacccgggcgagggcgacttcgccagtgggcccatccgcgaccacctgctcgagcgtcgccgcgatggtgcgatcgcgctcacacaacccacacggctcgcccgcgtggccgcccggcacggtcagcagcgcacgccgcagggcgtcgccgacgtcggcgaccaccgccgtcgtggcgaggcgcgctggatcgcgccagcgcgatcggctctggatccacgccacagggatgccccgtcgtgccgcaacggcgatgcgctcggcgaccacacgcgaggcgtgtggggcgccgaggacgaggacaacctctggggaggcgtcggggagtgagcgcaggacgagctcggggtgctcgaggacccacgggccgcgctcgacgccagcgagcggatcggccagcacgggccagcccaggtgcgcggcgacgctggcgagggcatcgacatcgatcgtgtcgtcctcaccgacgacgagccagcctcgacgctgaggatcgaaccactgcgcgagccatgcatccgccaggctgggacgactcgggatcgtcaccgagcgcggatgccaaggtccgatccgaacctcctcgtcgacgagaagcggttcggcgatcgcaagattcagcacgcacggcccagggccgaacggcgcggcaaccgtgcgcacgaggagctcgtgcgcgacgccagcgagctgctcggcgtccacgacgtcggagagctccagatcgatgacgctggccaccgacgcgagcgtctgggcctgctcgaccgtttgtgcagcgcccacgccatgggcccagcggggccggtccgccacgatcgccacgagcgcgacgcccgcctcgcgagcctcggcgagcgcgggaacgagctccagcgcagcggtcccgctcgtcgtgacgaccgccaccggtcgacggagtgccttcgcccacccgagcgcgaagaaggcagcttcgcgctcgtcgaggccgacgacgaccgacgcatcgctcgcactcagcgctgccgcgatcggcgtcgaccgactccctgggcagagcaccgcgcccgcgagcccaccgagggtaagggcctcgacgagcaccgtacactgagcaacgctgcgtccaaggagagacgatgaccaacgctcgtgcacgcaacctcctcggaccgaccggtgctgtcgtcgaggtcacgagcaccggcggacccgagcgacgcgccgtcgtgctccacggcttcactcagtcgcgctggagcctcatcggcacgctgcttcccgtcgccgagggcattgccagcgagatcgtgttcctcgacgccccaggtcacggcgccaacctagggccctccagtgtacgggcgttcctcgacgccgttgcggagctcgacccagacatcgtcatcggctactcgatgggtggtcgcctcgccctctggctggccgcggtgcaccccgagctcgaggcggaggtcatcgccttctccgcgcatcccggcatcgaagccgccgatgcccgcgccgaacggcgccgccgagacgaggccctcgcagaccgactcgaccagctcgctcgaccacgagccctcggtgccgatgcgagcaacgtcgacgccttcctcgacgagtgggactcccagccgctcttcgcgcgccgccggctgagcgagcggcgacgcaggggccgggccctggccgatccgagcgggtgggcccacgccttgcgtgcctacggcacgggcagccagcccgacctcaccgaggcgctcgctcactcacgagcgcgcctcgcactcgtcgtcggcacgcgcgacacggcctacgtcgcgcacgcagcgcgcctcaggcaccgtgcgcacatcgtgaccgtgcccaacgtgggccacgacgtgctcgccgaggcgcccgagatcgcccaagggatcgtgctcggactcctcgccgcccggcgcgcaccgacgtcggctccctaagccgcgagccacgctgccagcgcaaaggcgaggccgagcacgagggtcagccgcccggttgcagccagcgaagcgacgagcggacggcccttggcaccgccaacgaccggcgcgatcgcgctcggagccgcgacgagcccgaccacggctaccgcggccaccgcaaccagccgatcggtggcgagccaggttgcgagcgccacggcaacgacggaggccgccacgagcgtcacgaagagcgcgcgagtcgtcgactcgccgagccgcacggccagggtgtgcttgcccgcgagacggtccccgtcgacgtcacgcacgttgttgaccatgaggatggcgctgatcgcaagcccgagtccgatcgccaggatccagccatcagccgggagcgcgtggacctggatccacaacgtcccgagcgtggcgagcagcccgaagtacgcgaaggcaaacagctcaccgagacctgcgtagccatagggtcgtggtccgccggtgtagaaccaggctgcagcgatcgcactcgcgccgatcacgagcagccaccagctcgtctcggctgcgacgaccaccccggccgccgcggcgacggcgaacgaccccagggcggccgcacgaacgtgcgcggggctcgcgagcccctggccgaccaggcgaaccggtccgacccgagcctgatcggtaccgcggataccatcggagtagtcgtttgcgtagttgaccccgacctggagcgcgagcgcgaccaccgccgcaaggatcgcgcgcagcacgacggcgtgatggagatgggccgcgaggccggtcgcagccagtaccggagcgaccgatgccggcagtgttctcggccgagctccagcaatccacgcgcctacctgcgccatcgttcctcccttcgcaccatgccagtctacggaaggttcggccctaccatgagagatcatgtcgtcgccgtccaacgtaggtcgacgcctcgtcgcgctccccgcccgtcaggacgcctggctcgtggatgccatcgcgaccgcgtgggaacgtggcgaggccgtgtgtgtcgtcgacgtctcgtcgccgatggttcgccaacgcctcgacgcgctcggcgcccacgtgcttcgcctcgagtcgtcggagatcacgctcgacccgtcggcgccacccctccatgacgacgcctggatcgtgcaggtcacctccgggacgaccggcgcaccgaaggccgtggtcctcaccgagtccaacgttcgggcctcggcccatgccgtaggtgaacggctcggcatctcgagccacgaccactggaccaccgcgctctcgcccgcgttcatcggcggactcgccaccatcgcccgcgccatcgtcgcgggcgtgccgatcacgctactcgcacgtcaccgacccgagcacttcgcccgtgccgtcgccgctggtgcaacgttgaccacaaccgtggcgagcgccctgctcgagatcgatacccgtccgttccgggccgtcatcctcggcgcccagcccgccaccggcaacctggcccccaacatgcacacgagctacggcatgaccgagaccggctccggcgtggtgtacgacggcgtcgcgttaccgggcgtcgaggcgaggctcgtcgacggcttgatcgaactccgcggacccatgattgcgcagacctaccgcactggcgccccgatcctcggccccgatggatggctcgcgaccggtgatgtgggcgtgctccgagcagggcggctcgaggtccttggacgagccggcgacctcatcaactctggcggccaccacgtgccccctgacccggtcgaggccgtccttcgccgcaccctcgcagaccgcgtcgtcgatctcgcggtgtacgcgacggccgacgatcgactcggagagaccgtgaccctggccgtggtcgccgagcgcccaccgagcccagctgatctgcggaggtcgctcgaaggtctcatcgagaccccatggatcccgcggcgagtcgtcgcggtcacgtcgatcccgaggacggaaaccggcaagccactgcgcagactgttgcctggcgcagtggctcgcacaccacaagcgtccacgaccgacggctccgccgcgtcgatcgccgcggtctcctagtcgacgagcggttctggcgcctcgccgacgtcgtcgaggtgcaccacccgctcctccgggctcggcatgcggaagtagggccggcctttggcccagtaaatggcgatagggatgatgccgagcgcgatggccccgataccgaccaccttcgtcgtggtattgagccctgggaggctctgctcgaacatcaccgccatgaagatcgctccagcgagcggccagagtccggcgaagatgaaatacgagagcttcgtgaacaggagcttgcggtacaagatcaccaccgagaaccctgcaaggccgtagtacacggcgatctggagaccgattgcgttgatggcgtccgacaagacggtaccgacggagccgacgtagttcgacgcgatgagcagcccgaccgagacgacggcaacgacgagcgtggcggccacgggcgtgagccgcgtccgatgcgtacgaccgaggatcgagggcatcgtgccgtcacggcccatggcgaacaacgtgcgtgacacctggatgatcgtcgtctcgagcgtcgcgatcgtcgagagcgcgacggcgacgacgatcagcttgcccccgatcccgggccagaccacctgcccgagcgcatccaggacgtcaccggcgttctggctgatctgatggcccgtgagcaccatgttggtgccgatggtgaacacctcgaacaagatgaacaccacgatgacgccgttgatggccccgagacccggggtgacccgcgatcccttggtctcttcgttgaggttggccgtaacgtcccacccccagtagtagaacgccgccaccagggcacccgcgaagaaccctgccgaaccgtggaagatcgacggggagaaccagtgccagctgaagctcaccaccttggggctgtgcaccagcatcaagatcgcaaagagcaccaagatcgcaagttcgatcgtggacatcgcgacctggagcttggccgtgatggtcaccccagcgatgaccgcaccgaccatgatcaagaacacgacgatgccgaggaacgtcacccacccggtcgagttcgcgagccgctgcgagaacaggccgaggatggtcgatcccgccgggaccgaacctgcaaccatgaagatgagcgccgacaccacgaggcaccagccggcgatgtagccgagcacgggatggagcgcacgtcgcacccacgcgtacgtcgcgcctgcgttcgcctccgatcgcccgaggtagttgaacgcccagacgataccgaacatggcgattccgcagtagagcagggccgccggccctccgagcgccacggcgccgatcagggtcgccgtcgatgctgcgatggagtaggcgggggcgacgcctgcgacccccatgaccgacgagtcgaagagcgagagggcacctcgccgcaggcgatggtggtcccgactgttggcgtgctccagtgaatccatacctcccccttctcgagtccgacgccgaggctccccgaggttccggcgttactcgattcgcggggaattctacgctcgaccatcgaaatcggcaaggatttcacgaattacgcacgaattcgcaacaatcacggccccccgagccgaccgatcgtcagcgtcccgccgtcgacgacgaggttggcccccgtgatccagcgcgcctcgtcggagacgaggaacgcgaccgccgccgcgacgtcggcgggctcaccgatccgccgtgccggcaacgagcgagccagctgcgcctcgagcgcatctacgaggaccgccgcaaaggatgtgcgcaccaggcccggcgagaccgcgttgacgcgcaccggtgcaagctccgtggcgagctggcgggtgagatggatcaacgccgccttggagacgttgtagagcccgatgccgggctcgggctcgagccccccgacgctcgcgatgttcacgatcgccttgtcgtcaccaggcgcgctcgcgaaccgagcggcgagcaatgcgggggcacggacgttgaccgcccagacgaggtccatcgcttccggctccatctgggcgatcggaccgaacgtcgggctcgccgcagcattgttgacgaggaccgacaccgacccgaacgcagcgacggctcgctcgaccacgatggtggcgacctcgggatcgcgcaggtttgccgccacggtggtcaccgcgacgccaccggcgcgcaggtccttctcgaggctcgcgagctcctcctcgcggcgcgcgaccccgacgatcggatagcccttcgctccgagcgtctcggccacgctgcgaccgatcccgcgcgttgccccggtgatgatggcggcacctcgatgcatgtccccacgctatcggtcacgccgagcgctagcctggcatcagtcggcaccacgagggaggcgccggtggggaatcgccttgccaccagcgacagcctgtatctgcgcgatcatgccgacgatccggtcgactggtggccctggtcgagcgactcgctggcgacagctgctcggctcggtcggccgctgttcgtgtcgatcggctacgccgcatgccactggtgtcacgtcatggccgagaccacgttccgcgatcccgcggtcgcagcgctcatcaacgagcacttcctccccgtgaaggtcgaccgtgaggagctccccgacatcgatgctcgcttcatggcggccgcgctcgcgatcaacggcagcggtggatggccgctcaccgccgttgccacgtcggatgggagacctgcctgggtcgcgacctacctcccgccacgctcgacgagtaacctgcccggcctgatcgagacgctcaccacgatcctggacgcgatcgcacgcgacccccgcgcgctcgagcgtgctgccgacgaactcacgcgcgcacgcctcgagcctcgcagtcggcgaccaactgcgccaccgaccgacgagatcacgatgcgcctgcggacggacctcgcacgtcagctcgatcggtccgagggtggcttcggaacggcaccgaagttcccacaggctcacgcactcctcgccctctgggagctcgtgcgcaccggggatggcgtcgagacagtccgcgtgcgagagctcgtcctcgcgagcgtgcgccgctacgccgagagcggtctcgtcgaccacctcgacggaggcatctttcgctacgccgtcgatcgcccgatggtggacgtgcactacgagaagatgctcgtcgaccaagcctggttcatcctgctcctcgcggtgatcggtcccgatcgcgaggatctcgacctgtacttcacgctcgagcgcacgatcgccttcgttcgacgagcgctcgtacgcttcgacggcctgctcgcaacctcgctcgacgccgacgcccacggagtggaagggggcgcctacctcctgcgcgccgaggaggtccgtgccgtgctcggcgacgaggccgcctgggtaatcgacgagcttcacctacctcccgatcgcccccaccacggccaccggatcggcgcttcgacgctccgattggaagggaacgcactcacccgcttcgatgcgctcgccgcatggcggcgcgggcgcggcagtgcgcgacgcgacgacaaggccttgtgcgaccacaacgccgccgtcgcgaccgcactcctcgtcgccggtcggcgctcgggacgcgacgagtggatcgtctggggtctcggcctcgcgcgtcgcgtgcatgcgacgttcgtcgatgcgagcggcgcccgtcacgtcgcctacggcggcgaggcccgcggagcaacgagctccgacgagctgtgggtctcgatcatggccctcgccgcatgggaggtcacgggcgcgactgcttggctcgagcgcgcgcgcacgagcgccagtcgcctcgtcgaacggttcctcctcccagggctcggcatggtcgtctcgagcacggagcctggtgaggccgtccccgaccgcctcgacggcgcccacccgtccgtgagctcactcgccctgtggcacctcacgcggctcgtcgcggtgagcgcggacgaccgcctcgcccacgcacgcagccagctcgccgatgcgctcgccgatgtcctggaggccgcgccggccgcagctgccctcggcgccctggcgatgggacacaccgaccgcgtgcgcaccgtcgtcgtcgcgacccccaacctcaccgaactcgcccgtgtcgccctcgccgctgctcgtccgctcgacgtcgtcgtccgcgatccgacccacccactcgcgaccggagcggctggcgaccgggccgaggtgtgtgttgctcacgcctgcctgctcccgacgagcgatccacgcgtcctggctgacgcgctctggtccacgctcccgtgatgcgcaccgaagcccagctcggccgcgagcggtctcgtccacggagcggccaacccgagctgtgacgccggccgagcctcgacgaccaccgttcagcacgccgactcgacgacctccggcggcaccatcacgtcggcatcacgacccagtacggagccccccagagcaccgtcgactcgccgccgccatcgcgcaccagctagcctgaggtccaccacagtgacctgcggaggagggcgcgtgcatcgttggccgccggtggaagcctgagatgtccacaccgtttcgacatgtgctcctcgggacactcgacgtgcctggccacgaacgcgagttcatcatcctcgaccgggccgaactgcgcctcatccgcgtgatcgcacagcgctcgggcgagctgacgaacttcggctacgtcgtcctcgagcacgagcacgcacccgacgaggcagatccggctcgccccgatctgcgtatcgccgccgaggtctccccgaccgagcaggtcgccaagcgtcgccacctcgtctcgtggctggaacgcctgagcgcgagcgagcgcctcgccccacttgggcacccgggccccagcgtgccgtacgcccgcttcgatgggacccgcccctcgctcgcggtcgtggccctgcgcgatcccacgcttgggcgcggacgcaacgacgaggccgtcctcgagttctcctggggatcccttcgtcagctgatgccggtgaccaaggagctcgaggcgcgactcggtggcgggccgaccattacgcatcgcaagggttggcagcatgcgttcggacgcgtgccgcgcttcgcgctcgccgcctacacgccgccggatcacggctactgccgcaagctcatcgtcacgctggtgtgacgagcggtgaacggagaacggagaggcctatgacccgcataccagagtggttcggccgcctggaccccgaccccaacgcgcccgacgatgtccgcgcgcgcaacgacgccgtcgccgaacggaccggctttctcccgacgatctttggcgccctctcgtggcggccggaggagtatcgagccttcttcggctaccacgatgcgctcatggaggtcccgagcggtctcacgaaggctgagcgcgagctcatcgtggtcgcgacgtcggcgggcaaccactgcctctactgcgtcatcgctcacggcgccattcttcgtattcgggcacacgaccccaccatcgccgaccgggtcgtcgtcgatccagagcgcgcagacctcgacgaacgatcactcgccatcgtgcgctttgccttcaaggtgcgcgacgaagccaacgcgatcacgcccgaggacttcgcgccgctctacgaggttgggctcgatgacaccgacatctggctcgttggggcgatcaccgcgttcttcgctctctccaatcgtctcgccggcttcgcgaagatcctcccgaattccgagttctatgccatgggacgtacgccgcgaagctcatagcgcagcgaagtggcgtcccaccacgtcgtgcactttccgggcgccacgaaccccaagagggcgggccaccgggcgatcgctggcgtgtcagccaacagcgagccagaggagccacgcgagtggccccgacccgttccgactgtacccgcgtgctctggcaccatcagggcaggcgatgacatcgacgtcatccgagaggaggtccagctcgtcctccaagccctcatcgagcaggaggcagcagcagtcatcggcgctcgccgcgaaaacgagacgagggacgccagatgcagcgccacggtgagcgcagaccgtctgctcatcaccaaggccggcacgtggagctgcgtatccgcacggctccgccagaagagcgtgtcccgagcatcggcgagcgctggcgcctgtgtcgatcgtgccctcgacgccttggtcatggaggcctgcgtctgagggcgtcagcacccgcacggtcgatgacctggtcgcggccctcggtgggacgggggtcacaaggagcgaggtctctcgcatcgtcgcaacctcagacgaggagctggcggggttccgtcgccgcaggctggaccatcgctgcgttctgctccctcctcgccgatgccaccgacgcgaagggccgccttgcccaccgggtcatctcccgcgccgtggtgaccatcacgggcgtgcatgccacctgagacgcacgaggtcctcggggtcgtgcgtcggggacgggcagaccgagagcttctcgcccgagtactcgagggagctcaggggtcctgaggcctcggtggtgtgtgcctcgtcatctccgatgtgcgagcgcgggctcaccaccgccatcgcgaggtgcttcatcgggacgagctggcacaggtgccggatgcagcgtgcgcgacgtgctcgctcgcatcgaggaaggggagcctgggagacatgaacctcgcctcagatccgcacgatcgtcgctcgagccttcctcggcagcgctccgtacccaggacgaccaggtcatcgactcccttgccctcgaagctccccgcggttgtgaccgtgctcgccgaggccaaggaggaggtcgctcaccttctgagagcttctcggagggttgctggggaacgatctggtcgacgaacccgctcagagcgagtgaaccatgagatcaagcggcgcaccaacgtcgtcggggacttcggcaacgacgctgctctcctgaggctcgtcaccgctgtcgtgctcgagcagcacgaggactgggccgttgccgagcgacacggccgctaacaggagtgaatggcagagctcggggctgcaacgagccgcgacgacgacacggcgggcacctcgccgacgcttggggcccctggcgctccttgcgtgctggcgtcgctcgccgaggcggcacctgctgtgagaggaggaccagggagtgaactgacaccactcggtgggacgtgatctcgttgcccgagaacctcagaaccgctggcgggccagcgcccagtacggcgccgggcgatccggggtaagacttcccccctcggccagcctccgtggatctgctctggcatgtcgagctccccgcgctctgtgtggtctgccttacgtgtccatgctgatcagagtcctcgcacggcgggtgggctcgatggggcggccagcctgagtggttgcgattctggcgatttctacgattctggcgatttctacgattcttgcgattcttgcgattcttgcgattcttgcgatttctgctacagtgttgtcgtggtgtcaaccaaccaagtcggcaacgaagcctcgaccactctcatgcaccccaggccgggcgaagacgtcgtcctgccccccacggacctcggcccgctcgtccacctggctcggttcctggaagctcacaccgaaccagcgatgctccgtggtccagacggcgagaacatcccactaccacctgaggtctacacggtcttgcgccaggtggtcgaggtcatgcgacagggtaaggctgccctcatcgccccccaaggactactcctcaccacacaggaagcagcggatttcctcggcatcagtcggcctaccctcgtccgactcctagaggaaggggccataccgttcgagaagccgaaccgtcaccgccgcatccgcctcgaacacctcgtcgacttccagcatcgtcgctcgacagatcgtcgcgcggtcctcgaccaactcacggagcaagccagcgagctggggctctacgaggagacggaggccacctacgccaaggcgctgagggaggctcgtcggagcctggccaggaagaagatcgcggactgacgtcgtggctcgctacgcggtggtcttggacgcgtgcgtcctcgtgccggttacgctcgccgacactctccttcggctcgcagagctcgggctctatcggccactctggtccaagcggatcctcgcggaggccaccaaggccaccgtcgaggtccaccccaacatccctcgggaggtcctcgagcagcggttccgcgagatcgagcgcgcattcgaggatgcttgcgtccggggctggcatccgctcgagcacggcttgaccctccccgacccggacgaccgccacgtcgtcgcagctgcgcttgccggcggagcagacgccatcgtcacgaggaacctccgcgactacccgaggggcgccctcgccgatctcacgatcgaagtcactcaccccgatgacttcctcctcgaccaactcgacctcgcgccgaaggcagtacttgacgccatcgagcagcaggctgccaacacgcggcagccctcgctcacgccacgcgatgtcatcgcccgactggcccgctgcggtgtgcccaccttcgccgacaagatcggccgaatgatctgaccgaccggcacccgaaaccgagtccaccttcactgtcgaaccgacattctcacacgaccgctcactggtcccgctccgcttccgtgacgcagagcgcgccggacttctgacacctggtcaataccgcgcaagtccgtcgccgtccgcgacgtcatgctgattcagacaaaccagctcgagccacctcggacgtgaggcctcagtcgaatgagtgctcgagccgggctgcgcctcacgcggcacgcgggtcgtactgtgagccattggtcactcacgcaccgtcgagcgctcatgtctggcgcgacgagccctcgtgcgcgcccgcatcgctttgcaacggacctgcctaggagcgtcccgagcgagatccacgtggtcgtcgatcagcgccgacggatcgtcactcgccgctgcaagccgaacgatgggcaatccgagccgttcgaggcgtcttcgccgctcacgacaagccatccgctcacgccccggagacgtgctctctggtgagtcggcccctaggtgcaaccgaagcccaccacgcgcatgacagccgccaactcccggcgggaggcttcgagtccgtcaggccgtctcgagagcattgccgatacactggcgcggaccagtcggcgcaccgttaacccggccacccgcggcgacggacgacacgatcgccagcaggctcgtaccggtcaatcgagcgcacacgccactcgacctctcccagcggcccctctcaacaccgcgacgacagcgacgaaggccagcaatcgctcccctcccagcacgacgggagctaccagcgacgacgaccccacaacgacgagcgcccgagccgcggcaggatgcgaaacgccatccaccccatccaggcgaacgcaacgaccatgaggagcatcggtcgcaccatccatggtgccgttccaatgaacagcacggcggcatacaccaggagcaccgtcctgagaacgtgcgtccgatggcgacgctgcacccgtacgggagcttccgcagccacggggagcgtgcccggagccgtaacggggggaaggaacgggagcgcgtgcggaacgtcggtcacgagtgcgccgagatcacggtaggtccgcgcgacgtggagatgctcgagtcgctcttcgaactccatgggatcgagccggccctcttgaaacgctgagcgcagcacctcttcgaccgcatcgcggtctgcttgcgaacaccgcacctcgtcgaagtcgctcacgcagccatcgtatcacgaccgctcgtcacgcgtacgagagcccgaaccgaggatctcacggcgacctcacgagacgggccacccgtcacaggcgaggccgcggggcgcaggtagcgtggtgccgtgcgctcgttcgtccacctccacactcacaccgagtactccatgctcgacggcgcgtcgcgcatcaacgatctcctgcgtgccgcagccgccgacggccagcccgccctcgcgatcaccgaccacggcaacctctacggtgcgctcgagttctacaaggccgccacacgcaccggcgtgcgccccatcatcggcctcgaggcctacatggcggggggctcccggttcgagcgcccgcaacgtcgcggacgcctcgacgacacgggcggcgagagcgagcgaggtgagaagctctactaccacctcacgctgctcgcggagaacgagaccggttaccacaacctcatccagctctcctcgcgtgcgttcctcgagggctactactacaagccccgcatcgacttcgagctcctcgaggagcaccgcgagggactcatcgcgctcaccgggtgtctcggtgggctcgtcctccagcacctccttcgcggcgacgaggagggagcgcgcacggtcgccggaacgctgcgcgagatcctcggcccggacaacgtcttcgtcgagctccaagatcacgggctggccgaacagcgccgaaccaacccccaactcctcgagctcgccaagcacctcgggctgcggaccgtggccaccaacgactcccactacacgcaccgcgaggaccacgagacccacgatgcgctgctgtgcgtccagaccggcgcgaccatcaacgaccagaatcgcttccgcttcgagggatcggagcactacctcaagagcgccgaggagatgcgtgagcgcttccgcgaggtgcccgaggcctgtgacgcgaccctcgacatcgccgagcgctgctcgttggagctgacctttggccagccggcgcttcccgagatcgacatcccggtccggatcacgggtgcgacctacgacgagcgcgcaggtgagtacctcgccgagctggtctggcagggcgcgcgggcgcgctacggcaacgatctcgacgagaccacgagcgagcggattcgctacgagctctccgtgatcgagtccatgggctttccgggctacttcctcgtggtctgggacctgatccgtcatgcccgcgaggctcacattcgcgtcggcccgggacgaggtagcgcggcgggcagcgtggtcgcttactgcctcgggatcacccagatcgatccgctcgcctacgacctcatcttcgagcgcttcctcaacccaggccgcaagcagatgcccgacatcgacatggacttcgacgagcgctaccgaggcgagatgatccgctacgcggccgagcgctacgggcatgatcacgtcgcccagatcgtgacgttctccaccatcaaggctcgagctgccgtacgcgacgccgcacgggtccttggctacccgtacgccgtcggcgacaagatcgccaaggcgatgccgccgctcgtcatgggacgagacacgccgcttgctgcctgcctcgagctcacgcccggccacgaggacggctacgctcaagcggcggcccttcgcgagatggtcgagagcgatccggacgtggcgcgggtcgtccaggtcgccaagggcctcgaaggcctgcggcgtcaggacggcatccatgcagccgcggtggtgatctcgcgtgacccgctgacggagtacctgcccatccaacgcaagcccgatccaggccaggatccatccgaggcacccatcgtcacgcagttcgagatgcatggcgtggaggaactcggcctcctgaagatggatttcctcgggctgaggaccctctcggtcatcgatcgcgccgtggagctgatccgggcgacgcggggcgtcgacctcgacatcgacgccatcgccctcgacgacgaggccaccttcgcgatgctgcgcgcgggtgacgccatcggtgtcttccagctcgaaggcgggccgatgcgccagctcatgcgccagctcgccccgagccgcttcgaggacgtggccgcgctcgtggccctctaccgtcccggcccgatggcggccaacatgcacgtcgactatgccgaccgcaagaacggccgcaagccggtgagctacctgcacccagacctcgagccggtgctccgcgacacctacggcctcatgatctaccaagagtcgatgatgcgcgtcgctcagcagatcgcgggctactccctcgaggaagccgacaacttgcgcaaggcctgcggcaagaagatccggaccctcatcgccgccgaacgcgagaagttcatcgccggttgcgtcgcgagcggctacggacccgaacttggtaccgcactcttcgacatcatcgagccctttgcggactacgccttcaacaagagccacgccttcggctacgggctcgtcagctatcagacggcctacctgaaggccaacttccccgtccagttcctcgcggccatcttgacgagtgtgcgcgacgacaaggacaagttggccgtctacctcgccgacgccgcagcccaccacatcgcggtcctcgtgcccgacgtcaacgcctccgacgtcgacttcagcgtcacgagcggtcctgagggcgagcagatccgtttcggccttgctgccgtgcgcaacgtcggggagggcctcgtgcgctcgatcatcgacgagcgcacgcgaagcggtccgttcacgagctttgccgacttcttgctgcgggtcgatgcgagcgtcctgaaccgccgcaccttagagtcgctcatcaaggccggggccttcgactcgttcggacacccacggcgggccctctacgaagcgctcgagggcgcgctcgaacgggtcaacgagcggcgccgccagcgcgaccgaggcctcgggtccctcttcgaagagccctccgaggacgagagcgtcgtcccggatctgcgcctcgacatcggttcggtggagtggagcacgccagagctcctcgccttcgagcgcgacatgctcgggctctacgtctccgcgcacccgatgcacggcgtcaacgtcgaccggctcggacgggacgtcacccccatcttggatctcatcgaggccgatacgcctcccggcgaaccggtgacggtcgtcggggcgatcacagcgctcgcgcaacggacgacgcgcaagggcgacctcatggccaccttgcggctcgaagacctgcaagctgggatcgaggtcatggtgttcccgaagaccatggcagatcacgggctgcacctgaagcaggatgccatcgtcgcgatcaccggccgtatcgacggccgcgaagacggccgcacgctggtcgcgctcgccatcgagcccgtcgatacggccgcgctcaccagtgacgacgcggcggacggcgccactgacgcggtggtgctgcgactgcccaagcgcctcgccgtcccagattcgctcgttcgactgcgtaacgtgctcgcggatcacgtcggcacggcgcgtgcggtcctcgacatcgaaggcatgcgcttcgagctcgccagcaccagcgtccgccccggatcgagcctggtggggcacctgcgcaacgtgttcggagatcaggtccgtgtcgactgacggcccacgcatcgccctggtgggatcgggcgagtacctcccggcgatggcgcccctcgaagcgtcgctcatcggtcggggtcgcaactacgtccagattccgctcgcggctggccaagagagcgatgaacgcttcgcctactgggtcgacctcggacgtgagcaggccgcgcgcctcggcgtcacggcgcacacggtcctcgcacgctcccgagccgacgccgacgaccctcgctgggcacgtctcgtcgccggtgccgatctcgtctacctctcggggggcaacccattccacctcgccagcagccttcgcggaagccggttgtggtcggcgatcgtcgacgcgctcggtcgcggtgtggcgctggcgggctgctcagccggggcgatggtgctcggcggcctcatcggatcgctgcgctcacccacgcagcacgccgagcccgggctcggtgtgctgccggggaccagcattctgccccacttcgatcgagctcggcattggatgccgaccgagctgggggccgtcgccggcgccgaacgaacgatcggcatcgacgaactcaccgcgctcgtcggcgagggcacgacgtttcgtccctggggaaccgggcgctgctgggtcgtcgaggggacctcgacgacaccgatctccgacgccatcgacctgcccgtcgtcatccccgccacgtagccgcggacgaatcgctcagtggtggaaggactcccgcacggtcggatgcactggcggcggggtcccgtggcgctcgagcacctcgacacactcggcgaggtcatcgaggaacagcgttgccatgtccgcggagaactcgctgcgcaccacggcgcgcatcaccgtgacgtcgctcatcgcatcaggcatgggataggccggcacctgccacccataagcgcgcagctcgtgtgagaggtgattgaggtcccacggtcgcacctcacctggccgcagacgccacgccacgacagggatgtcacgcccgtcgccgatcacctcgaacggtccgagcgatgccagctcgtcggcgatcatgcgagcgactcgttgggcactcgcgtgcacggcggtgaagccctcgcggcccagtcgcaagaaggtgtagtactgcaggagcacctgcgcccccgggcgagagaagttcagcgccagcgtcggcatgtcaccgccgagataggcgacacgaaagatcagctcttcgggaacgtccgtcgcttggcgccatacgacccagccgagtccgggatagacgagcccgaacttgtggcccgatgcgttgatcgagacgactcgcggtaggcggaagtcccagtcgagctgtggctcgaggaacggcgcgacaaacccgcccgaggcgccgtcgacgtggatcgggatgtcgagacccgtacgctcgtagagctcgtcgagggcacgcgcgatctcggcgaccggctcgtagacccccgtgtacgtcacgccaaggatcggcacgacaccgatcgtgcgctcgtccaccgccgcgagtaccccgtcggcgtccagcgtcgggtgctcgggcgtgaccggaacgtaacgaggctcgacctcgaagtagttagcgaacttctcccacaccacctgcacggcggagctcacgacgatgttcggccgatccgtcggcgcccccgtggcgcgacgggcgatctgccaacgccgcttgagcgcgaggcctgcgagcatgcacgcctctgacgaacccgtggtggagacaccgatcgtggtgtcgggatcgggcgcatgccacagatcggcgagcatccgaacacagcgaccctcgatcgctgccgtctgcgggtactcgtccttgtcgatcatgttcttgtcgaccgcctcggcatagagacgatcggcttgcggctccatccacgtggtcacgaaggtcgcaaggttgaggcgcgcgttgccatccatcgcgatctcgtcgtgaatcacctggtaagcgaggtcgggaccgagaccatcgctccgcagccgtgcacgtggtacaccctcggtgagctcgcggacgaagagcggattgatcgggaggtccttcgagaacgtgtgtcgccgtggtgacgagtgccgtcgagccaacctgatcatctccttcggtcatccagcaggcaccgcccggtgctcccgatcacgtgacgtgagaggcgcgagcaacgctggaacccgctgcgaccctagcaagcccgtccggtgccggtcggtcagtgcgtggtcgatggcaggccggaccttcagcatgcgagcgctgcgccctctgcgcgatcgcggcccgcagccacggacggcaccgtgcgagcggccctgtgagcgcggcgcgagtcacgcaccggcgaacatggccgggagccgtcgtcgcgcggcgtgcgagcagcgtggcgagagttcaccgacgacaagccaccgctcacgcctcgtgatcgccgcggcggccatggacgtccgtgacgtcaccgacgtctcatgctcccctcgccagttcggcctggatccgggcaaggacctcggggtcctcgaggccggtgacatcaccggtcgccttgccatcgacgaccagttcggcgagcaggcggcgcacgatcttgcccgatcgagtccgcggcatcgtcgacaggacgtacaccgcgccagggcgcgcgatcggaccgatctcgcgctcgagcgccgcagcacacgtggcctcgtcgacaccggtggcgccggcggcaaccgtcacgaaggcgacggggacctggcccttcagtgcgtcactgaccccgacgactgccgcctcggccacacccggtacgaggaggagcgcactctccatctccatcgtcgagagtcggtgtcccgcgacgttgatgacaccatcgacgcggccgacgacccagacgtggtcatcgtgatcgaggagggcggcgtcggcggtgtcgtagcgttccgcaccgaagcgcgtgaagtactgcgcccgatagcgcgccggatccccccagatcgaccgcgccagcgtcgggaacggcgccgtgagcagcaggtagccgactcggtctcgacccaccgttgcgccttcatcgtcgacgacgtcgaaccgatgaccagggagcgccatcccgcacgacccgggcttggcgggcgtgatgcccacggcactcgaggtccacgccgaaccggtctcggattgtccgtaggtgttgttgatctccacagtgcccgtgccaacgtgctcacgcacccagtgccaggtcgtcgcgtcgagcggctcgccgacgagcgagatcagacgcagcgacgagagatcgtggcgctctgcccagctcgcgcccgctctcgcgagcatgcgcaagaacgtcggggcggtgaagaccttcgtgacgcggtagcgctcgatgatgtcgtaggcgcgatcgggctccggatagtccagcgcaccttcgtaggccagcatcgtcgccccggcggcgaggccaccgacgagctcgaagatcgggaaggtcagccatccggtgtctgcggtgcaccagtacacgtcctccggcccgaggtcgagcgcccactggacgttgtggtaggtcccgatgagaaagcccacgcctgcgtgcacgagccccttgggtttggccgtcgtgcccgaggtgtaaatgatgaagcccggctcgttcgcctcgaccggcaccggctccgctccgtccggatgcgcggcgatgagttcgtcccatgcgtgatcgcgccccggttgcatcgggacctcaccgtcgccgagccgacgcacgacgatgacgttgcgcaccgacggcaaccgatccaggatgccgtccaaggtctccttcaatgggatacgccgcccccggcggtaggtgccgtctgcggtgatcaccaccttggccccggtatcgacgatgcgatcgaacagcgcttgcgccgagaagccagagaagatgatgttgtagatggcgccgatccggtagcacgcgtggaccgcggcgaacgtctcgagcaggttcggcaggaagatcgcgacgacgtcgcccttcgtcacgccgagatcagtgagcgcggccgccatgcgtgcggtctcggaggcgagctcctggtacgtccagctgcgctcggcgccatcctccccgatccaccgaatcgccacgcgctctggctcgcgcctcgcatggcgatcgatgcagttcacgctcacgttcatacgagccccggcaaagaaccgaaatccatcggcaaggctgccctcgagggcgggggcttcgtcgaacccatcgatccactcgaacgtggctgcaaccgaacgccagtagcccccgagatcctcgatcgagcgttcgtagagcgctcggaactcgtcgacgttcgagaccggcagtcgaccagacggtgacagggacggctccaccagttcggcggttcgcaccatcgggggtagctctggcattggctcgctcatgggcagcacctccctcgctccacgctgggcggatgttaccacggcacggcacgcgcggcgaggacccggggcgcgacgcgccgtgcgaggcaggcggccgcggcgaccgctcgtggctcgctggtcgcgaggaactccacgccgagcgaccggtccccacgtcgtacggggatgctcgtggctgcaagcttcgccaggttcgccacgtgcactcgacccacctcggtggtgtcgtcgtccgtcacgacgacctcaccagctctcgtcctcgccccgctcgacccgacggtgctcggtgcaagcagcgcgtcgaactcgccggccacccgacgcacacgcgcgctcgccgctcggaccgcgttctcggcggctacgaatgccgccacgatgccggtcgcgacctcgcgagcggtgcgctcggtctgcgtcgttgcgatcgcctcgagcgcgcgccgtgcctcgacgagcgaccaccacggtgcgcagaacgcgtcgtcgacgtcgatgcattcgaccccgtccgcttccagcgcggaggcggcctcgtcgaggactgcgtcttcgtccgtgcgagcgcgtccgggcgtcacgcggccccagaccccgatccgcgtcggacgccactggccgagcgtgaacggggtgaggagccgtccccgcccctctgggtctcgaagcacatcgatggcccatgcagtctcggacagcgtcgcggcgacgacgccgtcgctcaggcgctcggcgtcaccgagcacccacggtcgcacgtgcacgctcgcgagtccgacgtcggctgctgccacccgcagcgacccgagggcatcggggaccaacgcgagcgggaccgcaccgagtgcgacccggctcaccgcagcgtcgaggacacgggtcgcgcaagactcgtccacgacaccgggatcctcgagagcaggaagcggccccgagcccgtcgtcgaccacacgcgaccgacaacgacggctcccagactccgggccctcgcgacgactccctcgccatctgacagacgagcatcgacgagcacggggacaccagcgagcgggcgagacggcgacggggcgacaccgtcgagcgcacgagcctcctcgagcgccgcgtcgtcgagcgacacagcgatggggtcggggcgttgctcgagggagcgaagctgcgcgcgagaggcaacgacgacctcgctcgcgcagcgacgtcggtggacgaggtcgtcgaggacctcgaagagcacgtgctcgacctatgcgccctgaatcggcgggaggctgccgtcagcaaggccctcggccatcgcccagccgaaggcgatgagcacgtcggcgtcaccctctttgcagcaggtgaacacctcatcgaaacccgtcggcgtcgcgtccgagagacggtagaccacgaaaccgaccggccgctctccgctcaccgcacccgaggtgcggtcgtcaaggccagaatcgagcccaaagcgcttggcgagccgtcgcgaccaggctcgctcctctcctgtcggacgatgcccgggtcgcggaaccacgtcctcaagaccagcaagcaggtcgtagccggtcggggagccgagcttggccgcgacgagcacatcctcgtcagggaacgcgagcagcgcgcgctcgtaggcctcgtggagcagactggccaaggtgaggggctcgtgctccttcggcgtcgtgaccgccagctcgatgagcacgcagggcgtgccgccgatacgttcgagggtgaagagcatcccgccaacgagctgctcatcatcggcggcgagggcacagagcacccacgcttctcgctcggcctccaagaactcaggggtcaaggtcacgccgtgcgctgctgccagcgcaccgagcgcgtgcagctcctcgtccgtcagtgcggtgcaatccttcgtgatcgtctcgatcgccatggcgctcctgctccctcgagtcgacggcccctccagtttacccgccctggcgtcgcggcgagggcgatgccacccgcgccgtaggctgggatcgtggacgactcgatcacgctgcaggcactgggttcatcgcggcagacgtatgcctacgacgaccctgacccatctgtgctcgagaccttcccgacgccacagccctccggcgggctcgtcatccggctcttcgccctcgagttcacgagcctgtgtccggtgaccggccagcccgactatggccagctcgacatcgtctacgtgccggggcctcgttgcgtcgagtcgaagagcctcaagctctacctcatgcgctttcggaaccacggagccttccatgaggcctgcgtcgcgcaggtcgcgcaggatcttgcctccgtcctcgctcctcgctatcttcgggtaatcggccgcttcaacgcgcgcggaggcatcgcgatctggccgctccgtgaggtcgtcgccgaccacgaggacccggctgccctccgagcgctcgtcgatctggacaacggagcgcgtccatgagaggcatcgatcgatcgcgtctcgcactcgccatcgcgggtgcggcggtctacgtgggatccatcgtcctcgccaactggatgctgctccacgtcggcgctccgggcccgggggcacgtgtgctccccgtgggcttcgggctcgaggccccgagtggggtctacgtcgcagcactcgccttcatcgcgcgcgatctcgtccagcgctacgcgggtccgagggtcgccgtcgcggccatcgtcatcggagcggcgctctcagcgctcgtctccacggcgacgctcgcgttcgcatcgggcgcgacgttcctcttgtccgagtcgaccgacttcctgctcttccaaccgctccaacgtcgcacgctccccggcgcggtgttcaccgctggactcgcagcgatcgtggtggactcggtggtgttcctcacgctcgcaggcattccgctccacgctgcgcttccagggcaactgctcggcaagttctggatcgtcctcgtgggcagcgccgccaccatcgggctgcgacgcgtgacccccgcaccgtcgcttcgtcctcgcgccgcgtcatgaaccacctcgaccaccgtcagcgaacgctcggcatcatcgccctcgctggtgcctcggcgatctggggcggcatgtacgtcgcgaccgccgccctcatgcgccagaccccgccactcgtcgtcctcgagctgcgcgaggcgatcgcaggtttgatcctggttccgatcgcatggcgatcagggcggttgcgcatcgctcgcggcgacctcgcccttgcggcagcgatcggcatcgtgggtttcaccgtctcgatcggcctgcagctcgaaggcacgcacatcgctggggccgcactcggttcgctcatcaccgcatcgtcgccggtgctcattgcgctcctcgggagggtctggctgcgggagcgactcccatggcccaagctcgtggcgatcctcgtcgccgtcgggggtgtggcgctcatcgccggccatccgccagggggaccccaggtcgagcccgggatcatcgacctcgcaggggcggccctcgcttgggcgatctacacggtcggatcggcgcacctgacccgccgctacgacgccctcggagtcttggcgatcgcctgcatcgtcggctccgtgacgagcctccccttcgcactggcgtcggccagccacgcagcgcatccgctcccgacgacgctcgtggcgtggctcgaagtcgcctacatctccatcgcaggaatggcgctcgccttcttcctctggaactgggggttcggtcgagtcgatgccgccgtcgggggatccatgctgctcttccagccgctcgtgggcgtcgtcctcggcatcgtactgctcgcagaaccgatcactctcaccctggtgttcggcggcttcctcgtcgtcgccggcgtctcaggagccgtggcgatcgccacaccgagagtccagcttgcgacgaacgcgtcacctgaggcaccccagtcggggattcgcacgtagccgtcaccccgtcaggccccgaccacatgctcgaccgagttcgcgacgctcgcgagaccacgccggagcgggtacggccctggctcggagcacatcgtccttgtcagcgagatcggagccatctcgcacgagcaggacggaacctacggcagccccaggatgacccacgagatgcgactcgtggcggctgcttcttcaaccaccagtgcccgtgaccggccctgcgaccgagtccaccctgaaggcgagacttgacgccctcccgccacggctcggtcacggcgggcgccgatgaccgagagcgcgtcgagcctccgactcccggacgcgaggatccgtcgctgggtggcggcgtcggggtggcagcgcgtggccgagctgaggcaggcgacagatccgtgggctcgcgtcgtgttggcgcgatgccgttcgtgtgcgacgagcgcccggggctcctgcacggcggcggacggtccccgtcgagcacctcctctcggacctgggcgttcagcggcttgcctcgcagaggccgcgctgccacggcgatgcggcatcggggagccacggagtcaccccgagttccgctgctcagtgagcgagcacgcccgcgacggacaggcgcaaggtggagagcgggtcggagtggccaggtcggacggccatgttatccgtgacgaagcggaccgtgacgcccttgtcattgagctgggggacgagggctcgcaggtcgtcgaggttgcgcgccgaacgatccagcgagtggacgacgacctcgtcgccctcgcggaggtaggcgatgaggtcgcgcagggccgggcggtcgacccgagcgccggagacgtggtccacgaagacacggtcggtgtggacgccgaccagctggcgctcgaccgaccgatcaaccgaactcacatgaacgtagccgacgacccgccctgaggcctcgctcacgagagcgcgcctaccctcagcgtgagccaggagacgagtgccacggtcgggagtggacggtcgcggcgacgaaggctcgcaggtggtgggccaacgtctcacggtcgatggctccctcggcgaccttccagacgaggtcctcgagctcgttgtcggacgccagcagcacgtggccgttgagccggacaaacagctccgtcgtcacgaccgcacagcgcttgttgccgttggggagtgggtggttggcgaccaggcgctcaagcagcaccgcggccttggtaggcacggtcgggtaggcctccacgcccccgaggccggctcgaggcgctgcgagcgctgagtcagcgagttgacctgccgggccagcgaggatcgaccttaccgtggcctcgtcgaggccgagcgtggcctgcacgacgacggcgtagtcggcgaggtcgaggtagcggaccgtcacatcgtggcgaggcgctcgaggagccccttgcgctcctcgatgatgcctcgtagcatcgccaagtacccggggtcggcgcggcgctcgcgcgcacgagcgatgacgtcgtcgatggtctcgacgggcctgggtgcagcctcgacacagcgggtgaggtcctagctggccatgatcgaacacaccccctccctgcgccgacgtccgccaactcatcgagccgatgtcagcacaccgtagcagaacgagctggggggcgtcggcggctgctgtcgcctttggtctacaacatcgccgcgacagctgtcgccacaggaggagtgaatcccacggcgacaggatcccgtggggagcgcgagatcgcggccggtacaccctgaggcgacgtcggtggaagctcattgctgggggcgaccatgtcgtcgacgagtttgcataccttggtcgagcgctcgaggcggtagtcaagttccgaccacgcctcgccaagttcctcggcgcgtcggccctggtagctcttgatgaagcgcccgacgcgggcgtcgaactggatgcgatcgccaggctggagctcgaggcgcgcgagcgacgcgccgtacgtgaaccagaggtggtccgtgactacctctcccgtcgtgacgagacggacatcgaggagcagaatcgagcgctctggccccatccagccaggtttggagtcgaagagccctacgtcgcctcaaagcgtgatcgttgtccgacgtgtcgtgccagtcgttccctcgtgtccgtcccattagggcgggcctggcctatatctccccgggcaagaccgatgcgctcgctgcgcggccgtcctcagggatttccatctgcgtccagggctcgtcacgcacactctcgcgagccacgaggtcaaagagggcgtaggcaagggcgcagagcgcgtagcgggcgatcgtgcaagcgtcacgtgtggagcgtggcggcacgacgatctctgccgcgttgtcatcaagcacgccaacggtgatcgcgtcgtcgtccggtcgctcggcaatcctcgtcgtgacgaggcgctgggtccactcaccgaacacgcgacatgcgatgcccgcctcgtcgcagagggcctcgatcgtccgcgcaccgtcgagatcgatgtgctcgacgtagcgaggcgccggccagaacgaggtggccttcttgcgctccgagttcgacgagtgcggcaagagccgctcagcggtagaccgcgcgctgcgcgccctcgtcgacgaggaggtgctcgtgcgcggcggctggggcatctacgtgcgcgcgaggcgcgtcgggcatcgctgctcgcgccgaccggcacgatcggggcatctacgtgcgcgcgaggcgcgtcgagtacttcggcaggaccggcatcggcacggcggtgatcttcgatcgccggtaccccgaggtgctcgccaagctcggtgtcacttgggaggccgacagcgcacgcaaggcgtacaacgaggggcgcaccacccaggtcccggcctggaccgcggtcaacgtcggccgccagcgcatcaccaggcggatcgcgttcgggaagcgagtgttgcagtatgagcggaccacggggactcgacgacggaacgtggcgagcgctcgaggaggcgcgagcgaacggtcttcttccgctacttcctgagttcttcgagcagaactcgcccgtctgaacaggaccatcgacttccgggtggtgctgccggacgacctgcccggcaccaaccactgccgcagctacacggtgtgctggaatacggcctgctcgagccgacggaggcgctcggcgacgctcagctcgccccctccctcctcggtgcggagccgatcgagtgcccagatgcggagcagcgtggagactggtaggtgctcctgagcggcggcccgttggagccgggcatgctcgtcagcggacaaccgtaccgacaccacggttgggcgagtgaggttgggccgtgcgaccgtgatgtccgtgggcatcgtgtcggcgaggtcgtgctgctccgccgctgccccctcttcagccaggatttcctcgatcttgctgctcatcggtcctcctccgcgtagatccgtcgatctcgtgggcctgcgacccaggcgttggcgccccaccactccccggcaggccgctccgtctcgtcgacgtcggcggcgaccaggatcacaacgaggacatctcgagcgctcggcgagtagccgatcactcgtaccgatcgaccgctccggctcgcagggtccggcgtgagccagaccgcatggtcctcgttgatcgcttcgtcagcccagcctggttcgatgccgtggcgtgagcggatgtaggcggctcgcttctgccagtccactcgcaccacacctacatagtactacactcgactacgcttggtggctcggcgccgaccgtgagaggacggttgtgaggttcgcggcagcagtagcacccgctcccagggagcggctcggaggtcgtcacggcgcagctaccactcgtagagtggcgtcccaccaggtggtgtaatttccgggcggcctgaactccaggagggcgggccaccgggcgatctctggcttgtcggtcaagagctcgccagaggaggtacgcgagtggccctgactctttccgacttcacccacgtgctctggcgccatcagagcaggcggcgacatcgacgtcatccgagagggggttcagctcgttctccaagccctcatcgagcgagaggctcgagcggtcattggagctggccgcgacgaacgaggcgagggacgccagacgcaagcgcaacggtgagcgcgaccgtctgctcgtcaccaatgctggcgacctggagctacgcatccgcaaagctccgtcgggggagcgtgtcccgagcatcggcgagcgccgccgcctgcgtcgatcgcgtcctcgacgtgcgtggtcatggaggccgacgtctgagggagtcagcacccgcacggtcgacgacttggtcgcggccctcggtgggacggggatctcgacaagcgaggtctcccgcatcatcgcatccctcgacgaggagctggcaggatttcgtcgccgcaggctggaccatctctgagttctgctccctcttcgccgatgccacctacgcgaagggtcgcctcgagcaccaggtcatctcccgtgccgtggtagtcatcaccggcgtgcacaccgccggggaccgcgaggtcctcggggtcgtgcgtcggggatgggcagaccgagagcttctggaccgagtgcgagagggagctcagggatctcgggcctcggggtgtgcgcctcgtcagctccgatgccagagcgcaggctcaccaagccatcgccaggtgcttcgtcggggcgagctggcacaggtgccgagtgcagcgggcgcgacgtgctcgctcgcatcgaagaaggggagctcgggagatggacctcgcctcagatcccaacgatcgtcgctcaagccgtccccaggagcggtacgtacccgctacgaccaggtcatcgactcccttgccgcgaagctcccagcggttgtgaccatgctcgccgaggccaaggaggaggtctgcaccttcacgaacttcccggaggcccattggcgaacgatctggtccacgaacccgctctgagcgggtgaaccacgagatcaagcggcgcactaacgtcgtcggggtcttcggcaacgacgccgctctcctgcgccttgtcaccgctgtcgtgctcagccagcacgaggagtgggccgttgccgagcggcaatacctatcacaggagtccatggccgagcttgtgactgccacgagcgacgacgacacggcgggcacctccgagacgcctcggccccctagcgctcctcccgtgctgccgtcgcccgccgaggaagagcctgcagtggtaggctgagagcggccagggaacggatttacaccactcggtgggacgtgatccatcgcaccctgctgtcgcatctggtccgagatttcaccgcgatagctgtcgccacaggaggcgcagatcccacggcgacaggatcccgcggggagcacgggattgccccgccggtacgtcaggagacgaagccggtgggcgcgtcgagatggcagcttcccgggtcgggcgtgatccgggagggggcgtggggaggtcgtcgggcgaggatgcagcagtgctcgtcgctgcgcgaccagtcccgcctcgtcgaccaccacgactcggacgcacgcaggcaatggagtctcgaggagatcgaaaccgatgggcgaccgaacgcgaccgctcgacccggcctcaccgattgagcgcaccagagctgcctaggccttctccggggttgcgttcctactcatcgacgagaaaacgccacgcgagctcgcccccgcggctcagcccgattcggccagtcgccagaacacccgtcctgcgttcgtcggccggctcgaggtcgaccgccccgccgagcacgaggccattgtgctcgcccgtcatgccgagcgctcgtgcgacccgccctggaccgagcactcgacgcccgtcgtcgagctcgatgccgcgcacgaggacggcacctggcactccttcgggtgccacgacgatgttcaccaaccagtgcaccccgtagcacaggtacacgtagaggtggcccggaggaccccacatgatctggttccgcggtgtcgatcctcgccacgcatgacttcctggatcctcagcgccttcgtacgcctcgacctcgatgagtcgacctgcgccgagcggcccgacgagacgtgcaccgaggagccgcggagcgacgtcgtgtgccggaccctcgagcagctcacgcagggcgcgtgtgcctgagtgcatggaggcgctcccgacgctcgccgagccggacgcgcagctcgtcgagctgacgccgcaccgactcaagactcgccatcccgttcgcgccgcgccgctcgatcgcctcgtgagcctcgatgaggcgcaccgcctcctcgccgagctgcggatgcgccgccacgagctcggcgagcgcgacgtggcgctccagcgagtcacgcacgagccctgccgccaccgcatgcgcacgtcgaaagggcatccctcgacgtaccaggtactccgcaacatcgatcgcttgcaggtaggccgatgacgccgcctgtcgcatggcgtcgaagtcgaacgtcatcgtcgcaagcagcccctgcatcgccgacagctcgaggcggaactggtcgaccgcgtcgaagagcggctgcttgtcctcctggagatcccggttgtaggtgagaggcaaccccttcaagacggtcaggatggtcacgaggtcgccgatgtagcgaccggccttcgcgcgcgagagttcggcgatgtccgggttcttcttctgcggcagcatcgacgagcccgtggcgtaggcgtcgtcgaggcggatgaagcgaaactcctcggtggtgaagagcacgatctcctccgcgagcctcgacaggtgcacccccgccatcgtgatcgcaaagatcccctcggcgacgaagtcccgatcgctgaccgcatcgacgctgttcgcaaacgaacgcgagaacccgagccgggccgcaacccacggtgggtcgagcggcaaggtcgaacctgccagggcaccggcaccgagcggcgagacgtccatgcgcacgagtgcgtcgagcactcgggcgatgtcgcgctcgaccgcccaggcgtgagcgagcaaccactgtgcgaccgggatcggctgagcgcgctggagatgcgtgtagcccggcatcactgcgctgcccgcactctcggcgagctcacgaagcacgtccgcaaacccgatgagccctccggcaacctctgccagtgcgtcacgggcccagagccgcagatcggtcgcgacctggtcgttgcgcgagcggccggtgtgcagcttggcgccgacgtcaccggcgagctccgtcacgcgtcgctcgatggccgtatggatgtcttcgtcggaggggaccacgacgaaggtcccctcgccgagttcggcctcgacggcccggagcgccccgagcagcgtctcgagctcatcgtcgtcgagcaagcccgcgtggtggagtccctcgacgtgtgccctcgagccctcgaggtcctcgcgccagagacgctcgtcgatcgagaggctctcggtgaacgagagcagggcatcggcgggcggcgcacccatgcggtgctgccagagcgtcacggccgcagccctccctggcgttcggcccaggtacggatcccgagcccgaagatccgtacgaagccctcggcgtcaccatggcggaaccgatcctcgctggcataggtcgccagttcgtagtcgtagagcgacgaggggctgcgacggccatccacccagaacgcgttcggcgcaaagcgcacccgcacctcaccggtgacgggcttggacgcttcgtcgatgaaggcgtcgatggcgtgcttcaggggcgagaaccacagcccatcgtagacgagggttgcccaccgcagaccgagttcgatcttggcgtgcgccacctcgcgctcgagggtgatgtcctcgagctgccggtgcgcctcgagcaacacgaccgcggctggtgcctcgtagacctcccgcgacttgataccgacccgtcgattctcgaccatgtcgatccgaccgacctgccacgatccggcgatccggttgagacggtccacgagagcggcgagcggcaggcgctcaccgtcgagcgacaccggcacaccctgctcgaaaccgatgacgacctgatcggggagcgacgcaaggccacctgcggtgtaggcccagacgtccgatggtggcgccgcccagggatcctccatctcaccgcactcgaccgcacgaccccagaggttctggtcgatggagtatgggttctccttcgactgggtgagggtgaccccgtgcgcgcgcccgtactcgatcgtgtcctcacggttcatgccccaatcacgcacgggcgcgagcaccgtgagatcgggagcgagtgcggcgagcgcaacctcgaagcggacctggtcgttccccttgccggtacagccgtgcgcgacggcgctcgcaccgtagcgccgggccacttcgacgagccgctccgagatgagcggacgcgacagcgacgagacgagggggtagcgattctcgtagcgcgcgtccgccttgatcgcacgcgcgatgtagtcgtcggcgaaggcgtcacgcgcatcgaccacctcggcggcgatcgcgccggtcgcgagggcgcgggtccgcaccgcctcgaggtcttcctgctggcccacgtccaccgagagcgcaacgacgtcgaaaccacgctcgacttggagccacttgagcgccaccgacgtgtcgagaccccccgaataggccagcactaccacttcagccacgagtcgactccttgctgttccgtcttgtcttcgtcctgtatcgagcgcgctccgtgcgacctggcgccacgaccaggtcgatcccgtcgatcgatccgagcagagccgacgcgcgcagtcacgggagccagatccgcgccgatgcccgcgtcagcctaacctctgggttcgcccgggagtccggcgaggttgtgcagcaacgcggcgacctccggggcggtcgagccctgcgacaccacgatgagcagggtgtcgtcacccgccacggtgccgagcacgccatcgggcttggcgcgatcgagggcagcggcaacgacatgcgcgcaccccggcggggtcttggcgagcacgagatccctcgcaaccgcgacctccacgagccactccgacagcacgcgacgaaggtaatcctccgacgtggtctggtcccgcgggagatccgggatggcatagacgctctgaccctgcggaccacgaaccttgatcgcgccgagctcgtcgagatctctcgatacggtcgcttgcgtggcggagatgccctcgacggcgagtaggtcgacgatctgctgctgagagctgatcgcctgctgactgatgagcttcgcgatccggtactggcgctggttcttcgcgaccatggcgatcaccaccgctcgatcgagccggagccggcacgatcgacgaggaacgccaacagtcgcaccatggccgtcacgcgatggccggcctgacgaaaggcccacgagtgcgggccgtcgaggaccgacgcctcgatctcctcgccacggtgcgccggcaaacagtgcaagatcccaacctcgtcgctcgcctcggcgaccaacgcctccgtcagggcccagccctcgaaggcgctgcgtttggccgggtcctcgcccatcgagacccacacgtccgtggagagcacatcggcaccgcgtgccgcactcgtcggcgagtcgaacagcgcaatcgccccccgcgcccgccctgcacgctcgaggtaggcatcgatctcagccatgtcggcctcggagaactgaaaccccgccggcgccgcgatgcgcacctcggctccgagcgcgccagcggccttggccagcgatcgagcgacgttgttcgcatcgccgatccacgcgatccgcacaccctcgagcgtgccgagcgcctcgtggatcgtgatcacgtcggcaatggcctgagtcggatgcgcgcgatcggtgagcaggttgacgaagggtcgctgatgcccagcgaacctgggagccatccgctcgaacgtggcgtgacgacgaagacgcgccccaaccacccgatggtgacgcgccagcacctcggcgacgtcctcggccgcctcccgcgtatcgatcccgatctcgtcgccggtgaagaacacgggcgtcgccccgagcgcagccgcagcgacgccgagcgccgagcgagtgcgcatgctcggatgctcgaagacccctgcgatggtgccgcctcgaagcggcccgctcgctgcgaccgcctcggtgacgaggcgccgcatgtcctcgggagcaaggtcgtctacgtccccgaccacgagcgacgtcgcgcgctccatgttcagacctcctccaggacacgggccagggcacgaccgaggcgggcaaacccctccgcaagctcgtcggccgtgatgatgagcggcggcagcagccgcaaccgcgtcggaccggtggcgttcaccacgacgccctctgcgagcgccacgtcgacgacgcgcgctgcgaccggagcggcgagttcgaggcccaacatcaggccagagccctcgacgagccgtaccccaggcagcgcccccgccaacgcgacggcctcgtcacctcgcgcgcgagcaagcgcgggcgcgtcaaggcgaaccagctcgttcgccaccgcctcgacgaccgccatcgcgagggcattaccgccgaaagtagagccgtggtctcccgggcgtagcgcctcggcgaccggcgcacgggccacgaccgccccgaccgggtacccgttgccgagtgccttggccagcgtgatcacatcgggctcgagcccgaccacctccgaaccgagccacgcacccgtacggccgaggcccgtctggacctcgtccacgacgacgagcgcgccggagacccgccgtgcccgctcgatcgccgcgatcgccgccgctggcagcggatggacgccggcctctcccgcgatcggctcgacgaccacggctgccgtcgcctcgtcggcgacctgcgcctcgagcgcagccgtgtcgtgcggatccacgtgcacgacgtcgggcaccagcggctcgaacggcgcttgcttgtcgggctgacctgtcagcgagagcgagccgaaggtacgcccgtggaacgcgccggtcatcgcgaccacgcgggtcctcggagcgcgcgcacgccggacgagcttgaacgccccctcgaccgcctcggtccccgagttggcgaagaacaccgacgcgtccccgagcgaggcgagcggcgtctggagcgcggcgagcgcgcgctcgcgcgcgtcagtgtcgaagtagttcgacgcgtgccacagacgcgcagcttgggccccgagggcctcgacgagacgcgggttcgcgtgaccgagcgacaccacggcgatgccggcaagcaggtccacgtagcgctggccgtcggcgtcgatgagccaggagccctcgccacggacgaaccgccgcttgggctgcccgtagacgccgatgagcccgagcctcgtcatgacgcgctccgacggatcatggttccgacccccgcatccgacaacaactcgacgagaagcgcgtggcgttcacgaccgtcgacgaagtgcacctcgtcgaccccggcctcgagcgcggcccgtgcggcagcaagcttggggaccatgccgccccgtacgctgcccgagctgagccaatcctcgagctcgccgagggtgagttcggagacgacgctcgccggatcgtctgggtcggcaagcaggcccgggacgttcgacaagaacacgagcttcgtcgccgagagcgccggcgcgagggcggcagcgaactgatcggcgttgacgttgagttcacggccctcgtcgtcggcggcgagcgacgccacgatcggaatcatgccgtgtgcaaccagcgcctccacgaggtcggcacgcacctcgaccacctcgcccacccgaccgagcgacggatcgacgacacgcgcacgtgcgagcccaccgtcgacgcccgagaggcccacccctctcggcgctccggagacctggttcacggcgcgcacgatggtggggttgacggcaccgagcaggccgagcctcaccacctccagcatcgcgtcgtcggtgaccctgaggccgccgcgacgctcactcgacaccttgagtcggcgcgcgagatcatcgatctgcggacccccgccatgcacgaggaccgggtggatcccaacgtgagcgaggagcacgagatcggtagcgagcgaggcgagcgaccccgcctcgtcgccgagcacgttgccaccgtacttgatcacgaccgtgtgacccgcgaagcgctggatgtagggcagagcctcgacgaggatcggggcgcggagacgaggatcgaggtcgatcacgaggtcctccggttctcttcgaggtaaccgtgaccgatgtcgctggtcaagacggtggcgctcgccgatccacgcccgagtgcgacggcgaggtcgacctccggttgggccatccgccgcgtgagctcctcgtgctcgttcgcactccagccgcctcgggcctcgaggccaccctcggccacgagcatcccctggtaccagatgcgcacaccgctcggatcgacgccgcgtcgcgcggcccccacctcggccaggacacggccccagtagggatccccgccgagcaacgacgccttcacgaggagcgagtttgcgatctgtcgcgcgatcaggagcgcttcgtcctcgtcgcgtgcctcgagcacgcgcaccaccccgacgcgcgacccaccctcggcgtccgcaacgatctggtgcgcgagctgcgcacagacctcgcggacggcctcttcgaactcctcgccaggcgagcgtccccgaccagaggcgagtgcgacgaccgtgtcgttggtcgagctgcatccgtcgatcgtgatccgattgaaggtcgtctcgaccgccgcgcgcagcgcagcgtcgagacgctccgcctcgaccgccgcgtccgtagtgatgacggccagcatcgtcgccatctgaggcgcgatcatcgccgcacccttggccaagcccccgacgcgaaaaccatccccctcgacgagcgcggtcttcggatgggtgtcggtggtcatgatggctcgagccgcggtctcggcgctccgctcgtccactccgaccgacgcagtgagggccccgaagcccgcgagcgccgcgtcgatggggaacgagatcccgatgaggccggtctgagcgatgagatagtcctcggcccggcctccgaaggcgtgggctgcagcctcgaggaggcgccgagcggctgctcgtcccgcttccccggtggcagcgttcgcgttgcccgaggtcagcacgacgccacgaacgcggcggcccgagccagcgaggtgcgctctcgacacctcgatgggtgcggctggcgagtcagtcgtcgcgaacaccgccgccgcgacgaccggctcaccgtcggccgatccgacgaaggccgcgtccaacgcgccgcccgccttgatgccgatccacgctccacctgcacgaaagcctgccggcgcggtcacgctcacggccacacccccaatccctcgagcccgagtacttcatccacaccgaccatcaggttcgcgccctgcactgcgtgctgcgccgcgcccttgccgaggttgtcgatcacgctcgtcgcgacgatcacgccgacctcgtcgtcgaccgtggcggccagcacggctcgattggacccccgcacctcacgcgtcgacggaggcgtctctcgcacctcgacgaagggcgaggttccataggcccgagcgaggacgtcgcgcaccgagtccgcatcgacggttgcgtcggcgaccggcagcgtgatcgtcgcggcgataccgcgtgaatagggcccgagatgcggcgtgaagcgcaccgggaccccgagcagcgagcgcatctcgggcgtgtgtcgatgccccccgagggcataggcgcgcactccctcggcaacgttgacgaaatgcgtcgtctccgtggctgcactgcccgcgccggtgacgcccgagatcgcgtccaccacgacgaggtcacgacgagcgagaccagcgtcgatcagcggcttcgcggcgagcaccgtcgcggtgacgtagcaccccggaaccgcccagacctgtgcgctcgcaagctccgtgcgcacgtgctcggcgaccccgacaacggcagacccgaggagctcgggcgcggggtggtcgtctccgtaccagcgccgccaggtcgcctcgtctgccaggcgcaggtcggcaccaagatcgaccacgcggacaccccgagcacggagttctcggatgatcccaccactgtgaccgtgtgggagtgcacagaaggcgagttcagcggcgacggcacgaggatcgatgggctcgataggccgctcggccaagtcgacactgaggccaggcacgagctcgcccaggcggcggccagcgcgctggtgggcctggaacgcgacgggctcgaagacggggtgccgcgccagcacccgaacgagctcttggccaacgaagccgcttgcgcccaccaccacgacgtccatgtcgagagtctatgtccactactgcataatcatgcgcaccctgcccgaagaatcggcgccgagctaagcttccttcgatcgagggaggcgcccgtgggtccgttcgtcgcctatgaacagttctggctgcgctacgtcgacttccgaggacgctcgagccgggccgagtattggtgggtcttcctcatcaacctcgttctcgagctgctcttcaccttgggtgcacgctccacgtcactcgtcagcgatctcggtctcctgtatgggctcgccgccatcatccccaacctcgcgctcgtcgttcgacgtctccatgactccgaccatcgcggctggtggatcttcatcgcgctcgttccgatcgtcggcgcgatcgtgttgctcgtcttcgaactcctcccgggcaccccagggccgaaccgctacggggatccgtcgacgccggttcgctctccccggttctagatcggctatatcagcatgggaacgcttcgctagaactccagctccccggctgaatggatcgttgctgagaacgaatccactcgcgtcggagctcttccccgaacgaaccgcccgacggcgggtagggtgggcactcgtgcgcggttcgtcgggcctgagcggggccacctcgcgatggctcgaacgcttcgaagtgcttgcagtgcgagccttcggcgccgacacgctcctctacggcgtctccgcagtcatcgccgggctgaacctcgtcgtcgcctccgggggcgactaccgcgcctgggcgatcgtcgcgacaccgctctatgcgatcgcagcactcgccagcctccttctcgaccggatcggcgacgtcgagcaagcgacgcggtggcgtcaccgtctcgtgctcatcctcctcgtcggcgtggtcgtcgtgccgctcggcgatgcggtggcagcgcgcgcccttgcgctacccggcatccacgcccaagccgaggtcgtcgtgatcgagcgctgcggcgaccgcgtgctccacggccacgactgctatctcacccacccgacgaccgctggcagttccgtgtcatcggcgtcgcacgcactcgacgcgaacgcgttcgtcccctacctccctgggatggccctcttcggcctcccgaacggcctccccctgccgaccgtgctccgcgacgcccgagtctggatgagcaccttcaccgtggcggtgctggccttcggcgcgtggctcgctcgactcgcgcctgcacagcggtggcgcctcctgctcctcgtcgtcgtgctccccgcaggagccctccccatggtcaccggcggcgacgatctccccgtcatcgcgctgctcgcgaccggcctgctcctcgtcgagacgaagccgcgcacggcggggatcgcgctcgggctcgccacggccttcaagctcaccgcgtggccgatcgtcgcactcctgctgctcgttcgcgatcccaccgtgaatcgtcgccgcctcatcccgccgatcgtcgccatcggtggcggcctcaacctgctcggtgccgccatcaacctgcgagcgttcatcaccaacgacatccgcttcccactcgggcttaccagtgtgcgctccccagcgcagagtcccctgcttggccaggcattggtgcagctcgcaccgagcgagcaccgcctgatcgtggtcggcctcgtcgccatcggtctcgcgggcacggcgctgctcattcgagcggcttggccgctcaccgtcgatcgggcgatcctcgtggcagccctcgtgctgctgcttgccacggtgctcgctccgcagacgcgcttcggctacctgctctatccgttcgatctcctcgccgtgctcgtgctacgtcgaaccacacgcgtgccgatcgacagcgaccagatcaatcccgacctcagacagacagcgctcgcgcgactagagcgctgacaggcagactgcgcggccacgactggaggcgcgtcgccgacgtgtcactcagtcgtcacgaatccgggccgggacgacgcccacgacgaggcagagtcgaggcgtggttcgcgttcgtccctcgactggaccagactcacgggtcgatcaaccgtacgacgagttctacgacgccgacgggtgcgttcggcccgtctacgaacaactcgctcgcaccgtcgcgagccttggcgcagacgaactcgcggtgcgcaccatcgagcgcgacatggctcacgccgatcggggcgtcacgtacgatcaccaaggggtcgaggccgtcttccccttcgatcccatcccgcgcattctcaccgagtcggcctggcgtcacatcgcagctggcgtgcgacagcgcgtacgcgccctcgaggccttcctcgacgacgtctacggcgcccagcagatcctcgccgacggcgtcatcccgagggcactcgtgctgcgctcgacacacttccgccgcgaggtccacggcctgcgacccgcgaacggcgtacgcgtccacgtcagtggtgtcgatttggtgcgcgacgccgacggcaccttcctcgtgctggaggacaacctccgcgtaccctcaggcgtctcctacgcgctcgacaaccggcgcacaacgacgacgcgtttcccagagctcctgcgcggctaccacgtggaatcgatcgacacctacccgtcgcagctcctcgccgcccttcgtgcgagcgctcccgacggggtcaacgaccccaccgtggtcctcctcacacctgggccctacaacgctgcctacttcgagcacgcgtacctcgcgaggcgcatggggatcccgttggtccaaccctccgatctcatctgcagcggcgggcgctgctatctccgatccacgcgacgctcgaacgaggtgcacgtcatctaccggcggatcgacgatgcctacctcgatcccgtcgcctttgatccgacatcgctcctcggggtcgccggcctcatcgtcgcggcgcgtgagggcaccgtcaccatcgcgaacgccgtcggcaacggcgttgccgacgacaagctcatcggcacgtgggtgccgaccatgatcgactactacctgggcgagcagccactgctgggcatggtgccgacctaccgcctcaacgatcccgacgaggtcgcctgggtcatcgccaatctcgaccgactcgtcgtcaagcccactgacggcgccggcggtaagggtgtcgtcgtcggtacgacggcgaccgacgaggaactcaccaacctcgctggagagcttcgcgcccatccctaccgcttcatcgcgcagccgatcatccctctgtcgacccaccacacgctcgatggacgcgcgctccacgtcgacctccgccccttcgcgatcaaccacggggaccacatctgggtcatgcccggaggccttacgcgcaccggtccggcaccgggagtcctcgttgtgaactcgtcccagggcgggggatcgaaggacacctgggtcctgcgtccgggcaatggtcgagtacggacgagtcgctccgtgatcggcctcgtcgaccaggtacgcgccgacatcgacacgccgaatcccgaggcgacccagtgatccgcccccgcgcggcggcctccacgtactggctcggtcgctacctcgaacgcatcgacgcaacggtacgggtactcgaggtccagatcgacgcctccgtccagcaccgaagcggtctcccgtcggctgcgctcgcgaacagcttggggatcgccatcccagagcagctcgcatctcgcgacgacctcgtccggcttcttctcaccgacccggcggtgcccggctcggtaccgttctgcgccgccatggcgctcgcagacgctcgggacgtacgcgacctgctcacgagcgagctgttcgaggcgatcaacgccaccgcacgagccatcgccaacacggctcgaaccgcgagcaccatcccgtgggcacgcgtcctcgcgaccggacgcgacgtccacagtcgcgttgcgacctgcttcggtctctgcgagatgacgctcgcacgcgacggctactgggcgctcttcggcatcggctccagcatcgagcgcgtcgagatgacggcccggatcctcggcgcgtggcgagcacacgcctccaccgaggaggattggcacaccctgctgcgctcggtcggctccctcgagatccacctgcgacgccacgggatccgcgggagcacgccccaccgtgtgctgagcgacctcgtgggcgcgctcgacaacccgcgtgcgatcgccttcggcctgaacgaggttgcgcgtcgagcgcgcctgctgccacgcagcctggtcggggcccgtgtcgccaagacggcagccgagttggcacacgagcttcaccgcacccccgagaggatcggcacccgcagcggcgaggtggctgcccttgaggcgagccgaaccctccatcacctcatcgagaccacgatcgccctgccgagccagccgccccgctggcagctcagcgatcagctcgcctccgaggtcacccgatgaggagatcccgttccaccctcgccacctggcacaccaccgaactcagctacgacacccctgccgttcggtcctattccgagctgcgcatgagccccacgacggggagcagccagcgcgtgctccgacaccgcatcgagctctcccagccagcgcaccgagtccgctaccgcgactactggggctcggtcgtcacgtacttcgacatccaacgcccacatagcgagctcacgatcgtggccagctcgaccgtgcgatgcgcgccctggagcacgggatcggtcgtgacgctcgcgacgctcgcgcggcccgagacccagcgagcactcctcgagtacctgctcccgacgcccttgacgaccattgctgagcccgcgatcgacctcgaggtgggcacggacccactggagcgggcggaggccctcgccgccatcgtccatgacacgatcacctacgctccgggaacgacgaccgtcgacaccacggccgacgaagcgtgggcccgacggtctggggtgtgtcaggacgccacgcacgtactgtgtgcgctgctgcgtcatgcaggcatccctgcgcgctacgtctcgggttgctttgctccgcatgctctcgaggtctccgaggccgccgagggcgcaagtcacgcctgggtcgaagcgtgggtgggccactggcacccgctcgatccgaccaacctcttcgcgccgtcagagcgctacatcaccgtcgcccgggggcgcgactaccgcgatgtggccccgctgcacggcatctacgaaggtccagggcgacagacgatgcgctcgagcgtacgcatccagcgcgtcagctgagacgcgctccaccgccgctccctcgacctggttgcccctgcgacgcgaccggcgggcagcctggcgatccgcacggtgagtgagcgagcggacagcatcgcatgtgtggagcctcccggagaggccgctctctgccgtgaaccagccccgaccggtcaactccgaacgatgagccccacatcggccctccgacctctggttccctggtcgatccgacgaccaacgcgcacgcatccgcgtgcaccccgtgcaaccctgagcgccagcacgcgcaggttccaggtcgcgctgggacgatcgacgtcgagccgcttacgccatcgccggcagtgcggccgtacgacatgcaccgcgggacttgcgctcgagccgcccgcagattcgctcgacaggaggcgggtggctcgcctgccatctgaggtgacggtgacgaaggtgcgcaggtgcccccggagcgagcggggacggcgtcccaccgaccggaccgtggcgagaaggccgaggctcacagagccgcgtgcacgccgacctcgtgggccagaggcggcccaggtgccgctcggcacgcgagcgggaccctggtgatcgcccggggcagccctccacgtaggaccgcgcgagcgtgtcaggtaccgaaaggtgagcccatcgctcctcgtctgtcgcgggagcggaacgtcgggctagaggacgaccgcagcgaccacgaggatcgccagcaccaccgtcgccacagcagccatccgtccgacgcctgcggtcgcaaagccgatcacggacgccacgacgccagcgaggggggtcgcgagcaggatgaccgcgccgagcagcacgatgccttccccgcggccgtgccgaagagcccgtaccagcccgccgagccccaccggaaagtgcgcacggcgcccgacgaggacgtggtagctgatcggaccgacgacgaagtgaggatggctgacgagggtcaccacgagcccggccacgaccagcacgaccgcgatgacgacgccagccccgaggacgcgtccgacgacgttcgcgacctgcgcgtccggatcctcgacgcgtcgctctcccgacgcgctcatccgatgcccttctgcaacatctcgacggcgacgaccacgagcaccgcgatgaagacccagcgcaccacggtcacgttcacccgcgtgagcaggcgagccccgagcgttgcgccaccgagcacaccgaccgcgatggggccggcgaggatggggtcgatctggcctcgcgacaggtagatcgccgcactcgccgcggctgtcatgccgatcatgaagctgctggtcgccgaggccaccttgagcggcacgcccatcaacatgtccatcgtcggaacgttcaacgcaccagagccgataccgaggagcgccgagaccacgccggcaccgaacatcagcaccagaccgaggaggctgcgctccacccgatgggcaacgaggacgccgccatcaccgatcggcgctgcgccatggagttggagggcatcggcgatgcgatcgtcgcggggctgctcgatgcgatccccactgcgtcgacgcagcatggcgacggcagagtagacgaggatggctgcgaacagcaagaagaggaaccgcgtcggcaccgcgcgcgacaggagggcaccgacgatcgcgccgagcgtggtcgcgatcgcgagatacagcgcgagacgcacgttcaccatgccgcgacggacgagccgcgacgcgccggtcgccgaggtcgccaccacggtcacgaggctcgccccgaccgccaggcggatgtcgacatggaagaccagggtgagcaccggcacgacgacgattccgccaccgagtcccaccagggacccgagcaggccagccacagcggcgatcactatcagcgcgatgatgaagacgagcggtgtgatgaccatcattgtaccctcgtgggtatcagatcacgacgccggcgccgtacgaagcgcggctccgagtgccgcacccgcgtgccgggccacctcgatcacctcgcgaaccctcgcctcactgatcggcccttcggggtcctcgagccgtaggcgcaggccgagcgagcgccgaccctcgcgaacgaacgtgtcgaacgctgccacgtcgcgcaccaccgggccgatctcctcgcgcacccgagccgcgaggcttgcggccgcgaggtcccagggcacctcgaacgagaggtcgagctcactcgccgcgaaggcgccaagggtcgaggaagccgtgaggggtcggggctcggcgagccagtccgcgtccagctcgacaacgccgtagcgccaccgtcgagcacccagcgcagcggccacatccggcgcgagctcaccgaagacaccgacgaccagcccatcatcgatcaccgccgcctggcggctcggatgcagtcggggccacccaggaccaccagggccgagctgcaccgacccaggaccaagctcgaggccggcccgagccacgagcctcgcgagccaacggcccgcctccacgccgccgtcatgggcgtgggcgacgatgagcccgagtcgctgtcgctcgttgacgacgcgtccctcctgccagaagaccggaccccactcgaagaatcgcgcgggctcgagacggcgtctgaccgcgtgatcgagcgcaccgacgaggcccgcagcgaccgtggtgcgcaacacgctctcttcggggcgcaagggattggcgatcacgggtgcgacgcgctcgctcccgagctgctcctccaccgagggcgacaccatggtcacgctccaggcttcgaaggcgccctcgtccgcgaggagcgtcgagagggcacgttcgcgctgctggcgtagcgtcgggccatcgcgtcggggaccgatgaggggcgtcggggccaccgcgtcgtagccgacctgacggagcgcctcctcgacgacgtcggcgacgtcggtgacgtcggggcgccaggtggggaccccgacctgccagccgtccccgtctggctcgaggtcgaacccgaggcgcgagagcccggcatcgggttcgaacgactcgagcaccactggatcgcccgcgatcgccaccgcgctctcagcacgcaccgcgatccgtcgcggcgtcgtggcgtacgcaacgtcggcgaccagcatcggcgtcgcgacacccacgagagcggcaacacgggcgcacaccgcgtgcgcgacggcggggtccaccccacgctcgaaccgccacgacgcctccgtccgaagacccgtggcgcgcgccgcgcgcgcgatgcgctctcgtgggaacgccgccacctccaagaggacctgctcggtctcggcgttgacctcggtctcggcaccgcccatgatgccagcgagccccaccgcgcgatcgctgccgtcgacgatgacgagttcaccaccggcgagggttcgttctcgatcatcgagggtgacgagccgctctccaggacgagcactgcgcacccccaccacgccaccagccaaacggtcgcggtcgtaggcatgcgagggctgacccgtctcgagcatcacggcgttcgtggcgtcgacgatggggctgatctgccgcatgccgctcagcacgagccaccgcgccacgcgcggctcgagcaccgcgccacgcacctcgaggctcgcgagcacgagtcgatcgacggcgccctcttccaccgtcaccgcgcggggatcctggcgcgtgagcacccccgtgacgtcgacgaagggggcgcggaagcgcgcagcgaggtcgcgcgcgacaccgcgaactccggaggcgtccggtcgattgggttccacggcgatgtcgaggacgacctcgtcacggacccccagagcctcacgcaccggcacgccgagcgggagcgacggcgagaggatcgcgaggccgctcgcgtcggagccgagacctgcctccggagccgagcagagcatcccttccgacgtcaccccacgcagacgccgggccccgatctcggcgccgttcggcaggcgcacgcctggcagcgccagcgggacgacatcgccttcgacgaagttccatgcgccgcacaccaccggacggatgcgacccgatccgtcgtccacctcgacgagtcgaatgcggtccgctccctcgatccgatggatggcgagcaccttggccgtgaccacgccgtccgccgcgaccgggtgctcttccacgccttcgacgacgagcccgagggagtcgagcgtgcccaccagcgcgcgaacaccctcgctgtgcgcacgcagtgggtccgtgaggccgagcgcctcgagcggcgtgaagacctcgagccaaccgatgggcaacctcatacttcacccctcgtgcgcaccagcagccggaggtcgttctccggcaatacccgcatgtcggccagcccgtagcgcatctgcaccagacggtcgatgccgaaaccgaacgcgaaccccgacacacggccgggatcgagcccacctgcctcgagcacgcgtgcgtgcaccatgcctgcaccgccgagctcgatccagcccgtgcccgagcaggtgcggcaccccgccccgccacagatcgtgcacgtcacctcgaactcagccgacggctccgtgaacgggaagtacgcaggacgcagtcgcgagtggattcccggtccgaagtacgccgtcgtgaaggcctcgatcgtccccttcaggtgcgagaaggtgatcccctcgtcgaccacgagcgcctcgatctgatggaaggccggcgtgtgacgtgcgtccggggtgtcgcgccgatagacgcgccccggcaccaccgcgtagatcggcaacgtgcctcgctgcatgagacggatctgcgctggcgaggtgtgcgtccgcaggagcagcggaggcgaggcgtcgacgtcgaggtagaagctgtcctgggcggcccgtgcgggatggtgctccggcacgttcagcgcctcgaagttgaaccactcgtcctcgacctctggacccgaagcgacctcgaagccgaggcgccagaagacgtcctccagcgccatgcgcgctcgcgccacgaggtgcctcgccccgggaccctcgaggggttcgacgagcaggcccacggagggatcagagcgctcgcgctcagcgcgctcgaggagctctgctgcgtcgagacgtgcctcggccgcctcgatggccgacgtgagcgaggcgcgggcctcggccacgacccggccgagtaccggccgctcctcgggatcgaggttgcgaatcgaccgtgacagcactgccagtgggctctgcggcccgagcgcagcctcacggatcgcagcgagctcgtcccgatccgcgaccgtcgcaaggcgctcgagcgctccttgcacactcgccgtcacgagagcggtgtctgcggcgccctgaccgtcgccaccctggtctcgcacgctcgcccccatagaccctcgtccttcctcaccaccgcgacctgcggccaaggctagccccgggtcgacgcacccgccccgccaccgagcgacacccagagcgcgagtgcacccgccaccgcagcgttcagcgactcgagccggggcggcacgaccaacgccgcgcgctcgtcgagctcgccgtcgaccgccgcactcaggccagcgccctcggcaccgacgacgagcacgcgccgctgtgtctcgggcgcgagcggcgacggtgcgcgcgggtcgagcccaatgacgcgcgcgccccggactcgcagctcacggagcgcaggcgtgagctcgtccacctcggcgatgggcacgcgctcgagcgccccggccgccgctcgagccgccttgggattgaacggatcggccgatcccggaccgacgagcacgcccaccgcgtccgagagcgcggccgcggtgcgcaccaaggtgccgacgttgccgggatcttgcacgccgtcgagggcaaggacgacgagacggtcctcgagcgcctcgaccggaaccgtgacccgtcgcagcaccccgacgagaccctgcggagtcgtcgtggcgctgatggcggccagctcgcgctgcgtgacgacgacgaccgaacgcgcagaggccacgaggtcggcctcgcgacggatggcctcgtcgaccccgacgagctgctccacgtgcgctcccgccgccaccgcggcacgaaggaagcgtgcgccttcgagcacgtagcgaccgtgtctgcgccgcgcggctgccgacctcacgagctcgcgcagctcggcgcgggcgtcaggacgcagcgcgctcctggttggcttcggcaagccgcaccaacgcgccgaacgcgcccgggctccgcaccgccaggtccgcgagcacgcgacgatcgaggccgacacccgcgcggcgcagaccagccatgaagcgcgaatacgtggtgccctcggcacgcgccgccgcattgatgcgctggatccacagccgacgaaactcgcccttgcgcgcccgacggtcgcgataggcgtactgcagcgagtgcatcacctgctcgtgggcggctcgatagcttcggctcttgttgccgtagtagccgcgcgcgagctcgagcaccgcacgacggtgcttgcggctgtgcaacgaccgcttgactcgtgccacttgtgtcctcctccgaagccctagcgtccgccgagctgacgcaacgcgcgacgggtgtcaccccgcgacaacacaccctcgcgatgcaggcgccgcagccgcgacgacgacttcttgccgagcaggtgggaggtgaaggcgtgccgacgcatcagcttgcccgtgcccgtgcgcttgaaccgcgccttcgcacccgtatccgtcttcatcttcggcatcgcaactcccgtctcctgccggcgtcacccgctcgcgatcggtccacacccaacgagcggcgctggtaaccacgcatccatccccgaaaccccgtctgcgacggagcgctcgagcggtcatggctgcctcgacaagctcgcgccgggtgcggcgcggcctatcagcgtagtgtgtctgtcgaccgagttgggcctcaggcgcgcgccggtgcgggtcggcgatctggtgcgagcaccatcaccatgttccggccatccagcttcggcatcacctcgacgtgagcgacgcccttgaccgcctcgacgactctcgtgaggatctcctgaccgagttccgggtggaacacctcacgaccgcggaacatgatcgtgaccttcaccttgtggccctcggcgagaaacttggccacctgtcgcgtcttcgtgtcgaagtcgccctgcgagatcttggggcggtacttcatctccttgagctgcgacgccgaggccttgcgcttctgctcacggactcgctgggcttggtcgaacttgaacttcccgtagtccatgatcttcgcgaccggtggcttggccatgggtgccacctcgacgaggtccatgtccatcgctcgggcgatttgcagtgcctccggagtcggcttgatgccgagctggttgccgtccggtccgacgaggcgcacctcgcgaactcggatctgatcattcacacgggccccgtcctcgggtgcagtggcgataggagactccttccgtcggaaaaccaccagcgtggcggccagcagccgcgcctcacgattgtagcccaacgcgacgaggcaagcctcgattccccgaaggccacggcgctagactcatggcccgtggccaccgacgaacgtccgccatccgacctcgctggcgaggtgcatggtccttcgtccagcgacggctccacggcgagcaccgcggcgccctcggatgcgcgcgccgaggaggaggccgcacgcctcagggccgagctcctcgacgccgacgttggggatctcatcgccaaccacgcctacggtctgttcgagctgacgcggatctacctcgccgccgaaccaccccggctcgctgacgctaccctcgtcatcgacgccctcgcaggtctgcttgccggcgtcgccgatcgcctgggcgagcgcggccagctgctcgaagccgcactccgccaagtgcagctggcgttcgtgcgccttcgggacctcacccacgacgagaccgcctcctgagcgcgcgtcagtcgagcttgtgcacccaggtggcctcagaggcgcctcgaaaggacggcgcgacccgaaccagcacccgctggccgacacggacctggcgcgacccgtcgtcgaccacgatgcaatgaaacggcacctcgactgacccctcgaccgcgatcgccccgaggccgacgtgggcgtcgaacgccaccaccgtcccctcgcgcacctcgtagggatcgacgacggcgcgcgctggcgcctcttccagactgccgcggacgcggcgccgagaccgacgcaccgctacctacggcacgatcttcgacagcgggatctcgaggatgtccgtcgcgcccgcgtccttgagcgacgggatcagcaggttgatgcgctctctcggcaccaccgcctcaaccgcgaacccatcgccgccgtagagctcgctcacggtcggggccttcatcgaggggagctcggcgatgatctgcgccaacgccgccgctggggcgttgagcttgacgagcaccgacccgcgtgccgccagtgcgcccaccaacaacgtgcgcacctgctccatggcgtggcgccgctcggggtcggcggccgcgacgggattggcgatgagctcggtataggacacgaggagctcgtcgatgacgcgaagtccctgggccgcgagcgctcgaccggtctcggtgatctctacgaccgcatcggcgatctcggggaccttcgcctcggtggcgccgtaggaggcgagcacgtgggccttgatgccgagcctggcgaagtagcgctcggtcaaacggggatattccgtcgcgacgcgaacgccatcggggagctgtgcgggttcggtgacggcgctctcaccggcgaccgcgagcacgacgcggatggggcgcgacgacgccttcgagtagcgcagttcgcccagcgacacgacgttcgcgccggtctcctcgacccagtctcgcccggtgatgccgagatcgaacagaccctcggcgacgtaggtcgggatctcctgtggccggaggatgcgaacctccgcgatgcgcggatcgtcgatcgtcgcgcggtaggaaacctcgctctcccgctcgatcgtgagatcggcggcgcggaacaagtcgaaggtagcccgctccagcgagccctttggcaccacgaccctcagcacgaaccgtcatcctccttgagtgcatcgatgcgtcgatagacatcggccatgcgaacggccacgagggctgcctcgtagcccttgttgccgtgcttggccccggcccgatcgaaggcctgctccaaggagtccactgtgaggagtgcattggccaccggcaccgtggcctcggccgcgagacgagccagctgggcgctcgcctgcgtcgcgacgacctcgtagtgatcggtctcgccacgaatgaccgcgccgacggcgatgatgcccgcgatcggcgtgcctgccgtcacgagtcgacgcgccgcgccagcgatctcgagcgctccgggaacccacacgacgatgggctcagccgcacctgcctcctcgagcgcccgccgagccccatccaccagcgcctcgccgaccagctcgttgaagcgcgccgcgacgatgacgaagcggtcagtgggctcggcacgtggtcggccttcgagcttcatcgttctcccctcgcgacgtcgagcaggtgccccaacttgcgcgccttggtctcgagatagcgcgcgttctcgggtcgcacctcggtgacgatcggcacgcgctcgacgatctcgaggccgaatccagtgagtccacggtacttggccggattgttcgtgagcagacgcatgcgtcgcacaccgaggtcggcgaggatctgggcaccgatgccgtactcacgcgcatcgaccggcagcccgaggcgctcgttcgcctcgaccgtatcgagcccctcgaactcctgcaagtggtacgcgcgcagcttgtgaccgagcccgatgccgcggccctcgtgcccacgcaggtagaccaccacccctcgtccttcgtccgcgatccgtgcgagggcggcgtggagctgcggaccgcaatcacaccgatacgacccgaagatatccccggtcaagcactccgaatgcacccgcacgagcaccggttccgtgtcgtcgatctcgcccaggctgagcacgagatgctcgtccccgggctcgaggacgctccggtacaccaccgcatcgaacgctccccattgggtcggaatggtcgcctccgacccctcgacgcgtgcgacgagcgtctcgcgcgccgcccggtagcgaatcaggtcggcgatggagatgagcgggacgccccaggcagcggcgaacgccgccagttcggggagccgggccatggactgacgatcctcggtcgtgatctcggcaagcatcgcggcaggccgccgaccggcgaggcgggcaagatcgacccctgcctcggtgtgtccacctcgcttgaggaccccaccctcacgcgcgcgcagcgggaacacgtgaccaggtcgcacgaagtcgctagggcgcgcgtccgggctcgcgagcagcgccacagtgcgggctcggtcctcggccgagatgccggtcgtaccgccgcgcgcagcgtccacggtgatggtgaaggcggtcttgcggggatcggtcccgtgctccaccatgagcggcagctcgagggcgtcgaggagctgcgactcggccgacacgcagatcatgcccgaggtgacgcgcaggtagaaggcgacgtcgtccggacgcaccgcgtcggcaggcatgatgaggtcaccctcgttctcacgatcctcgtcgtcgacgacgatgaccatctcgcctcggcgaaacgcctcgatggcatcctcgaccgacgagaaaggcgtcgccgctgttgtctcactcatgcatcctccgcttcgcggccaagccggaccccctggagccgcgcgacgtacttcccgatgacgtcgaactcgatgttgagcaccgcaccgacctcgcaggtcccgaggttcgtgcgacgtcgcgtctctgggatgagagcgactctggccgaggccggcgcgagctcggcgaccgtcaacgcaaccccgttcagcacgatggtgcccttctcgacgacgagcggctcgaaccgctcggggtagtgcaccacgatgccttcgtcgtcgacgtccgtcacggtcgcgacggcgtcgacgtggccgagcacgaggccgccatcgagcagcgtctggagcgtcaccgaccgctcgacgttcaccagcaccccgggctcgagcgcaccgagattggttcgccgcagggtctcgggcacgacgtcgactccgaccacctcgtcactgatctcgacggcagtgaggcacgccccgttgaaggcgatggaactccctggggcgatggcgacatcccagtcgctgcggtcgaacagcaatcgcccgtcacggcgctcgaggagcgctacggtccgttccacgatccccgagaacacccgactacctccgggcgctccaccggatcgaccgcgccccgtcgaccagcctaccggcagccgatcgctccgaggacctgcgactccaagccccagtaggcatcctcgagcgccgtcgcggcggggagtcgcacccaggcgacgagatcctcaccgacccgtcgatgcgcacgccaggccccccgaatggcatcctccaggagccgcccctccccgaggtcgaccgcgtgccgagcatgctcgtcgcccaacaggatcggtgcgatggcgacgagcagctcgtcgaccagtccctcggcgagataggcaccgagcagggtcgggccgccctcgacgaggacctcgacccacccgcgagccgctccggcagcgagcagcgcaccggggctctcgctggcgaccacgaagccctcggggacgtccagcgggcgacgactcgcgaccaccctgaccggttgacgccgcgcgagtcgcccgcccggtcgcgcggtgagttgcggtcgatctcgctcgaacgtcccccgaccgacgatgatggcgtcgacctcggctcgaagtcggtgcccgagctctcgcgcagcttcctgggtgatccacttcgactgcccccaccgatccgcgacggcgccgtcgaggctgcaggcgatcttgccgacgacgaaggggcgcccgcgcagccggtgcgagaggtacggggccaggtcgtcggcgagcctcgcgcgcatcgcccggggcgcgagtcgcacctcgaccccagcggcttgcagggcctggatccctcgacctcgcacccgtggatctggatcgatgaggcccacctccacacgtgccacgcccgcctcgatgatcgcatcgacgcagggcggcgtgcggccatggtgggcgcagggctcgagcgtcacgctcatctgggcgccgcgagccagggcaccggccgcagcgagagcggcgacctcggcgtggggacccccgggatgggccgtccggccgacgccgaccaccacgccatcgcgctcgatcaccgcaccgacccacgggtttggcggtgcgaccgcacgggagcgacgtgcgagccgacgtgcacgctcgagcggagcgatcacggcgccgcgtgcgggtgcgcgtccccgccgtcgatcaacagcgccaacgcatgatccaggacgggcagcaccgcctcgagcgactccaccgcgccggtcgccgacccggggaggttcacgatcaggctacgcccacgggtgccggcgaggccacgcgacagcgcaccgagcggactcgccgcgcgcatcgcctcgcagaagccgggggcgtgacgctcgagcacctcggccgtgccctcgggagtctgatcgcgcggcgtgaaacccgtcccacccgtcgtcacgatgagccccgcgaatcccaacgatgcctcgcgcagtgcgcgtgccaccgatccggcgccatcggcgatggcgctccgggcctcgagctcgaaccccgcccgctcgagtgccgccgcgagcgcctcgccggatcgatcgacgcgcgtcccgcgcaccacaccgtcggagaccgtgatcaccttcgccttgcgcttcggctccatctagaactcctcgctcgggatcgctcgaacgtgcagctgcgctgcccgaagcccgcgaacgaagtccgcaccgctcatcggtcgcccgccttcggggatgacctctccgagctcgtaagcacctcgtgccgtgtgcacgatggcccgaccgtgatcgagttgcacggtcccgagcggatcggccgcctctcgctcgaggggacgacccgagcgtacgatcacgcgacgccgtccgacgaagcagaaggctcgctccagacgcacacgccgatcccacacgatcgcggcctcggcgggacgcagacggaggtcctcggacgtgatccgcggagcccaactcgccgctccggcctgggggacccccgcttcgagggatccgggctgttcgaggagaccgaggaggagcgacacgccggcgtcggtaagacgacggcgagcctcgctggcccggaggccatcgatcagcaccgagcgcatcgcgaggatcgggcccgcatcgagctcgggctcgagacggatgatgctcacaccgctgcgatcgacgccagcaaggatggcacgctcgaccggagcggcacctcgaaactcaggaagcagcgagtagtgcacgttcaccaccggaacaccggtgagccaggcggcaggcagcaaccggccgtaagcaacaacgacgcagacctcggccccgaggtggtcaggagggagcgcctcgtgcacctcgacgccgagctcctgcgcgcggcgcgccgccacggtcccggccaccgcgccgccacgcccacgtcgcttgggtggccgagtcacgaggccgatcacgtcgtgacccgcctcgacgaggccatcgagatgtcgcgccgtctcctcggtcgagccgagcaggagcacgcgcatggtcagttgccgagccagcgctcacgcgcgatgcgttgcttggcctcgcgccgctcctcctcgtcgagtcgctcgatgagcagcacaccatcgagatgatctgtctcgtgctggaacacgcgcccgaggaggtcgctcccctccaactcggcgacctcgccgtcacgggtgacgtagcgcaggagcaccgtgcgagggcgctcgatcggccagaagtagccaggaacggagaggcaaccctcctcgtagcgccacgtccccgtacgctcgacgatctcggggttgatcgcaacgtccggaccgtcaccgatgtcccagacgaacaggcgcagatcgacacccacctgcggggccgcaagcccgactccgggagcctcgtgcatggtcacgatcatgtcctcgatgagctgatcgaggcgagcgtcgatcgtctcgacctcgcgagctcgatgcgagagcaccggatcgcctatggttcggatcggcaggatcggcacgccaccacgctagacggccgaggcccgtcggggcgctaaccctggttcacggtgggggtcgttgctgatgcgatctctcgccacgagccctgatcgagctggaggaggccgacaccggtcagattcggattgcccgccacgacctcgaccgctccgcccgaggtcacgccgaccccttgggcccacgctggtgccgcgatcgccctcgtgatcaccccgccgcttgaggtgaccggttcgaactccaccaatgttgcgcgagccccatgaggcacgagcgcgaccgcacgggtcccggaggctgcgagcgacggaccgagcgaggcgtcactgccgagtgacaccgttgcgaccacgcggtcaccgacgaggtcgacgagctggagccgctcgcgatcgttcgtcgcaacgatgacggcgaccagcggacccgtcgccccatcgacgaccgcactcgtggcgaccacatggcccgcgagtgccacggtgcgagcggtgcgcgccgcgaggtcgaccacggcgagacgcgcactcgagccacagctcaccacgagcgtctcgccgtcgggtgcgagggagcgcgccacgggcgagacgcaccccacctgatgctcgagcgccgcgagggacgcagacgagaccagcgtcgtcgcgatcgtgccgttcggcgccagatcgacgatcgactggtcgccgagcccaaaggagcgtgtcccgacgatcgcctcgccgccaccggtggtcgcaacgaccgatccagggaacggcgccaccgccgtcgtgaactcctgtggcgtccaacctgcgctgtccgccgaccacaggaccgagtagggccaggtcccatgggcgacctcgccggcatacaccggcagacccgccgaccccccggacgcaagcacgatgccagctcgggtcgacacgccgagcggggtggcgagggagagcgagttcccttgttgcacgagcacctggccgtgttggtagctctggacctcgatcagctcgccaccgctcggacgggcgacgatggccgcaaaattctcaggcgccggaggggcttgcgtcgctgcactcgtggctgttgcgcaggccgcaagcaacgcgccgagcgacgccacgaccgcgactctggcacctcggccacgcgtccagcgcactcagacctcctcgaccaggtggacatacagcgacgagatgctggtcgccaccgatgcattcagcgacggatccatcggtatcaggtagcgctcggtgaggttcggccctaccacatagccgatgtcctcatgctgggtcatcacgccatccaccggctgggacacgccgaaaccgagcgcctgccacaccttcgacagctgcgtgagcgaggggctggtcaagaagtaccagttggacagtccggtcaggttctctcgttggtcgaagatcttgaccgcctgcaccgaatggatcacggggttgaccgcgacggcaacgaacaccgtgttggcgcgcaccgacggaggcagcgccaagtccgccgtgcggagttcttgggcaatcaacggacagtcgaaggtgcacaccggatccaggttggtgagcaccacccgcttgccggcgaactggtcgatcgagaccggaacgcctcgctgatcgagcaaggtgaacgagggtaccgggcggtcgatggcaaagggcgtgtccgaagccgccagcgcgagcgccggcgaggcggtctgattgatggcggcataggccagcggaccgatgcccatgagcgcgaccaccacggtccacgtgccgagcaaccgcccagcgatccccacgccactcggccacagaccgcgaacatcgaccgactctcgagcaggactcacgacgccgacgacagcagcgccagcgagcacgagaccgggcaccatggagttcgggtccgtgccgacgcccccgaggaacccgaagtcctggacgaaccaccacgccaggagcgacaggaccgcgagcacccagaacgcgggccataccaagcgcttggccagaaaggcaaccccgacggcaatgaggacggccgcgacggcagcgttcacgacgaccgtcgtcgtgccatggagtgcgttcgcgagatcgaccatcggccgcgccaggaacgatggttggggcgtcccggccatcgtccggatcatcgcggggatctgtccgtgatagaagccacgaccaggccaagcctcgaggaccccgaacacgaagagttcggcgcccacgaggccgagcagccagcgtggaaggcgatccggttgccacgcgctccacggcgcaagcagcgctgccgccgcgaccacgtacaggaggaccgccccaggggccccgaagagccacgaggcccccggcgcgaggatgccacccatcgcctcgccacccacccacacggtcaagccccagaggatggcggcgacgtagccgaccttggcgaacgcccctgacttgccgaggagcaaccacacgccgatcgcgagctggatccacaccgcacccgtcgctgcccagagcggatggcgctgccacgcgtcgatgccgagctgaacgaggtcgaccagccagcggggactgccctgcgcggctggctggatgacctggcccacgagcgacgtcggcatggcacgctgcatctggagcagcccatcgacgatccacagggcaccaaagccccaacgcaggatcgctctcgctcgcggctcggcgacctcgtacaccccctcgtccgccgaaccagcgacctggacgcgtgccgggttggtggcgcccgcaaagaggaaatagcgggccgcgacgagcaccaacccgatcaagacgagcgcaatcgcctcgagccccaaacggtggtagaacggccccgcaagacccgaactgctcagggctgcactgcccatacccgtcattgcctaagcctccttgggctcaccgaccggcacgtaccgagacccgcggttcccgacagagcctgtcctgacaaccggattctagcggccgaaggccgaggctacggggccgctctgtgcaccaaagctcagagttctcgcgggtcgagttcgacccgaaccgcgcgcgcatcgagcgttcgcggcacggatccaaggacaacgcgcagctcacggcgggtgggagcggtgaggagccagcgatcgggggcgagctcggcaacctcgaaccccggcacgctcacctcgctcagtgcatgcacaaaggccgccgcctccggtccggagacgacggcggtgccgtggtctgggtcgagaccgagagcggcacgctcgtcgcgtatggcgcgcagcgcgcgtcgcgcgtcgcgctccgcgagcacctccgggagccacgctggcgcgtgctcgaccacgagatccacctcgccgcggttcgatgcgacgagcgccactgcccggtggatccagtagaggcccagctcctccgcgaggcggccatgagagccgaagagacgctccggctcgacgagtacgaccagatctaccgagccagcactctcgagcgcctcgatcgtcccgacgaccacgcccgcccgtggatccgggcccttcgcgatcggctggcgtaccaccggctcgaggcgtgccgcaacgtgctcgaccgaccagcgagacacccgcacggcgggtgagccgcacacgccacagcgcagcggacgtagcgcctcgcacgtccgacaccagccccgttccgggacaccgcgcctcgcagggagcacgaccaagcgcccaccgcaggcggcacacgtgagcgttgcgccacacgcccgacagaccggagcgtgccccggacctcgagccgggacgacgacgagcgccctcgggtccgcgcgccggcgccgggctaccgcgagcccatcggcgacgaccccctcgattccgcggtcgagatcggcggccccgaacgtccgcacgacgggccagggtcgaggcgctcgagtggggacgcgaacccgggcgcgcgccaggatgtcggcgggcggcaccgcactcacgaccacgagtcggctccggctgacggacgcccgcaccccagcgagatccagtgcctcgaggtacggactcgactcgtcccgcgcgttcggatggatcgggtcgagcaccaccaccgcatccggcgtcgcgagcggcgcgagcgcgcctcggcgaccaccgatactcaccgtcgtacgaccgcacgcgagctggtcccagtcgtcggggaaccgtgccgcacggaccccgacccgggcgagcgcgtctgcagtgtgtgcggcgatcgctccggtgggcgccgcgatgaccactcgctcgccgaaggcgccagccgccatgaggcggccgacctcctcgggcgccgagacggcgagcggcacgaggaagacctcgggtgtgacctcgctcgggtcgacgaggcgctcggcgagctgaccccgggcaggctcgagcaccggtgctccccgcaccttcgggcgccgcgcagcgcgcaagagcgtgacgggactcgccaccgcccacatcgccgcggcgagcaccgcctcgatcacctcgggaggggggcccggtcggacacgacggagcaccgagcgcaacgaggtggccgacgggtgctcgcgcgctcgggccgggcgcgcaacgacccatccgctgacgcgtctcgcaccgaagggcaccacgacctcgtcaccgagaccgacctctgcctcggggtcgacggcgtaggtgaacggcccgggccggccgaccacgtcgacgatgacgtccgccgagtccgcgggaaggtcgccctccacctcagccagtgatgtcgagcgcgctccgcagcgcgtcgagccgatcgagtcgctcccacgggaacgtgccgtcggagcgcccgaagtgcccataggccgcggttcgccgatagatgggttgacggagccgcagcgcatcgatgatcgccgctggccgcaggtcgaacacctctcgaacggcatcttcgatgcgacgcggatcgacctgctccgtaccgaaggtctcgaccatgagcgacaccggatgggcgacgccgatcgcataggccacctggagctcgcaccgcgacgctgcgcccgaggcgacgatgtgcttggccacccagcgagccgcataggccccggatcggtcgaccttggacgggtccttgcccgagaacgcgccaccgccgtgacgcgccgatcccccataggtatcgacgatcaccttgcgaccggtcaggccggtgtcggcgtgtggtccgccgagctcgaaccgtcccgtcgggttcgccaggatcttgaggcccgagacgtcgaggtctttgggcaccatcggaccgatcacgacgctctcgagatcagggagcagcagggtggcgagatcgatgccgggctggtgctgcgtcgagaccagtaccgtgtcgagggcgacgggtcgaaacccctcgtagcgtacggtgacctgggtcttgccgtcgggtcgcaggtacgggagcaccccagcccgtcgcacctcggcaaggcgctgcgcgatgcgatgggcgagccagatcggcaagggcatgagatcgggcgtctcatcgcacgcgaagccgaacatcagtccttggtcaccagcgcccagggacgaatacggatccgcctcgccgctcctggcctcgagcgcgctcaggacaccagaggcgatatcgggcgactgctcatcgatcgtgaccacgacgccacaggtgttgccgtcgaaaccgtaggactcacggtcgtagccgatgtcgcagatggtccgacgaaccaccttgggaatgtcaacgtagctgtcggtggtgatctcgccggcgacgaccacgagacccgtggtcagcagcgtctcacacgccacacgggccaccggatcctgcgcgaggatctcgtcgaggatcgcatccgagatctggtcggccatcttgtcggggtgaccttcggtcaccgactccgacgtaaacgcgtagctgcgcacagcgctccttccttcgagggcgctcgaacaacctagtggagccgatgcgatcgcgcgtacgcgacggcgtgcgcgagaatgcccgcagcgatctgctccttcgacgccaacgccagctcgccccaacggccgtctcggtcgagcagcacgacctcattggtcgccaccgcgaagccggcgtccgcacgggacacgtcgttgccaaccatgatgtcgacgtcgcgggctgcccgcttgcgctccacctcggtgcgcggatcacccgtctcggcggcgaacccaacgatgatttggtgcggctcgcgatgagcgctgagctcacccaacacgtcgggtgtcggtccgagttcgatcgtcagagacgaacggccggcccgcttgatcttggaagacgccgtcgccaccggagcaaagtccgccaccgcagccgcctgcacgacgacgtccgccgacggctggcgctcgcgcatcgcagcgaggagctcctcggctcgctccacccgcaccacctcgacgagctcgccgaccggaccggcatcctcggtcgtcaccaacgtcaccgtcgctccagcgagcgccgccaccgcagcgatcgctcgcccctggcgaccagacgagcggttggccacgacacgaaccggatcgatcggctcccgtgtgccgcctgccgagacgagcaccttccagccggcgagatcgagctcaggtgccgcctcgagcagctcgagccagagcgacatccaccacggatcgacaaggcgtccgagccctcgatcgcctcccgcaagccgaccggtcgtcggtccgacgagcacggcgccgtcggtgcgcagtgtcgctaccgagcgttgggtcgctggcgacgaccacatctgggtgtgcatcgctggtgcgagcgctctcggcgcgctgctcgcgagcagcgtcaccagcgcaacgtcgtccgcgatcccggcggcgaccttggccatgaggtccgcggtcgccgggtacacgatgatgcgctcggcccacgacgccaagcgcgtgtggaccgatggctcacgaccgaagagatcgtcgttcaccatgcgtccggcgatcgccgacagcgacgcggcaccaacaaactcccgagcggcggccgtctggatgacctcgacgtcgtgccccgcatcgatcagcagccggatcagctcgagcgccttgaacgctccgactccaccgccaacgacgcacagcacgcgtcgcgtcacgccgttactccgcttcgtcctcgaccaactcggtcacgtcctcggccacgacatccggaacgatcatgccggcagcgatctcctcgaacgccagcgacaatggcttcgcgacgtccgactccacctgcggcggaatcatcgcgcccagcccttcaccgagatgggtgcggtagtcgttgatctggcgggcacgccgcgcggccaaggtaatcagaacgaacttcgagcccgtgtgctcgagcagctcctcgatgggcgggttcaggagcgaacgcccggcttcagccaccacaacctcctcgacggacctcggagcctacctgctcgagccgactactcgggccgaagggctgcgccgcggacgatcccggccacttcatcgatggcccgctcgaggcgatcgttgaccacgatatggtcggcgaggccgatcatcgcctccacctcgttcgccgcgatggcgagacgggactcgacgtgcgcgtcgtcgtcgcctcgagcgcgcatgcgacgctccagttcgtggaagctcggcggcaccacaccgatgatcgccgcctcgagctccagcatgcgcacactcctggcaccctggacatcgatctcgaggatggtcggatccccgcgctcgagctccgagcgcggggtgccgtacaagcgcccattgaacgacgcccactcgacgaacatgccctggtcgatagccgactcgaagtcctcgcgcgagacgaactcgtacgcctcgtccccctcaccgggacgacgaggcctcgtcgtccacgatctggcgaggtgggccgatggcagcgacccagcgagccgacgagcgatcgtacccttgccgaccccgccggggccgcagatgacgacgatcagtggcccttggtctcctcgagcaggcgctgacgctgcaccgatccaagaccctggacgcggcggctgtcggcgaccccgacctccgccatgatgcggcgagccttgaccttgccgatgcccggcaacgactcgaggaccgacaggaccttcatcttgccgacgatctcgtccgactccgctcgctccaggagctgcgcgagactgagcgagcccatcttcaggcgctccttgatctcggcgcgggctcgacgggcttctgcagccttctggagcgcagcttgacgctgctcagggctgagcgatggtggcaatggcatacagcgcaacctagcagagcttctggccgtctagggctcgatttcgcctgaatgttgcctacgaggcctctcccgtcgccgctgcgaacagcctggcggccacctcgaccgggtcactcgcctcggtcaccgcacgtccaaccaccagcacgtcggcacctgcctcgagcgccgctcgtggcgtgacgacctgccgctgatcgtgctgggcacccgatggctcccggatccctggcacgacgcgaacgagctccggccagcgctcggcgacggttcgcaggtgatcggcgccgacgaccacgccctgacagcccgagcgtacggcgacgtccatccggcgctccaactcggagaggtcgagcggagcctgcgacgtcagcgacagcacaccgagcgcgatcggtgtcggagcaccgacacgttcagccccctcgaggaggccctccacgccagcgcggagcatggcctcacctcctgcaacgtgcaaggtgacgagtgcgacgccaaaggaccccaacacccggctcgcgcgatgcacggttgtcgggatgtcgtggagcttgaggtccgcgaagatccggaatccttggtcggcaagggccgacagcaccgtcggaccggcggcggcgtagagctcgagccccaccttggcgatggagaaccactctcgcaacgacagtgccagccgttgggcctcgacggcatcgtcgcgatcgagcgccagagcgaagcgctcccgaagcgcctgagcctgcatcatccactccctccttgacgccgaagcgcccttgcgtagcggtcccagctgtcgacgccgctgcgcgcgagccgacgttcgatctcggcgagcacgaggacgggacgtcgtgggtcgacaaagagcgcggtgccgatctggacggcatcggctccagcacgaacgaagcgctcgacgtcgtcggcggtcgcgaccccgccgacgccgatgatcgggacggtcggcaacgccgcacgcagatctgcgaccgcccgaagcgcgatcggctgcacagcgcggcccgacaagccgccccctcgcgccgtgccgagggcctcacgaccgtcgtcgtaccactgcgcaaagagggtgttgatcgcgacgagtccgtcggcgccggcagccaccgcggcgtgcgccacgtcgacgatgcgatccgtattcgccgagagcttcacgaggatcggggtcgcaacctcgtcgcgcaccgcgcccaccacgcgagcggtggcgttgggatcgtgcgcgaacaacgcccggtcggcctcgagattcgggcacgacaggttgagttcgatgtagaccagcgatggcgcgatccgagcagcgcgccgaacggtctccccgtagtcgcgcggctgacgtccccagacgctgagggcgaccgggatcctggcgtcggccaaggagggccacgtctcagccagccatcggtcgatgcctggacccgccaacccgaccgagttcaccatgccacccggtaccggagcgaggcgaggcgctggattgccctcggtggcaacggtcgtcagcgacttgacgacgtgggcaccgagtcgctccagagccacagcagccgcgagctccgtgccgtaaccgccacacccggccgccgtgaggatggggttcgccaagacgagccgaccgcgtgcaaccgagaggtccgccactcaggtttcctcgtgataggcctgcagcggccgcacggtcagcggctgacgtgcgagcgcctcgaccgctgccacagccgcgcgagcggcctccagcgtcgtgatcaacgggatcttggcttcgagcgctgccgtgcggatgcggtaaccgtctcgccgcgggccactccctctcggcgtgttgatgatgagcgcaacctcgccggagcgcaccagccgtacggcatcgacgaaaccctccggcgcagcacgctcgccgagatcctcttcctcggtgaccttcgcgacgaggcgcgcaacagggacgccgtgagcctgaagccaggaggcggtcccctcggtcgcagcaaggtcgaacccgtgggccaccagtcgctcggcgatcgggacgagcgcctccttgtcgcgatcggcgacggtcacgaggaccgtgccctgctggggaagacgcgtaccggcggcgagttgtgccttggcgaacgccatcggcatcgtgcgatcgatccccatcacctcaccggtcgagcgcatctcgggcccgaggatgctgtcggccccgcggaacctgccgaacgggaggaccgcctccttcaccgcgacgtaactggtgacgcggcgaggcacgaagaggccctctcgttcgagatcacgcagggtcgatcccagcatgagacgcgtggcgatcttgacgagcgcgacacccgtcgccttggcgacgaacggaaccgtccgcgacgcacgcggattggcctcgatgacgaacaccgtgccgtccgccacggcgaactgtacgttgatgagcccgaccacatcgagtgcgtccgcgatcgcacgcgtctgggcctcgatctctgcgacgagggcgggagcaagtgagaccggcgggatcgtgcacgccgagtcacccgagtgaacgccagcctcctcgacgtgctccatgaccgcaccgatccagcacgcgccctcgcgatcgcgaaccgcgtcgacgtcgacctcgatcgcaccttcgaggaagcgatcgatcaggatcggtcggtcctgcgagatcgcgccctcggccgccagatcgacgagccgagagaacgcgctgcgcagctcgtcctccgagtagacgatctccatggctcgcccgccgagcacatagctcgggcgcaccaacacgggcaggccgatcgcagcgaccaccgcctccgcttcggcgagcgaggtcacggtgccgcccgggggctggcggatgccgaggcgctcgcacagggcagaccaacgccggcggtcctccgcgacgtcgatcgagtccggcgaagtgccgaggaccagcgacggatcgatgtctcgagccagcttgagtggtgtctggcctccgagcgacacgatgacaccctggagtgagccgagacgctgttcctcggcgatcacgtcgagcacgtgttcggtcaccaagggctccacgtacaggcgcgaggaggtgtcgtagtcggtcgagaccgtctccgggttcgagttgaccatgatcgcatcgacaccggcctcacgaagcgcgaatgctgcatggacgcagcagtagtcgaactcgatgccctggccgatgcgattcgggccagcgccgatgatgatcacacttggccgattcgatccgacggtctcgctctcctcctcgtaggtcccgtagtagtacggcgtgcgtgctgggaactcgccagcgcaggtgtcgaccgccttgtagacagcgcgcacccctacggtgtgccgatgctcgcgaaccgccgtctcgtccacaccgagcagccacgcgagttggagatccgagaagccccatcgcttcagatcgagcagttcgtcggcaccgagtgaggcgagatcgcggccacggatgtcggctgcacgcgcgacgatgcccgccatttccccgatgaaccacgggtcgatccggctcagctcggcaacgcgctcgatgctccaaccgcgccggagtgcctcgccaacggcgaagactcgctgctcggtcggcacagcgacgagcgtggccagggcgtcatcggagtacgcctgccaggtgacctcggccggatcggcgccgaaccctccccgcgaccgctcgataccgcggagcgccttctgcagcgcctcggcgaaactacggccgatcgccatggtctccccgaccgactgcatccgcgtcccgagaataccctcggcaccttcgaacttctcgaagacccagcgcggcaccttgaccaccacgtaatcgagtgccggctcgaaactggctggcgtgacacccgtgatgtcgttcatgatctcgtcgagcgtgtagccgatcgccaagcgtgtcgcgatcttggcgatcgggaacccggtggccttcgatgccagcgcgctcgagcgcgacacacgggggttcatctcgaccacgaccatgcggccgctggtcggctccacagcgaactgcacgttcgagccgcccgtctcgacacccacgcgtcggaggatctcgaacgagagcgaccgcatgcgctggtactcgagatccgtcagcgtctgtgcaggagcaacggtgatcgagtcaccagtgtgaacccccatcgggtcgacgttctcgatcgaacacacgacgacgcagttgtcattcgcgtcgcgcatgacctcgagctcgaactccttccaaccggcgatcgactcctcgaccaacacctcgccgaccggcgaggcgatgagaccggcccgcagcatcgcctcgaaggagctggggtcggtcgcgatcccggttccggctccgccgaggatgtacgagggtcgcagcatgagcgggtaaccgagctcgtcggcgacgtcccttccctcctcgagggaccgcacgagccgcccgcgcaccgccagctgctcgtcgatgctcatgagcagctggcggaatgcatcgcggttctccgcgagctcgatcgaggccggtcgcgccccgagcatccgcaccccacttcgctcgagcacaccagacgcatccagctccatcgcgagattcagcgccgtctggccgccgagcgtcgggagcaccgcatcaggccgttcggcctcgatgatgcgctcgagcacctcgagcgtcaggggctcgatgtaggtcgcgtcggcgaactcgggatcggtcatgatcgtcgctggattcgagttcgccaaaatgacgcggagcccttcctctcgaaggacccggcacgcctgtacgccggagtagtcgaactcgctggcctggccgatgacgatgggaccagacccgatgacgagcaccgactccaccttcggatccctaggcatgcgaacctccaccgagcagtgacagcagctcgtcatggatctccgacgactgctcgagcggaccgggggcggcctccggatggtactggacgctcacggcgccaagtgccggcaaccgcagtccctcgacgaccccgtcgaacaggttgcgccgggtcacctcggccggcgtgtcgagccggccgagcgacgcctcgtcgaccgcgtacgagtgattctgggcggtgatcgcgacgcggccggtctcctccaggcgaacgggatgattcgatccgtggtggccgaacggcagcttgatcgtctcggctccggccgcgagggcgaggagctggtgcccgaggcagatcccggcgatcggcaccacaccgagcaaggaccgaacgagctcgatgggacccgtcagtgcggcagggtctccaggcccgttcgacaggaacaccgcgagcgggtcgagcttctcgagctcttcgagtcgtatggtcgccgggacgacgacgagccgccatgggccacgcagggtctcgagcatccgctccttcaccccgaaatcgatggccacgatcggtcgactggagcgcgcgtgacccaagggctcgagctcgcgaggttcgcgacgggtgaccgcgcgcacgagatctcgcccttcggtaccgacggcgacccgaactcgctcggcggccgcgtccggatcaccggtcgtgatgatgcctggttcggcgccagcggcccgcaccaggcgaacgagtcgcctcgagtcgaagtcgacgaagagtgggacgcgtgcctcccagagccacgccgcgagggtggtgtcggccgcatggttcgacgccaccaccgagtacctcggcgccaagaccgcactcacccacggccggacgctttgcacgtcggccctgcggacgccgtaggttccgaggtgggccgtggtgaagcacaccatctggccgtagtaggacggatcggtgatggcctcgacgtagccgctcatcgcggtgttgaagaccacttcggcctcgacgtcatcgaggagcggctcgacaccggcggggatgaccacagcgccacggaacctcgcacccgagcgcagcaccaaccacgccggtattcgctgtaccgactcctcacgcacccacatagcggccttcctcgacaaccacctgacctcggcgcacgacccagcggatcgacccgaccaactccctcgtcgcccatggcgaattcgtcgaccggtacgccccgtcgccgccgccgatggttctcccacagggatcgatcacgacgacatccgccagctcgcctcgtcgcagctcgcgcgaacgaccgagcacgcgggccgggccgatcgccaacgcctcgaggacacgcacgagggcgcgccgcgcctcgtcgccaaggtgctcagagctctctggccgcgcatcctcgatcgagccacggagcacgagctggtcgagcacggcggtccaggtcgcagggaacgcctcgacgagaccgagcatgccgggtgctgccagctggaccggcaccgtcttcgctcgctccggatgcggggcgtgatccgtggcgatcgcgtcgaacgcgcctccgaggagcgcttcgagcagtgccatacgcgtcgcacgcgtacgcagcggtgggttcacgcgaaagcgcgcgtcgtggctcaggagttctgactcctcgaggccgaggtgatgcggcgtgatttcggacgtcaccgccaagccctctcgctgcgccgcacgcacaacattgacgctctcgcgggcgctcacatgctggaggtggtagcgcgcaccggtcgcacgaacgagagcgacgtcgcgcgcgaccagtgcaacttccgcaacctccggaacaccgtcgtagccgagacggtccgccagcgctccggcgttcatgacgccgcggctcagttccgggatggtcgcatgctgcgccacgacgacccccgtgctcgcggcggcctcgaggaccgcgaccgcgacgtcggcacgccagagggggtcaccgtcatcggagatgatgcgaacaccggccttcgccaggctctcgacgtcgacggcatgatctcctgcacgctccatcgtcgccgacgccgcctgcacgacctcgaccgggagcgccgcaaagcgatcagttgctgcgcgccatcgctcgacacggtcgatcgcggggaccgtgttcgccatggcaaccaccgtcgtaaagcccccacgcagcgcctggatggcgatgtcctccggcgtgtcggccacctcaccacccggccaccggaggtgggcgtgcaggtcggtgaaggcgggggccacgacggccccgggagcctcgatcacccggtcgccgcgctcgggaccctcgaatccggcaatccgtgcctcatcgatccgtatcggcacccgttggaggctcccgtcgacgaggacctctgcgcctgtgactacaatccccaccctgcctcctcggcgagcgcttcgagaacggcgacccgagtgggcacaccgtaggcgtactgcaggccatcgagcatccgaggggacgagagcacgatatcgtccaattcgaccccccgattgacgggcccgggatggagcaccacggcatcgggccgcgcacgctccaggcgatgcccgctcagctgaaacctcgcccgatagcccgacagatccacgcgctcgttcgctcccacgcgctcgtgctggatacggagcatgtagaagacgtcgacctcgtcgaggacgtcatcgattccatccgtgacgcccacggcaccaagggccttcggatccaacgaccactcacggggagcgacgccgaccacctccgcccccaccgaagcgagaagccgccctaccgaacgcgcgacgcgcgagtggcgcagatcacccacgatcgccacccgacacccctcaagcgcgccaaacgcatccgcacgcccgccccgagtccgagcaaggacgcagacgtcttggagcgcctgcgtcggatgctgaccgacaccgtcgccagcgttgacgacgatgccatcgaagaatctggctaccacgtcggccgtaccaacccacggagcccgcacgaccacgccactcgtcccctgcgcagccagcacgcgcaacgtgtcgcgaagactctcatccttgacgagcgagctgctctccggatcgatgcggacggtccgcccgccgagccgatcgattgcagcctcgaacgacagcgccgtacgcgtcgacggctccaggaacagcaacgcaacccgtcgcccctccagacaccgcgacgccgccgcgccatgaacgagctcgtcgacacgcgcgcccagcacgccaaggcgccccgcatcgagctgctcgacccccaggaacgttgcgctcatcgcccttccgcctcgatccacacaccggccgcatcgacaaccacgtactcgttacgcgctgtcggcaggttccgacccacgatgtcgggccgaatcggcagctctcgatgtccccgatcgacgagcaccgcgagcagcacacgctgcgctcggcccgcacgcaagacggcctcaagggccgctctcgccgtacgcccagtgaagaccacatcgtcgacgaggacaacggtccgtccctcgaccttgatcggcggcaaccatctcggatcacctgccggctccgcatcgtcgcggaactgcgtcggatccacgacgaccaacggtaccgctacggagcgaatcgactccaacgtgtcgacgaggccacgagcaaccgggacaccgccgtcggcgatcgccacgaccacgagatccgctccaccgcgcgtcgcctcgacgacctcatgcgccatccgacgcagtgaacgaacgatgtcgtcagcgtccaacacacgccgccgacgcatcgcaacctccgtttcggcctcacaggaccgtccttaacggctaccacgacgagcctagcgtgtcggctctcgccgcggcacggacggacgaacctcacacgcgcgcccgagaacgatcgatggcggggagcttcacgccccccgccatcgtcagcgaaccagcgagatcagccggaccctaccggcggctaccgagccgccgccgagcgaaaaatccgaacaccaacgacgctgcgaagatcccgatcggaatcgcgaacgtcatgtcagccgctgctgagtatccggtgacacttgcgaacattgacactccctcttgttgtcgtcagccccaacacgaaagacccatgacgctcctactgtatcgcgacgagaccagctcgggcgaccactaccaggagcactacaggaacaactctaccgacccacggcagcgaaccaccggccgatctacgggcgccgtcgcaccgaacgaccgatccgcacaccaccagtgagacgccccttgagcccgtcccgttcctcggcgtccaaccacagcttcatcttctgcgccccgagcacgaaccacacggccccaccgccgatcaccaagatcgccgccgcgatctgctggtcggtcatcgcgccaagaatcccatcctgatggaccaggtagccgtaccaggtgcccggtgcgaggcccatcgcgatacccacgcccatgatcaccatggccgaggtccacgcgacgatgacttgacggatgtgggtgatctggggcctgccgtctcccatcagcaccgccattgacagtgctcctgcagtcccttgggcaagcaacgtcgccgtaccgacgaccggcacggcgtggatccatgactgccagaaaccctcgaactgacccacgaccaacaggtcatcggcgacggcaaccagccagacccatcgcaccgcccacgcgacgagcggcccacgcccagcgagcggctcgtccgactgcgtcaactcgtgccaaaagagcgcgagcggcaccgccaggaccacaatgctcaccagtgcatgcaccgcgaccacagccgcggacgccaccatgaggagcggattcgccaccagaccgagcgccacgacgacccaacccactcgacgccacatcgaaacgcgaccgcgtcgaatcagagcagccccaacggcgacgacccccacgctgaggagcgccgcaacaacgttaccgatcacgccagcacccccttgcgacaactcctcgcccgacgacgaccctctgcatccaggccatccgtcgccgggaatcgtgctggcggggcacccggaaacccgcgtgccccggccaacactcaactcactcgagttcccaccctcctagtggaggatgaagtacacgtaccacgaaaagatctggaccaacacgaagaagatggagaaggccccgaagccatcgaggtttgctcggaagttctccgccaggcgatggctcgaaacgccgacgccaccgtcgacccggaagaactggtagctccgaatcgcccgcatcaccaacacgaagatccagtaggccgccaggaacaaagccaacgcattcatcacagcgaacgcgatgtacaccccggcatagccggaatacccaggcgggaacggcaatctcgtcaggctccagatctggaaccccatggcgagcagcagcaacagcacattagcgaggcctgccacgatgaagtccatcgtgaacccacgccgcaggcgccgattcgcaaacagctgcaccagcagaccagccagcgggagcagcatgacgaggaagccaaggatcttcgaggccgtcaatccgtgtggatcccacaggccgttggagttcaacgactgaaggtagaagaacgagaagtagatcccgccgtagaacgcagccgcaaccgggatcagcgttcgagacgccgtccacagcgcacccagctgcgcatcatggtagtactgctcctcatcgatcgcaggcggctgggcctgcacacccgtagccactactcctcacctccagcgacgacagcggcctgctcagccgacggatggagctcggcaaccggaccccgatccttcacgccgtactggtacgggctgcgaagcacgaccggaatctcctcgaagttgtcggccggtaccggatagccaacctgccactcaagaccctccgagcgccacgggttcggaccagccggcgtccgccagacggcgagcgaccagatcagattgaacacgtagagcaggattccgaagccgagcacgtacgaggagatcgacgcgaactggttcaggtgctggagccgaagggcgtactcgaacacgcggcgcggctgacccagcagaccgaccatgaagagcggcaagaaggtcccattgaagccgagcaggatgagccagaaggaccacttcccgagcttgtcgttcaaccgcacaccgaacagcaacggtgtgtagtagtagatcgcgccgagcacgatgaacacgagctgacccatgatcgtgaagtggaagtgcgccagcacgaagaagcttccgtgcaccaacgtgtccaccggcacgtccgagttgaacactcccgtcacgccgccccagaggaagttccagaacacggcgagaacgaagagcatcgggacctcgaagcggatctttgcgcgccagagcgtgcccatgctgaccaggtacaagaagccggtcgggatcgagatcagctccgtggtcagcatgaacagcggacgcatgtccgggttcatgcccgacatgaacaggtgatgctgccacacgaagaagctcagcgcagcgataccgatcatgcccgccgccgaggtcttgtaggcaaagaccggcttgcgtgcgaagaccggcaagagctccatggtcatcgcgaagccaggcatcgccatgaggtagacctcgggatgaccgaagaaccagaacagattctcccagaggaagctcgagccgccgtggcccgcatagagcatcgacgtgcgcacggcacgatcgagacccatgatgaagaggccatctgcgaacaccggaaccgagagcaacatcgtgaaggccgtcgtcagcaaaccccacaccaggatcggcatccgagaccacttcatccccggcgcgcggtagttgatgatcgtcgccaccatgttgagcgaaccgatgatcataccgatgccgaccagagcgaaaccgacgtcgtaatcggactgtccgggtccaccctggatcgagagcggtgcgtagccagtccaaccggcctggaatccaccctgccacagcgccgagatgatgaccatgtacgccgcgacgaggagccacagcgacaccgcctcgaggcgggggaaggccatcttcttcgacccgatcatgagcggcaccaggtagttaccgaacggaccgagcacgagcgacgtcgccatcgccatcatgatcgttccgtgctcaccgaccacctcgatgtaggtatcggccgcccagatgtggtacgtcggcgacaagagctccgtgcggatcgcaagcgccagcaaaccaccggtcaggaagaacagcagcgtgacgaacaggtactgcacgcccacgaccttgtggtcggtcgagtacgtgaagtgctcccagaacgtccgcttctccgacttcggcgggtccttcggttcccatccgagaagcttctggatcgggtagttgaagaccccgagtccagcgagaaagcctacggcaccgaagatgagtgccaagtacacggcgatctcgttctggccggagttcactaccaccgtatagcccgaggcaatgaagttgccgagccaatggccgaacgcgtagaagatcgcgcctccaacgaggccagtgaagaagttgcccgtgaaccacgcacgtgcgaacttcaaccctcgagcctcgaggtcacgctgatcgacgatcgccgcgctcggcgacatctcaacagccatcgtttcgttcccttcctcagcgttcctagtacgcaaccgagtgaccgttggggtcgtagctcgggtagtagccaccaccggcccccgagtacgacggcgtgtacgtcaacgcgaacggcggcaggagcttggtcacaccagcgttcgcagcctgcatgttcgtcgcccacgtctcgaacgacgatgctggcaacacctcgccgtagttgtacatcgcaccatgccagatcccgcaaagctcgtcgcaacggacggtgatcttgcccgtctggctcgtcgtctcggtggtcgcgacgttgttgacgcccggattcgcatccgccttgactccgagctgatacgcccagaagtcgtggatcacgtccagagacgtcacatcgaagaccacgcgcgcgttggtcggcagatacagctcagtggtctccatccccccgaactgcgggtaccgataggtgaaccgccactgttgcgcgatgacctgcacgacgagcggcgtcgagcctcccggcgtccacgccccctgcggcgttgcctttgcccatgagtagttccagatcggcgacgggccagacccactccccatgtcatggttcgcgatcagctcgtaggtaccgaataccgccaggccgagcacgagcacggtcgaggccacgtaccagattccctggatcttccgattgccgaagaggacaatgccatcctggtcctcttcacccttacgggctcggaagttcacgagtgcaaaaccaccgtacacccagaccatgaacaggactgggaccacgagcaccatcagaatcttgaagtcgaactgctgggccgcagccgacgtcgtcatggtgccgggcggcatgtggggcccccacacgaaccacgtcagatagtcgacgatcgccgtcaggacgaaccagaccgcaaagatctgccaccccttggatcgcgcgaaagccttgcgctcctcacgctcctgttgtgtcagcgccatcacgccaccaccttgaagaagccagccatgtagccagtctcggccataggaccaccgttaccttcgaggtagccaacgccgcacgggatgaagcactgccagcggtaggtgtgcgtcgtgttgccggagtagaacgtgaaggtgatcacgttgtgcgcctccgacggattgcacggaccctgctggcagaagttcttcgcattgccgttgacgccccacaccgggatgttcaggccgagcgacggggcatcgatggtgtgtgcgacaccattccccgaggcagcatcgagaacgctgaccggcttcccgttcagatactcgacaccgccctgcgtccccaggaccttgccccagtaggggttccgcaacggcccgcccgagtcgtactcgtagaccgtcacgtgcacgtacgtcttctcaggaacctgatagatcgtcgtgcgtacccacttgccagcggcatccttcgcgtaccagcccacccattgcgggtgaggaccggtgccgacggcaccctcgacctgcaacgtcaggtcgacggtgttcggctgtgtcggcgacggagttgccgccaccgtcggcgggtacgttcgcaagtatccgaagatgccaaacaggatcaacccgatggcgatcgccgcggatacaagaacgatgcccgcccttgctcccttagacaacctcaaccccctatcacctagggccttccccactgcgcctccggcgaggctgcgagcgcagctgctcgaacgagctcactgcacccggacgaacctggtgctaaccgtggtgggccagcgcgtccaacttccgaagccagttctccaaggtggacgacgaaatttgaccctgcaccgcaccgatgacgcgaccgtcgggtgcaacgaagaaggtgtcagggatgcccacgagcaggtaggacgactggagcgatccggcgtcgcgcacgactggatacgagacccccgtgcgcgccagaaaggcgagtgcagccgatcgctggtcattttcgtccacaccgaggaatgcgacgctcccggcggaagccgccgccgccttggcgagcatcggcgtctcggcgttgcacggtccgcaccacgacgcaaagaagttgatcaccaacggacgcccacggaaggatcccggtccgagcttcgacgcgctcgaatcgttcgcgaggaccggcagcgaaaagccaggcaccgtacgacccacgagggccgaaccagacgacgaggccgtgagcgaggccgaggccccgttcgttgcggatcgcgcaacacccacggcgtacacgacgtacccaaccgcgaccaagagcgcaagcaccatcgcgaacatgaagacgcgggggcgccggcgaaggtcggactgctcgtaggtgctctcactcgtcgtccgcgtcacctcgacctcacgatgacatcgacagccatcccgacgaacagcaaggacaggtacgtgatggagtaggaaaacacgcgcatcgccgccttcggagagagggagcgcaggagacgtaccgcataccacacgaaccccgcaccgagcaggaccgcagcggcgtcgtacacgaggccgagcccggcgaccgggcccaggacgagggccaggagcaccagcacgaccgagtaggccacgatctgccacgccgacgcgcgacgcgaggcgaccgaaggcagcatcggaacccctgcagccgagtagtcgtcggcatagcgaaacgccagcccccagaagtgcggcggcgtccacacgaagatgatgaggaacatgagccacgcggcgagcgagagctcgtcacgcaccgcagcccatccgacgaggaccggcgccgcaccggccgctccaccgatcacgatgttctgcgacgtcgatcgcttcaaccacatcgtgtacacgccgaagtagaacagcgccgccgcgagcgcgatcgaagccgcgagcacattggcgcccacggacaggatcgcaaacgcggcgacctcaagcgtgacagagaagatcagggcgccccggggcgacacatcaccggtgacgagcggacggcccttcgttcgccgcatgaccgcgtcgatatcacggtcgaaccacatgttggccgcgttcgcaccgcctgccgcaagggtgccaccgaccacggtgatcgcgatgagcgagagggatggcaggccacgcttcgccacgatcatcgccggaaccgtcgtgatcaacaggagctcgatgatccgcggcttcgtcagcatcacgtagccgcgggctgtccgcacccagctccgagagtcttcgaccagcaccggcgacacccctcctcatcacagccacctgtccagtcattcgggcaggacggcgtgctcagcactcgttatcctaccaaccaggtcgtcatctcgtcaaccggaagcaggctttcgtgcatacgcaagacacatcgcctcggcgttcgctcagcttgaacccagccgcgctcgaccgcgcgccgggtccctccatggttgggcaggtcaggggcctgctgtccggacaagctgcgacgacgctggtcgttgtcgacccagcatggatccgctacttgacgggattcgacggttcccacggcaccctactgatcgatctgcgcgatgaggatcggcaccttctgtgtacggatggccgctacgtcgaggctgcgggtcgggcacttggggcgcgagggctcgacgggctcgttgaggtgctcggagacgaccccctcaccacgtcgcatcaccgagacctgctgcgcgcaccactcgctctgctcggctcgtgttggtcgctctcgaccctacgactgctgatggagatcgatccgactcccatcgacgcacagcctctcctctggccgcttcgggccgtcaagcaaacctgggagctcgagcgcatccgcgcggcagcccgactcgcggacgacgccatggatgctgcccttgcgtcgctcgccgacgggccaatctcagaacgccttctcgcggcgacgtacgagttcgagctgcgtgcacgaggagccgatgaacccgccttcgcgaccatcgtggcggcgggatctcatgcctccgaaccgcatgcgaggccgagcgagcggctgatcaggccaggcgacatcctgctggtcgacttcggcgcaacggtggacggctatcgctcggacgccacccgcacgatgctgccgagcgaaggagcagaccctcgagtccaggcgtactgggacatcgttgcggcggcccagagggccggaatcgcagccgcgaccgtcggcgcgtccgcgcacgacatcgagacggcagcccgcgccgtccttcgcgaggccggcgtcgaagagctcctcctccatggagtcggccacgcgctcggcctcgagatccacgagcggcccttcaccgcgcacgatcgagatcccctcgccgaagggacggtcatcaccgtcgagccgggtctctatgtacccggagagcttgggatccggctcgaagacacgatcctcgtgggcgcagaaggcccagagtgcttgacccggcccgcgaccgagtctcgaacgagaccaggttccgcagctcgcgtgcgcagctaagctggtagctcgcatcgcgcggacgtgcgtccgttgcgcccattcactgttccgcctcggaaggagcccctatggcagtcgctacctcgacgaatgacctcaagaatgggatgaccctggacctcggaagcgacggcctctttacggtggtggagttccagcacgtcaagccgggcaagggcggagcgttcgtgcgcaccaagctgaagaacctccgaaccggcgcggtcatcgaccgtacctaccgagccgacgagcgcatcgaccaagccatcatcgacaagcgggagatgcaagcgctctatcgcgatcaggacggctgggtgctcatggacacgcagagctacgaccagatcacggtggatgcggcgaccctcggatccgcgatgcagtacctgcgcgaagggagcacggtgctcgtcctcagctacgaaggctcgatcgtcgccgtcgaactgcctgctgctgtcgagctgaccgtcaccgagaccgagcctggtctccaaggcgaccgagtctccggcgcccgcaagccagccacgctggagaccggactggtcgtccaggtccccctcttcgtgaacgtgggtgacaccgtcaaggtggatacgcgcaccggcgactatctcacgcgtgcctgaccgacgcgacgactcgcacgacgtgcgcgccgtttggcgcgagcgcgtgctggagctgctctacgaagccgatacgaagggcgaagcgcccgcggacctccttcggggggacgagccagcgttcatccgcgaacggatccgaggtctgacggagcgacgcagcgagatcgacgcacagttgacggcccacgtcatcggatggcagctcgagcggctcgcacccatcgaccgtgccattctccgactggcgaccgcagagctcctggaagcatcgacgccgccctctgtcgccattgcagaagcggtgaaactcgccgaccgctattcaaccgaacgttcggccgcgttcgtcaatggggtcctcgcctcgatcgccgtcgacatcgctggcgagggccaccgcggcgagcccgaccgcgaacccagctagctcgcgacgcgaccgagttcggcacgcaagaagctgggcatgccgctcgtcgagctcagctccacccgttgaggcgagatgccgagctggcgagaaacgctcgcaagctgtgcgttcgctgttgccaggacggtgtccatggtgtgcaggcgccctgcgatcaacgtgacggtgctcatgtcggtcggatgcaccagcagcgtcttcatgtacgcgagcaccgacgctgcgttcgggaacgcccacgcgtagacctccttgaccaccggcgtcaggttgaagtggttcaaggagttcggcggtgcataggtcgccaagttgtagaggtccgagttgaccgcgatggtgcagtactcctcgtcttgttcgatgatcgttcgcgcctcggcgagctggttggacgccttcgagacgatcgcaccgagcgcccgatagccgtcgttgagggcgaccgcacagccccctgcgtcctgctgcatcgtctgcacggcgccgcggaaatcgacgcgctcttgggcaacggtcacgcgctgcgggtacacgatcgcggcctcgatggcgacggacgcgacgaccactgcgccgacgatccagagcaccttgcgacggcgagcaggcgtccggggctcaagcgttggatcagctcggttgacgggtcggggcactgtgctcctccagatcgagtggttcagatcgcgtggcgacggggccgctgctacgccctctcggcgagggccggttcgctctccagtctacggacccacacgcactcgctctcgcaccatctccacgagggcgagcacggcgagttcataggagcggggcccgaacccagcgatggatcctgccacgacgcgcgcgatcgtcgaccgatgacggaatggttcgcgagctgccggattcgacaggtgcacctccaccacggggatcgtgatcgccgcgatcgcatcggcaatcgcgtacgacgtatgggtcagcgcgcccgcattgagcaccacaccatcgaccgatcgaggcgcacgctgcaggagttcgatcacccgagcctcgctgttggtctgctcgaaggtcacggctgctccgaccgaggccgcacgttctccgacgcggcggcgcacgtcctcgagcgtctcggtcccatacacggtcggctcccggaccccgagcaggttgaggttcggaccatcgatgacgagcaggcgcaccgccgtcatgcgcgtgcctcgtcgattgccgcgacgatcaccgcctctggcacgccgtggaccagctcgagaccgctcggtccatcgaggaccatcgcgagtgaccctcggtgcttcttgtccgctgcgagaaagaccatcacctctgcggccccgatccacggcggcacgcgatgtgcgaggccgagacgcgccaccacctcgacgtgctggatcacgcgatctcgcgtgatcctgccgagacgctcggcaacgatcgcctcgaccacgaggccgatcgccaccgcctcgccatggctcaagggccggcgacgcgccaaggcggctgcctcgatggcatggcccaccgtatgcccgtagttcagcagtgcgcgctcaccgtgctcgcgctcatcgcgctccacgacgcgcgcctttgcctgggccgcctcggcaaccgcctcgtcgagcgggagctcgaccagacgatcgaggccaaggaaggcgtacttcgccagctcgccaagaccacttcgccactggcgacgaggcagtgtcgccagcacatcgaggtcggcgacgactcgtcgcggctgccagaaggcgccgacgagatttttaccggcacgcaggttgaccgcggtcttgccgccgatggccgcgtcgaccataccaaggagtgaggtcggcaccgcgacgaagtcgatgccacggtggtaggtggcggcaacgaaacccgccaggtcggtgaccacccctccaccgatggcgatgaggccatctccccgagtggccccggcgctggcgagctcctcagccacccgctccaccaccgcgagccgcttggcgcgctcgccattgggaacctcaatgacaggccagggccatgacgcagggaggggaatcgcggcttgggtcaccacgaaggcctggcgccagtcctccgggacgatctcgcgagagtcctggaggatgccgctcccgaccgtgatggccacctcgtgctgtggcgttcgcatcgagaaccggcgggtcgcacggcctcgcgctgcccacgctgatcggagtgcgctcggaggaccttgcaccatcagcgctccagcgcaccgtcgcgccacggtagcgccgcctcgtgtgcgagatagctctcggcgttgcggcgaaactcggcgatggagtccccgccaaactttctcagggcttcgtccgcgagcaccaaggccaccatcgcctcggcaaccacgcccatcgcgggcaccgcggtcacgtcggtgcgctcgcgaaaggcgatcgaccgctcccccgtggcgagatcgaccgtctcgatcacaggccgattcagcgtcgcaaggggcttcatccacgcggttgccacgatcgggctcccattgctcacaccgccttcgatgcctccagcgcggtccgtcggacgctcgagctgcgaacccacgatggcatcgtgcgcgagcgaccctcgcacgcccgcgacctcgagcccggcaccaatgctgacggccttgacggccgggatcgacagcaacgcctgaccgaggaggccatcgagtcgacgatcccagtgcacgtaactccccaacccgaccggcacgccgtgcgcgacgacctgggcggccccgcccagcgagtcgccaaccttcgcggccgctcgcacctctgcaatcatcgccgcctcgacagccggatcgagacagcgcacctcggaggcgtcgatacgctcgcgatcaccaagcgtcggcacggtctcgacgctcacccgggcggcacccagctgcacgacgtggctcacgatcccgacaccgagaacgccgagcagggccttcgcaacggcacctgctgcgacccgagcagcggtctcgcgtgccgacgctcgctcgagcacgttgcgagcgtcatcgaagccatacttctgcagaccggcgagatcagcgtgaccaggacgtggcgccgtcaacttccgggcggtctggcccggatccggcgacatctcctcggtccacttgcgctcccactccgagttggcgatctcgagcacgatcggcgatcccaaggtgcgtccatgacgcacgccgccgatgatcgtgagcgcatcctgctcgaagcgcatcctcgggccccgcccgtagcccaagcgccgccgcgcaagctcagcgctgatggcgtcgccgacgagctcgagtcccgcggggacaccctcgatgatgaccgcgagcgcacgtccgtgcgattcgccaccagtcaaccagcgcagcatgcgctcaggctagcgagacgccgagcgcactcacgtgagtgccgtgagccacgatcaaagccacgagcgcacccaccgcgatcgctggcccgagaggcaggcggtcacgatggctcccgccgcgcaggagatgccagagcgcaccgagcgcgccgaggctcaaggccacgagcgccgcgaggaccgggacccaccagccgagcggcgcctccacggctccgagcatgccgaggagggcaatatcaccacgaccgagccccccgcgcgacaaccagcgtacgagcatccacgcgcccaccacggcgagcgcaccgccgatcgctgcagccacagcgcgcagcgcgtggggaccgagtccgaagatcacgacctccgtgaccagcgcaccatcgacgagcgagcgcggaatgcgtcgggtctgccagtccacggtcgcaccgaccaccgcgacactccaggcaagcgcctcggcgacgagcgcggcgcccgtcacgcccgaccagctgagccaccacacaccaagacccgccgccacgccagcgccaccatgcaggaacgtcgcccgtcggctcttcaccgcgccccgccgacgggcgagcggtcccacggcacaggcgaccagagcggcggcaaccacagcggctgtcgcccggacaacagcgacggacacgtacgatccgtcgaccgagtgcctccaaaggtttaccgttcggcaagatccgaccactacggtcgagccatggcaccgatgagccagagcgccgacgaccaggactggcgagcattcgacgggctctggaatttccgacccgtcgaggcaatccttgccaacggtcaccgactccgtcccggcaggcttctgcgctcggagcaaccgtaccgactcgacgccacccaacgacgccaactcctcgagcgctacgcgattggcaagatcctcgacctccgaaccgccgaggagtgcgccccgacggagtccatcgacgcgccacgaacgcacctaccgctcccggacgtctcgcgtgacccacgcatcgcagatggttcgcgcaacctggccggtgcctaccgcgcgatgctcgacgaccacgctccgacgttggttcgagccatcgacgccatcggggtgccaacgccggtgctcgtccactgcacggccggcaaggaccgaaccgggatcgtcgtggccctcaccctcgaactcgtgggcgctcggcgggacgacatcgtgcgcgactacgtcgagagcggacgacgtctcgcggcgttgaccgaacgtgccttggctcgcggctacgagccgacgtggcgcgagctcgcgcccgaagtgctcggtgcgcctccggctgcgatcatcacggttctcgagacggtcaaggaacggtggggctccgtggatcggttcctcatgacgttcgggatgacgccaatgcgcatcgaggcgatccgaagctcgctcatcgcatgacgccacgattgcacgcgcgccaaccccaacggctccgcccgaggccggcgtgtgcggcgccgcatcacgagcgctcgcgctcagtcgctcgcgtcgaccccttcaagggccttggcgagcaggttgccaagctggcgcaattcctccggagtcagtcgactgccaagcgcgccgtcaagcgtcgcgaccacaacgggctcggctcggcgcgccaccgtgcgtcccgcctccgtgatcaccgcatacgtcccgcgccgatcggtcgggcagccacgccgcacgacccactcggcttcgaccagccggtcgactcgccgcgacagcgcgctgcgcgacaccaaggcagcatcggcgagctcggacaggcgaacccgtccctcgggagcgctgtcgaggtggtggagcaccaagaactccccgagaccgatgccgcacgcgctctcgagctcacgatcgagcaggtcgacgagccggccctggagaacgagcagcgtgccgaacacctcccgggtcagggggtgctgggctgttcggacaggcgtcgacggcgatactgcttgcatgtgcaactacaactcctatacttcagcatagtcaggaacccatgacacaaggaggaaagcgatgacgctgagcgcacaggatctcggcatcgacacggggcggtggaacatcgacccgacccactcgacggtcgagttcgtcgtcaggcacatgatggtttcgaaggtccgcgggagcttcgagaagttcgagggctacgccgacatcgccgacgacgtcacgcagagcacggtcactgcgaccatcgacgcatccacgatctccacgcgcgacgagaaccgcgacaaccacctccgcagcccggacttcctcaacgtgaccgagttccccaccatcaccttcacgtccacccgcatcgagcccgcaggtgagaactggaagctcgtcggcgaactcaccatccgcggcgtcacccgtcccgtcacgctggacctcgagttcaacggcacctcacccgacccgtacggtgggaagcgtgccgggttctccgcgaccggcgagatctcccgcaaggacttcggtatcgagtggaacgctgccctcgagaccggtggggtcgtggtgagcgacaaggtcaccatcaacatcgagatcgagctcgtcaaggcgtaaggatcgagcgaccatactaccgagaaggggccgggtccgaagacccggccccttctcgcgtaccacgagcgcacggcgggcctcacccggatcccgatcgcggtcacgacgagccggtcacgacgagcgaggtgcgcaaaccagggccgtcgcctacttcttctcaggttggtagtacgggttgttgccggcggcgtgattcgtcacgtcgacgacgtcacgaatctcgggtacggcatctcgaatggcgaccgcgatgccctgcgtcagggtcgcagaagccagtccacacccctggcatccaccacccatcaacacgtaggccacctcgtcgacgacgccgacgagttccgcatacccaccgtgagctgcgatggccgggttgacctgctcctgcaggatgctgtcgacacgtcgggcgagatcgctcgtgagcgcctcgggaccgaactctggtagatcgctctggcgcgtcggggcgttcggattttcaatgacgaggtcgccatcgtcgccgacgtcgagcgtcgcgtcgcgcagcgcctcgatcgacgccgcaggaatgacgacaacgagatcgcccacctcgacgatggcgtctgcaccggacgccatcgccagctcctgcaggtacacgtcgtaggtccactggtcgcccgtcgaaccagtcacctcgatccagagcgcgatcggcgcctccgcttgctcttcggcgatcgccgcagcgacgacctccgctgcacgctgcgacacagccatcagtcccaccgcgcgcctccttccgctcaccactacgatcctatcgacgtggcacgccttgccctcgtggtccccgcgcatagttaccgagggaacgatttcctcgcagctgcaacgccacaccagctcacgatcgtcaccgatgccgaggagccactcggaggtgaccacatcgtgcgatcttcgctctccctggatgcgtccgagacagatcgcctcgcccaggtcctcgtcgagcgcagcgtcgaagcggtcatcggcgtcgacgagtactccgtccagctcgcagccgatgtctccgatcgcatgggactcagccacggccgtggggaggcaatccggcgggcgacacacaaggaccaactgcgcagcaccctcgatcgcgcggaactgccacagccatcgtggcacgtggccgacagcgtggccgccatcgacgtcgactggctcgagcgcgcgctcgggcctggcccgtgggtgctcaagcccctcgaccgaaccgcctccgagggagtcgtgcgcgtcgatgcgtccacactcgcctggggacgcgaccaactcgcagccgtcgtcggatcgcacgcgccggtcctcgccgagaccttcgtaccgggagccgagatcgccgtcgaggcgatcctgaccgacggcgcactcgagatcgtcacggtcttcgacaagccagacatcggcgatggaccgacgttctgggaagcgacgtacctcgctccgagctccatccctctctcagtgatcgaagaggttcgtgtgctcatcgaacgagctgcacgcgccctcgacctccacacgacgccgatccacgccgagttacggctccctgaaggtcggccggtgatcatcgagctcgcgccacgcaccatcggcggacgctgtgctcgagccattcgtctcgacgacggtcgtcatctcgaggatctcgtcatcgagcgggcactcaaccagccacgcacgatccctgcggcccgccgtggtggccccatcggtatctggatgctccccacgccccacgacggcaccttcgagggtctcgacggcgtggaagtggcggcagcgatcccaggcgtcgagcgcatcgagatgaccacgaccgccggcaccacggtgtacgctcccccacgaacccgcagctatctcggcttcgtcttcgtgagcggacgaagccgccgacgcgtgctctccacgctcgatcaggtccgttccgtgcttcgtccccgtgtcgctcccgcttcctagactctgagcggtgaccgctccgcgtaccgacgcagcacgagtactcctcatcaccacctacgacctcggacaccgtccccaactcgcggcgttgctccaggccgagctcgccgaccgactcacggtggtcgacggcaaggccgatgccgcagtgctcgcgagcgagattcgatccgccgactggatcatcctcaccacaccgatgctcaccggcgcgctgatcgccgagcaggtcctcgctgctcacactgacctgctcgccgctcggcacgtcctcctggtcggcgcctacgcaacgacgacgctccacgcgctcggcgagacacaccacgggatcatcgcactcgaccgtgacgatcctgagctggtccttggcgccatcgaacccgagcgaccgctccgccgaggcgggcgtcgtcactaccgcgtgacgacgagcgaaccgctggaccgctatcgacacgccgagcgcaacgggagctggcagctcgccgggtacgccgagaccacgctcggctgccgccatggctgcctgcactgcccggtcgccggcgcgtggcacggtcggatcgtgacgctggacgcgactgacgtgctcgccgacatcgatcgccaggtggaagcgggtgcctcccacctgtcactgggcgacgccgacttcctctcggcgccccgtcatgcgctcgccatcttgcgctcggtccacgaacgtcacccgcagctcagcgtcgacgtcaccatcaagattgccgagctcgcagcggatccaaccctccccgcgcgtctcgccgaactgggcgtcgccttcgtgatctccgcggtcgagtcgcttcgcgacgacatcctcgaccgcctgggcaagggtcaccacgcgcacgacgtcctggcagctcgtgacgcgctcttcgcagcaggcgtcggcctccacccgaccttcatcccgttcacgccatggagccgcctcgaagaccttcacgacattctccgcttcgtgtgggattcgcatctcgaagacgtcgtcgaaccggtgcagtacggcatcgagttgctcgtgccgacgtcgagcctcctcgagatcggccccgagttcggcgacttcgacccagcgacgctgagtcggcggtggaatccgagcgaccctcgtctcgatgggctcgctccgcgcatccgcgccatcgcagcgcgcagcgctcgctacgacgagggcttccgagccgtctgggaactggcagggctcggtgctctgccgtctcgcgggccgcgccgagcacccgcgcccaccttgatgagcgaggcatggttctgctgcgcagcgcctccacgatgaccgacctcgacgacctgctcgatggtctctccgacgcccagcgcgaggcggtcctcgccccggcgcccgttcgggtcatcgcacccgcaggctccggcaagaccctggtcctgacgcgacgtatcgctgctcagatacgactcggcgccgtacgaccccgcacgtccgcagcgctcacgtttacgagagccgccgccttgtctctgcgtcaacgcctggctcgcaccctggatacgaccttgccgatcaccacgacgatccatggtgctgcgctcgtctggctgagcgaactcgctcggctggaggggaaggccctcccaccagtcgtggagtccgaaaccctcgtgcgcgccgcgcttccgaacctctcgccggcggagcacgcggcggtgagagctgccctccgcggccagcgaccgacgtcacccgcgcacgaagcgcacgtccgcgcggtccatgagctccgacgacggcgacgcgtcatcgatctcgactccatcgtcggagagctcgcacgacaactcgaacgccagcccgaacggcgcggactcatcgggatcgaggcgctgttcgtcgacgagttccaagactcgacgcccgaccaacttcggctgttccgcgcgctcctcggtccggatctggccggactcaccgtggtcggcgacccgaaccagtccatctacggctggaacggcgccgacccgaacgtactcaccgacctcgaaccgcccggcttgcgcaccgtgacgctcacgacgaactaccggagccgcgacgagctcgtccgtcacgcgaccaggatcctcgatccgcagccacacgttcgaggagcacgtccaggcggtcgaccacccacgctgcgcggctacgccacgccagagcgagaggctcgagcgctcgtgcgcgaactcggcgggctccacgcgctcggtgtcgcctggcgtgcgatggcggtactctcccgcaccacgcgcgcactcgagcccgtgacggcagcgctcgaggccgccgagattccagccgtcgtgctcggacggacgcgcacggtctcggccatgctcgcacgactgcgctcgctgcgagatcgacgcgcgaccgtcgggcacctgatcgacgagctgagttcgatgcaggtcgacgacccttcgcaccagcacgagctcgaccaagttcgcgacatcgccatcgaactccaccgtgtcgatccactcgcagacctcgcgaccttccaggagatcctcgagcagcggctggcacggcgtctcgacgcggtcaccatcgcgaccttccacaaggccaaaggcctcgagtggtaccacgtccacgtcctcggcgtcggagagcgcgcactgccgcatccgcgagcacggacgagcgcgcagcgcgaggaggagcgaaggctgctctatgtcgcgatgacccgagcgaccgattcgctcagcgtgagctggcatggcggggggccgagtccgttcctcgcaccgatcgtcggtgatcgagcacccctccgccccacgccgagcgcagcggccagaggagccgtcgcgcgccaacgcgcgctgcgccatgccctcgtcgcccaacgagctcgcctggcgcgcagcttcgcgatcgcgccgtcgatgctgctgagcgacgagagcatcgagaccttcgtacgaaccccaccacgatgcgcggacgacgtggtcgcgcacctcacacgcgttccgccagccaggcgccgcgcggtcgctcgcgccatctgggcgtgcgtcagcgcgcctgccgacagctaagcgagatccacgacgagcggtgcgtgatcggaagggcgaggagcccgccgggcctcgatgtccacatcgaccgcaaccacgttgcgcgcgatgtcctcgctggcgaggaccaggtcgatgcgcatccccatcccacgacggaaggcgccctgccggtagtcccaccaggtaaagcccggatcgtcagggtgaagcgcgcgatagacgtcggtgaggccgagcccgaggagcgcatcgagcgcgcgtcgctcgggcaacgacacgtgggtcgcgccttcgagcgcggacggatcccagacgtcgtggtcgctcggtgcgacgttgaagtcaccgccgaccaccacaccgtcggcaaccaggtctgcgagatgtgcccgcagctcggccagccacgtcagcttgtagacgtagtgcggatcatcgagcgcacgaccgttcggcacgtagacactcatgaaccagcccgcctcgagcctgaccgcgagcgcacggggttcctcggtcgccagaggcgctcgcgcgaacccggtcccatagcgcacctcgcgaggagcctcgcgggtcaggaccgcgacgccgttccaggcccccgtgccccagtgggtcacgtgatagccgagcgagacgagggaatcggccgggaactgatcggtggccaccttggtctcctgcagcaggagcacgtcgggggcgacacgctcggcccacgccaccaccaactcgatcctggcgcggatcgagttgacgttccaggtcgcaagccgcatggtcacgcggtcggcgcgatcacgaacatcagctcgacctcggcgacgatcgcgtcaccgaccctggcatgtccccgaccgcgtccggccctcgtcgacagcgaggagagctcgacctccaatcgcagctcgtcgcccggcaacacctggcgccgaaaccgtgcccgatcgaccccaccaaacagcggtagccgaccagcgaagcgctcatcggcgagcacggccgccgcgcccagttgcgcgatggactccacctggtagacgcccggcaggaccggccgccctgggaaatgaccggccaggatcggcaggtcgaccgggacgcgccacctgcccgcggctcggagacccggctcgagatcgtcgatcgcgtcgaggagcaagaaggggggtcgatgtgggatcaacgtggtcggatcgatcgctgccacccgtcctcctcggtcctccccgatcgcgcccctcgccgcgccgtcaccggcgacctcgagcggacctaccctagcgggctaggcgacgtcacgaacctgcgacttcacggccgcgagcagggcaggcgtcactcgcttgagcccgtgcgcactcacgacgtgctcctggatgtgggcgagcagttcctcatccgtcgccgccgctgcatgccagtcgcacagggggatcacatccccgcaccggaactccttcatggttggccctccttcttgacgaacactggatctgtgacccggaccacgccgtcgagcccaacgcactgccgcagcgccatcgccgcgaggaacccaccgaggtctgcgcccggaaggcccacgttgcgctggccacgacttccctgtggcggcacgcttcctaccagcgtcatggtagctcaccgcgacgacgccggaccgaggttggcccaccttgcacccataccatcatcggcgaccgtccaagacgcaccgaacgacccgcgacggcttcacgacgccacacgccgcgccgtcggcgtcgacgaccacgatcggctcgagcgcaccgtcgtcgcgcacgagcgcccgttggagcagcacgtcgagggggtcttcttcgtggacgacgaggggtcgttcccaacgctggcgtcgctcgccgttcgaccaacagcagccgacggccaggggtttgcgccctgtcggctgcagcacccaccaacccgtcggcggtgcgtcggccagtgcgccgatacgttcggcaggctcaaggtactcgccagcgcagctgtcgttcgaacgtggcctgtggacgtgcatgagtcgttcacgcagcacctggtcgagatcgatcggctcgggtgatggacggccaaacaggtaaccctgcgcaagagggatgccgatccgcacgatctcttcgagttctccgtaggtctcgaccccctcggcaaggagccacgcatcgagttcaccgaggaatgcgccgaaggcggatgcgagacgactgcgcgccgcgtcacggtcgatcccgttcacgagccctcgatcgagcttgacgatctccggtcgcacgacgaggagcgccgcaaggcccgcgtacccggcgcccgcgtcgtccatggcgatgatggcgccgcgttcccgaaggaggtcgagtctcgcggggagatccggcaggtcatggagcggaacgtgttcggtgagttcgatgaccaacccctggagcgagggcagtcccacgacggcctcgaaggcgcgcgactcgagcgtcactggactcacgttgatcgcgagaaagtgctcgccgagcagatccgctcgtcgctcgagcgcagcgagcgcacacaaggtctcgagctccgcccccacgccaaggtcccaggcggcagcgatcacgcgatcaggtccgatcctgcccatggggtcgagccgcgcgagcgcctcgtagcccgcgatccgcggaccgtgcaggttgacgatcggctgcaggtgcgtgcgaggagcgatccgacccgtgacgagatcgtccacgaggtccgccaagcttcgcgggcggacaccgtcggagcgatcagcgcatcccactccctggagatccacgcccgcctcctgctcggctcctgtcgcttccagcagtggtgatctcggctgccggagcgcccacctgaagcgacggccgccgcggcgggctcacttggcgcgatgggggcgcgagcctagactgaagctgatggcgagcgcacccgacaacagcactgtgcagcattcggcctccgaacagttcggacccaacgactggttcgtcgaggagatggcggagcgctaccgagccaatcccctcctcgtgcctgagagctggcgtgcgtacttcgagggtgagcgcgtccccgatggcgtggcgacgaagaccatcgccaccgctacggcgaaagagctcgttggcttcgaggctccaggcgtcgcgacacctccgacgacggcgacaccggcgccgacttcgcctccgcacaacggagccacaccccagaccgcgccgttcacccctgcatcgtccccagaagccgtcgacccgctgacgccgccgaggagcagcgctcccgagacggcaccgcacgcgtccgaacccgcagtctccacgacgccgaccgtcccgtcagcacagcccctccgtggagcccagggcgccttggcacgcaacatggaggcctcgcttgcggtcccgaccgccaccagcgtgcgtgccgtgcccacccgcgcactcgaggtcaaccgggcaaccatcaacgatcagctccagcggctcggtcgatcgaaggtctcgttcggtcacttggtcgcgtgggccatcgtccgtgcgctcgtcgagcatcctcggatgcacgcctcctacgtcgccgacgccgacggacgcgggcaccccggcatcgtcatcccagagagcgtgaacctgggcatcgccgtcgacgttcagcgccccgacggcacccgctcgctcctcgtgccggtgattcgcaacgccgacaccctcggtcctcttgggttcttcgccgcctacgacgatgcggtccgcgcggtgcgctcacagcaggcatcgcccgacctcttcgtcggggccaccgcctcgatcacgaaccctgggacgatcggcaccgagcactcaatcccgcgtctcatgcccggtcaaggggtgatcgttggcgtcggggccatcgcctaccccgccgcattccaggctgcagacccacgactcctcggcgaactcggtgtctcgcggacgatcaccctcacctcgacgtacgaccatcgcatcattcaaggcgccgagtctgggcagttcctcgcgacgatcgccgctctcctcgaaggagaacaggacttctacgacgagatcttctcggcactccaggttccctacccgcccatgcggtggcaggccgaccacaccagcatgcagcccgacgcgaccgagcggctcgccaagcaggtccacgtccagagcctgatccaccactatcgggttcgtgggcatctgctcgcgacgctcgatccgctggacctgacccgtcccaccatgagccccgaactcgatccggcaacctacggactcacgctgtgggatctctcccgacccttcctcgctgaagggctcgtcccagggggtcaggcgtccctcgaaaccatcctccaggtgctgcgcgatacctactgccagaccatcggctacgagttcatgcacatccagagcccggacgagaagctctggatccaacaacggatcgagggctcgcaccaaaccctcacgaaggatgaccagctccgcatcctcgcaaccttgaacgacgccgaggcgttcgagaagttcctgtcgacgcgctacatcggccagaagcgcttcggtctggaaggtggcgagtctgccatcgtgttcctccgggaggtcctcgatcacgccgccgagacggggacacacgcagccgtcatcggcatggcgcatcgcgggcgcttgaacgtgctggcgaacatcgtcggcaagtcctatcgcacgatcttcgccgagttcgaaggcaacctcgacccctcgagcgtgcagggctcgggcgacgtcaagtatcacaagggtttcgagggacactatcgcactgcgagcggcagcgagctgcccgtcacgctcgcatccaacccctcgcacctcgaagcggtcgatcccgtcgtcgaaggcatggtgcgcgcgctccaggatcagcgtggcacgctctacgagttcggtgtcctcgggatcctcgtccacggcgacgcttcgttcgccggccagggcgtcgtcgccgagacgctcaacctctcgcagctgcctggctaccggactggcggcaccgtccacctcgtcatcaacaaccaggtcggcttcaccacgaacccatcggaggcgcgctcttccttctacgcctccgacatcgccaagaccatccaagcacccatcttccacgtcaacggcgacgatccggaggcggtggcgcgctgtgcgcggctcgccgtcgagtatcgagcgaccttccacaaggacgtcgtcgtcgacctgatctgctatcgccgtcacggacacaacgaaggcgacgaaccgagctacacgcagcccgtcatgtaccacgtgatcgagcagcacccgtccgtgcgccgactctacgcagatcagttggtacgttcgggtgcgatctcggaggacgaagccgaccaagcgctcgaagcgtacctccagcggctcgcgacggcgcttgccgagactcgcgaggcagcaccccccaagccgaccgagctgccgccagagccagcacgcgacgtcccactcccgatcgtcacgaccgcggtcgacaaggctgcgctcgactacgtgatcgagacgatccatcgggtgccagaggattttcacctgcatccaaagctcgctcgccagttcgagacgcgccgggccctctacgagcagggacagctcgactgggcgctcggggagctcgctgcctacggcacgctgctgctcgaggggcacgacgtccgcctcagcggccaagacacgcgccgcggcaccttctcgcatcgtcacgccgccctctacgactacgagacgggcgcgatggtccaacccctcgctcgcttgcgcgacgacgaggtgccggtgccgcacgcgtccccgatcgggcgcttcatggtgtacgactcctcgttgtccgagtatgcggcgatggggttcgagtacggctactcgctcgtccagcgatccgctctcgtcatctgggaggcacagttcggcgacttcgcgaacggcgctcagatcgtgatcgaccagttcatcgccggagcgctcgacaaatgggaccagcactcgggtctcgtgctctacttgccgcacggctacgaaggacaggggccagaacactcgtccgctcggctcgagcgcttcctcgcgctcgctgccggacccaaccttgcggtcgtccaaccgtcgacggccgcgcagctgttccacctcgtgcgcgcccaggttgcgcgcaccccacagcggccgctcgtcgtcctcacccccaagtctctgctccgtgcgcgtgagacgcgctctgcgatcgccgcgttcactgacggaggtttccagccggttctggccgacccgttggtcgacgacggcgagctcgagccgacctcagtgcgacgactgatcctcgcaagcggcaaggttgcctacgaggcaatggccaagcgagccaagggtgagctcgccgcgccgaccgccatcgtgcgcgtcgaccagctctacccctggccccgtgaagcactcgccgcagcactggcgaccttccccaacctcgccgaactggtgtggctccaagaggagcccgagaacatgggcgcctggccgtccgtccacgagctgctccatcgcatggacctcaatggggcgcggctgcgccacgtctctcgcgtgcgcgctggctctccggcaacgggctccgctgcgatgcacgcgctcgaacaagccgacctacttcgtcgcgcgctcgaggcacccctgccctaggccctcgcatgccgtgctcggctcgcgtgctcagtcgaggcgacgaatgaagtcgcggaccgcctcggcccaggccgctggcgccgacaggtgcaccccgtggggagcgcccctcacacagtaggcctcggcatcgatgctcgccatgagtgttgcaagtcctcggcgatggcgagtccctgccagctcgccgatgcccgcttgcaccgggaccgagatccggtcgaggtcgatggcaacctcaccagcagcgagctcggcgagttctcgcgtgaaggctggggcctctgctcggcgctccgcaaggaagttcggcccgagctgtgcgagcgcagggcccatcgctcgacgcaggaagtcgctcaccagctcctcgaggtctggttcgggaacctcacccgccagcaccgaccgagggtccactgcccacggtccccaccacgccgacgtcggcaggggcgcctcgaagacactcacgccacgcagcgtgggcggaggatcgctcgccaaggcgagtgcgagcgtccctccgagcgaatgaccaacgaccaccgtcgcatgctcgcgccccaccacagcccgcaggtctgcgaggtgcgccgtgaaggtggcgggccccatgtcccgagagcgcgcgtaaccacggcggtcgtagagcacgacctcgagcggtgcgagcgctcgcgcgaagcgtcgaaaggtcgcagcacgatcgagcacgccgtgcaccacgacgacgcgcggctccgagcccgcgaagcgatcgaccgccaagtctcgacccacgctggcagcctacgaggccgacacgcagacccgctccctcgtagactcgctgcgtgcgcgccgtagccccccgaaccctcggcctcgccgaggccgcgctcggcggcggcttggcgctcggccaatggctccgcaggcatccacacgccgcgcgagccctcgtcgtcggcaccgcctacgacctttgcgcgcgggggccagcgggtctcggtctcggtcttgcgattggtgcggcacgtccagccctgcggggcccgatcgtcgcggggttggcgctctcggctcgcagacgactgggttggttcgcaggccacgccctggccgccaccgctgcgctcagcgccgtgcgcgcggtgcttccaggtccgcgaaccgatcggcgagccgtcgtcgtcgtcaatgcgcacgccggctccacgcgcctcacccgacgcgccctgacccatctccatcggctggactcgaacgtcggcgtcatcgtcgctccgcgagatgccttcggcgcaagcctctctgccgctgcccgccagagccccgaggtcctcatcgtcgccggcggcgatggctccatcagcggtggggccgaggtcgcggccgatcacgaggtcgtgctcggcatccttccgaccggcaccggcaacgacaccgctcgaggcctgcgcatcccactcggcccggaggacgccgcgagcgtcgcgatcggcggcgtcgagaccgccatcgatctcgggctcgccggcactcgtttgttcgtccacgctgtgtcggtgggtgtgatcgcgcgcttcgcggaggcggtccagcaccttcgcggccgagcccggccgctgctctacccgctcgccgcatggcgggtctggcgccactacgacggagtccgcctcgaggtgagcgtggatggacaacctgtccactttccagggacgctcgtcgaactcgcggtcgtcaacaccccacggctcggagggcgtcttggcatctcgctcccgccgtcgcttgcggccgacggccgactcaccgccatcgccgtcacccgctcgccgctctcgctgctggtacgatccttggcctccatgatgcagcagaggcctcaccacccgcacgggaccctgctgacgcgcgacgctcgagtcatcacgctcacgagtgccacgccgaccctggtggcgatcgacggggagccaatcgccgagaccccgatcgatcttcgaaccctccccgcccgcctccgcgttcacgtaccggcgcaacctcggcgatggcgtggcgcggcgtcggaccaccgcacgccaggagacgacgaggcagctagacgccagcagcggtgagcgaaccatcccgcaccgcccacgagagggcggcgtgcacggttgggtgctcgaaggcgaagccgcttgcaccgaggacgctcggttcgacacgctgcgacacaaggaggagctcgcgagccatctcggaaccgaggaccacctcgagcaccggagccgggaccgggagcacggccgggcggctgacgacacggccgaggactgcgacgaagtctcggttccgcaccgggtccgggccaacgaggttgactggtccgtcgagctcggtgtcgatggcgtggacgatggctcgcacctcatcgaccaagctgatcggactcatgaactgccgaccatgcccgaagggccccgcgagaccgagccgcgccatgggcaggagacgagtgagcacgccgccatctggagcgagcacgacacccgtacgcgcaaggaccacgcgaccgacgacctcgcgggcccggagcgcctccgcctcccaatcgaccacgacccgagcgaggaatccctccccggcggtggactgctcggtgagcacctcgtcgccacgatcgccgtagaacccgatcgccgatgcgcagaccagcacgcgaggtggactcgtcagctgtcgcaagccacgtaccacagaccgggtgccgacgacgcgagaggcgtagatcgaggaccgaaccgccgcattccagcggcgctcgccgatcggcgcacccgcaaggtgcaccactgcatcgacgccgtcgatcgcgtcgaaccacgcccgctcgtcgttggtcgagaagatcggcgttcccgccgggtccggggcatcgccccgtcgaagcgcgagcacctcgtcgccacgagcccgcagcaccgatacgagcgcccgcccgatcaacccgctcgcaccactcaccgctacgcgcatgtcaccctccatcgtgtcgacactcgcaccaacgcctcggtctaccgagatcatcctggacgctcaggcatatcgttccgcgcgggcgtcgacacgaacgcgaaagcacgtccaggctggccgcggatacccgcggccagcctggaccaacgcacgatggtcgcaacgatcgaaccgtcgcgacctgacgctcacgcttcgtgcgacgtgagcgcatgcgccgaggcgccacgctcgatctggatacggcgcggacgagcggtctcagcgagcggaaccgtcacccgcagcaccccgtcctggtaggtcgcgctcactcgggacggatcgagctccgaaccgaggtagatcgaccgctggaacgtgccggcgaagcgctcggcgacgacgacgtccttggcgtccgcccgcctcaccgcgcgcgcagccttcaccgtgaggacgttgcgctcaacggtcagatcgatcgactccggatcgacgccgggcaggtcgaactcgacgacgtagtgatcatcctcgcgataggcatcgaccggcgtgaacaccgagtaaccctcagtggtcacaccctgcaccatgctcatgagctcacggaacggatccgtacggaacagcaccatggcacacacctccttgccagtcctcgactgtcacgatcgtcgtgacacttacgacaacaccactctagcaaatctattcccaaactgaccattttcttgagtcacttgccatcatgtttcttgaccctcactccccagtaccgaactcccgatggccactagactgtcgatcacgagcagacaacgcctgtggcaggtgggtcgagcggccacgaccatcgcggcccgcgacacccttcgtcgtatcggtatcgcgctcacgccaggtcccagcaaggacgcggcccagcgagcacggacactgcgcacgacgaccgacgtagcggccgccgtcgcgggcatgcgcggcctcaccgtcaagcttgcgcagatggcgtcctacgtcgatcccgccgcccccgacgacgtccgcaacggtctcgcgcgcttccaagacgccgcaccgccgatgagcgccgacctcgcgctcggcgtcctgcgcgacgaactcggcgaacggctctcgcggttcgccgagatcgaagaggagccccgggccgcggcctcgatcggtcaggtccatcgcgccacgctccgcgatggcaccaccgtggcgctgaagatccagtacccggacgcgcgcgaactcatcaccgccgacctcgagcaagcgccagccatcgtcggccttctgcgcttcgcctttccctcgatgcgcgtcgacgacatcgtcgccgaactcgccacgcgggtccgcgacgaactcgattaccggcgcgaggctgccgtccaggctcgcttcgcacgggcctacgccggccacccgcgcatcgtcatcccccgcccgatcggagcgctcacgacgagcagggtcctcgtcaccgaatggatcgatggcgcaccctttgcgagtgctgccaccctcgagcccgaggagcggtccgagatcggcgagatcctgttccgcttcgtcttcgcgagtctctatcgcctccgtctctacaacggcgacccgcatcccggcaactacctcatcctcgacggaccacgcccgcgcgttgccttcctcgacttcggattctcgcgctcgttcaccgccgacgagatggcaaccttcgaggcgctgatcagggcgcgtgtcgtgacgcccgaccgccacgccttcgccgagacgcttcgagcagccggcctcgtcatcggcgacgaccacgacgacgacgtgctgtgggagttcttcgctccctactacgaactcgtcgagacacctggaccgcgcacggtgacgccggcgtgggcctcgggcatccttcgtcacaccttcgaccgatcgcacccgctggccagcgccgtcaacgtgccaccggcgttcgtcgtggtccaacggatcaacctcggcctctatgcactcctcgccgagctcggtgcgacggccgactggcgtgccatcgccgaggacatctggccattcgtcgctcgcgccccgatcacaccgatcggccaggaggaggccgcctggcgtctggagagggctcgatgagacgcaggctctggtggttggtgcccatcggcatcgccgccgcgatggtcggcgcgcgccaactcctcgaccaacccgcgatcgtggtcccggaggctgccgccgtgagcgccggcatgctggtgtgggagttgcccttgttcacccaccggccattggcgaccgtggcgctgatcgatctcgcggcgttcggcggcgtccaggccgctcgctacgtctcgctgcctgagcccgccctcatcgctctggtgacggtcgccatcctgggggccttcgtcctcttcgacctccccgccctgccagcgctctcggcggggctgctaccgatctacctgcacatcgtggtagccgcgtacgtggtggcggtagcgctcaccatggtgcccgtcgcactcgtcgccgaacggcgccaccgagcaagtcgccgccacttcggcacccacgagcttgcccagatcgcgccagcgagcgccgttgcggtgctgctcgccagcctgaacccgttcctcatgcttccgccgctctacgtcgccacgaccgaagcagccctcggcgctcgcccaccagcgggtcaggaggccatccgtcgttccgtggcgctcgcgacgggcttcgccggcgcgctcgtcctccatctcgtggccccgcccctcgtcgtcgcccccgtcgcggtcgcgctcgccgcgttcgtgagcagccagctcggcgtgtcccttccacctgcgatcgcgttcagcctggttcccctcctgtttccagtgaccgccagcacccttctcgccctcggcggactcgtcggcatcgtcgcaaccgccctcgctccgtggctgcccaacgccttcggccgtgcgcggatcctcctcgcctcgttctcgtcgggtaggctcacggcatcggtggatgacgaggcgctgcctgtgggcgatggcgagtaggcgatggacgaacgccacgaggagcatggcgagggagcacggtgaaggcaaccacagcgatcgagcgatcgcacgcgagcggcgagcgctccacgggacggatcgtacgtggcctgatcgtcgcgatgcgacccaagcagtgggccaagaacgctctcgtcgtagcggcaccgctcgcagcgggcagcatccttcggacccacgtcctcgtgccgacagccctcgccttcgtcgccttcgtcgcgatctcggccgcgacgtatctgctcaatgacactgcggatcgagagcgcgacgccgcccacccgaccaaacgccgacgcccgatcgcggccggcatcgtcccggtatggctcgcccttctcacggcaaccatcctcggcctcggggccctcctcctcgccgccctcgccatcaacctggcgacgctcgccgtcctcgcgacctacgccgcctcgacgcttgcctactcgctcaagctcaagcacgaaccgatcctcgacatcgcgatcgtggccggcggcttcgtgctgcgcgccgtcgcgggaggcatcgcagcgcacgtcttcatctcgcactactttttgctcgtcgccggcttcggcgcgctcttcgtcgtggcctcgaagcgctatgccgagctcaccgcgaccgacggcgagagccgcacccgcagcgtgctcgcttcgtactcaccaggcttcttgaacctgactcgggcactcgctgccaccacgacagtcgtgacctactgcttctgggcgttcgagcgcagcgccgggctatcggatggtcgcctcgtgcttggcttgtcgatcgtgccgttcacgatcggagtccttcgctacgccctgctcgtcgagcacggccacggggaggcccccgaggacctcctcaccgccgatcgcacgctgctcgggatcggcatgctctgggtcgcgctcgtcggaggagcgatcttccttgtctaggcatatgagccaacccatcgacgcggcgaccgatcaggccccacccttcgaggagcgttggacgctcctcgaagggtggggccgaacgccccgctcggcggcgtggcttcgcgaagcgacagacgacgccgtcgtcgatgccctctgtagccagggcccccgcccggtgctcgcccgcggcctcggacgcagctacggcgacgcggcgctcgcggcaggcgggatcgtgctggacatgaccagccgccagccggtcgtcaccctcgaccagcatcgcggcgtcgccgtcgtcgacgcgggtacctcgcttgcccacctcgctgcgagtgtgctcccccacggttggttcctccccgtcacccccggcaccaagcacgtcaccgtcggcggtgcgatcgccgccgacgtccatggcaagaaccatcaccgagacggatcgttcggcggctacgtcgagcgactctggctggccacgccggagggcatcgtcgagctcgcgccacccgatgagcgtttctgggcgaccgtgggcggcatgggactgaccggggtcatcctccgagccgccgttcggctcatcccggtcgagagccgcttcgtcctcgaccgagaagtcgcgacgtcgtccctcgacgagaccatcgaggtcctcgccgacgacagttcggttcgctactccgtcgcatggctggacgcgacggctaccggagctcgcctcggccgcggcctcgtctcgttcgccgaccacgcacccgccgacgcactcccggcctcgctcgctcacgacccactccgactgccgcgcgagcgaacgctgcccgcacctccagatcgcatcccctcagggctgctgtcggtgcccacgattcgggcgttcaacgagctgtggtaccagcgtggacggcgtcggccggagacggccctcgtcgacctgcgctcgtacttctatccgctcgacgccgtgaacggttggaaccgtctctacggcccacgaggtttcgtgcagtaccaagtggtcgtcccgaacgacgccgtatcggtgatcaggcgcatcctcaccgacctcgtcgagcatgggcatccgtcgttcctcagcgtgctgaagcgcttcgggccagcggggaacggttggctctcgttccccaccgcaggctggactctcgcgctcgatctcccggcgcgccggagcgacctcgagaccctcctcgtgcgcctcgacgccctcgtgctcgaggccggaggtcgcgtctacctcgccaaggacggacggcttcgacctgagtccgctcgggcgatgtacaccaggatcgacgacttccaagcgctgcgtgcacgcctcggtgtacgaggcgtcatcagctccgacctcgcccgccgcctgcacctcgactagcctcgtggcgtgctcaacgccaacggtcttccccaacagctcctcgtcgtggggggtgggtccgatctcgcggtcgcgatcatcgagcgcctcgcaaccgacggccccctcgaacgcgtcgcgctcgccggaccgcggccggccacactcgaacgcgctcgcgaccggatccgtgagcacctcgacgaggtcgccacgttccacctggacctcgccgatccacgagcggtaccgagcgacctcgaaccagccctcgagtggctcggcagtgtggatgccgtcctcgtcgcggcaggtgtcctccccgaccaacacgctgccgaggccgaccccgccatcgtcgcgaatgcctttgcggtcaacgccaccggacctgcggtggcactcagcgtgctcgccgatcgcctcgagcgggccggcaccggtcagctgatcgtcctctcgtcggtcgccgccacggtggtgcgccggcgaagctacgtctacgacgcgtcgaaggcggcgctcgatcgctttgccctcgggctcgccgatcgcctcgaaccggcggtcggtgtccacatcgtgcgcccgatgttcgtcacgacccgcatgaccgagggtctcgagcgaccaccgctcgcgctctcgcccgaacaggtcgctcgcgcaaccatcgcagggatccaggctcgccaacgagtgatctgggtgccccgggccgccgcgctcggggtcatggtgctcagcgtcctgccgcgcaccgtcctccgacgtctcccgatctgacaggcaacgtccctcttaccccgcgaccgcggtgcccccgaccagatcgacgccgccaggcgcaggggcgctcggggcgccgccaagccccacgatggcgccggaggacaacaccagttcgagaccggcacctgcgcgcgcagcactcaccacggtggcagagccgacatcggcgctcgcgaggtccgatgcatcgccgaaggcaaagacatcgccgttcgcaagcacgagccagtagccctggccgtcggccgtcggcacgagcgtgaccactggggcagggagcgggtgcgagccgccgaggcctgagtagccggcactgtaggtattgccgtagaagtgggcgtcaccgaagccaaagacgccgccgtcggcggccaccaaccagtagccctggccgtcgggggtggggctgagcccgacgaccggtgcggcgagcgggtgggagccgccgaggccggtgagacccaaggtataggtgttcccgaagaagggtgcgtcaccgaagccaaagacgccaccgtcggcggccaccaaccagtagccctggccatcgggggtggggctgagcccgacgaccggtgcggcgagcgggtgcgagccgccgaggccggtgagacccaaggtataggtgttcccgaagaagggtgcgtcaccgaagccaaagacgccgccgtcggcggccaccaaccagtagccctggccatcgggggtggggctgagcccgacgaccggtgcggcgagcggatgggagccaccgaggccggtgatgccaagggtggcggtgtcaccgagactggtggcaccgtcggcggccaccacggtcccatccgccgtgacgccgcgaagcccgacgttccccgtcggcgacgacgatggtggagcaggcgtcgttggcgaggtcgtcgtcggggtggtcgccgactgcgcgttcgtcgccggggtgccgaccgccgcgatcgcgcccaccgcaccgccagcgggtgcggtggcgccgatgctcacccctccatcgaagccgacgagggcgcccgacgacaggacgatggagtagccctggccaccgggaccgggcacgagtccgatcgcgctcgccgttcccggcgtgagcgatccgtagctcggcgcatcgccgaagccgtagaccgtaccgtcggcggcgagcagccagtagccctggccatcgggggtcgcgagcatggcgacgatcgggctggcgggtgccgccggaagcccgccgaggttcgtggcgtcgccgaaggcgagcacggtgccgttcgcaagggcgagccagtagcccttgccgtcaggggtaggcacaagcgccacgacacgcgctggcagcggatgagcaccgccgaggccggtgaagccgcgcgtgtaggtattgccgtagaaacccgcgtcaccgaagctgaagacgccgccgtcggcggccactaaccagtagccctggccatcgggggtggggctgagcccgacgaccggtgcggcgagcgggtgggagccgccgaggccggtgatgccgagggtataggtgttcccgaagaagggtgcgtcaccgaagccaaagacgccgccgtcggccgccaccaaccagtagccctggccgctcgggtcgcgggtgatcccgaccacgggtgcagccagggggtgggagccgccgaggccggtgatgccgagggtagcggtgtcgccgagactggtggcaccgtcggcggccaccacggttccggctggggtggtctcgagcaccccgttgccgaggctcggcgactcgggcggcgtcgggggcggtgcgggggctgaggcgctcgcgtcgttcgagatcgcgatcggtccgctcgcgacgaaccaggccgaggggagtccgagagcaccagcgaacgttgcgcccgagacggtcaccgacccgttcgtgccgctcacggtgatcgaggtcactcgtccgccgtcgttaccgagcccgttgcgcgcatcgaccgcgagtccggtgggtgtgccgatcgaggggaatgcggcctcgaccgacgcgagcgagacgctctgcgtccaggggttccaggggttacagatgttgccgtagcagcccgcatcgtagggatcgggaacggcgggaaacgtaccgggtgccgtgtaaccgccatcggaggccgagtactgcgtgaacgcaggcgctccggaggcggtcacgagcacctcgtgcgccgtgtccgccaccgcctgctcgaccagcggccgatacggcgcgctcaacccgttgttcacaccgccgtagacctggcacgccgaggtgtcgcagatggtcgcgaacccgtagccgttgccgaccgcgagcgcataggttcgggcctcgacggcctgagcctcgagcgcctggaaaccccatggttccccttgcggaccggaagcgccgaggaggccccatgaggccggcatctcgttcgccaccacaccgagcacgtaggactcgagcccgagctcattgacgagcaccatctggcccgagccatcctggagcacctcgagttggccgcgatagctccgctcgctgccgccgggcccacaccacacgagtgccgacgaggccggctcgtcgacctgctgaccgaccggcggcagcgacggcggcgacacccacagcgaaccaggtgcgctcgtgaggttactccaccctcctggggagccgcagcccgtggcggcttgccccaccgccgcaaccatggtgccaccctgatccgtgagctccaccgggacgttcgcaccgacgctgacgccaccgacgctcaaaccggatggatcgaagacgacaacggggcccccgttggcctcggtgatccagacgcgcactgcctggtcggcagccgtcgtgagcgtggtcccaccgtagaagtgcgcgaggatggcctgataggagtcctggcccacactggcgtagccgatctcgccgaactgcgaagcgccggagcctccaccgacaccgaacccggtgaaggtgagctcgccgctggtcgacgttggcgtcatcgccggtgcatgcgccggcgccgcgacaagggctccgagcgcgatcgctgcgcccgcgagcggaatacggcgccctccgacgcgcacgctggtcctcggcaacctctgccccctcctgcgtgagccctccttggccgagccgagcgcgccttctcgacgctcggcccacactacaccatcggcacgcgccggagcggtcttgacggacgtagactccaaggcgccatggcctctcgcgacctcaccgccaaggacctcactgcaagggaactgcgcacccatctcgacgagacccgagcagcacttcgggctcgccttgcgccgtcgctggagcggacgttgcgtgaagcgctggtcgatctcgagccgctcctcgggccccgcgcgcttgccgaacggttgcggcgactcgcggcggcgtcctatgtcgaggccgacgtaccgacccaatcgcgaatcccggggctcgccgtcgtcaagcgcggcgtgcacgctctcgtggcgtggtacgtccgtgcgatcgtgcagcaggtcaacacctttgccttcgagacggccggtgtcctcgaagcggtcagcatcaagctcgacgagttcgagcggcgcctcggtgccgtcgaggctccgagcgtcgcaccggccacggccatcacagtgccgtggcctcccggcgcgaacgctgcgatcgtggcggcgctgaccgaactcgagccgggggctcgcgtgctcgtctcggacgcgacgaacgacgacctcgcgaccgccctggccgccgcaggcctcgacgtcctcggcacctcgctcgatcaggaggcggccgatgcactcgccgccgacggtatcgacgtgcgcatcctcacgatgaacgaactgctcgacgcaacggcgcccggatccatcgatgcggtcgtgctccgaggcaccgaggtcgagttcagcgacgtcaccgccaagcgtcgcctcatcgcatcggcccggcgcgccgccaagggtcccgtcgtcctcgtctggaacgagcccgagcgcctcgccgccgaaccgagccttgcgggcgtgctcgcgctgcaccctgggccgttgcccaaggcggcgtgggaactcctcctcgcagagcgcggcgagcggcccgtcctcgcgccggtcgccgacgggctcaccatggcggtgctccccggctgatgagggttctccacctcgtcccgtcgctcgcgccccacgacgccatcggcacgcacactcggctcctgcacgaagcgctgctcgctgccggcatcgactctgagatcgtcgcagacgaggcactcgacggcgcccaggccacgccgttcgccgcgcttcgtcgacggcggctcgatgccgccaccgtggtgtggtaccaggcatccacgacctcgccgatggccgcatgggttaggactcaggtccgtgcacggcgcctcctgacctaccacaacgtcaccccgtggcagtaccaggagcagaccaacgtcgaggttgcccgtgccctctggagggcacggggcgaactcacgcacctcgcgccagccgtccaccttgcgagcaccgtctcgcgcttcaatgcccgcgatctgaggcgactcggggtcgacgaggtgcggatcctgcccccactcatcgagctcggtgagcccgcagagcctgcgccggcccggccatctggctcgcgatggatcttcgtcggtcgactcgtaccgcacaagcgccaggatcgcctcatcgcagcgctcgcgatctaccgtcgcacgatcgacccctcggcgacgctcgcgctcgtgggcaaggcgaccgaaccgagctggcgcgcgcgactcgtcgacctcgccgcggcgatcggcgtcgaggcggccgtcgagttcatcggcgacgtcgacgagtcggggctgcgtgccgagtggcgcgaggcgtccgtgtacgtctcggcctccgatcacgagggttttggcttccccctcatcgaggcgatgagcgctggcgtgccggtggttgcgctcgcgcgtggcgcggtcgctgagaccatcggacgagcgggcctcctcgtcaccgacgaggcgccccgagcgctcgccgaggcggtcgccctcgtcgagcacgacaccgaggtgcgttcggcgctcagcgccgaggctgctcgacgacgcgctgcactcgatcccgcgcgggtcggccccctgtatcgagcgctggcctgggaggcggccgggtgagggtgctccagttcgtgcctgccctcctcccgcacgacgccgtcggcaacatcgtgcgcggtctcgacgagcgactccgcggcatcggcgtctcgaccggcatcgtggtggcgggcgaccgaccgcctccgggcgcaaccagcgttcgccacacccagctccggcctgacgacatcgtgctctaccaccttgcgagccgctcgcccgagggtgcgcgtctggtcgctcgccacccgaacgtggtcgtgcactaccacaacatcacccctccggagctactgctgccgtggctcccgacggacgcactcgagctccagctggccaggcgtgaggccgcgcgcatcctgcgagctgctcggctcaccatggcggtgagcgcctacaacgcagacgacgcccgttccctgggggcacgtgacgtcgccgtcaccggcaccctgtcgcgccacgatcagctcgtcgcagcaccatcaaccgaggtcctcggatggctgcgcgcagaccgcgatcgccgagggtccccgcacgactggctgttcgtcggacgcctcacaccgcacaagcgcgccgaggatctcgtcgccgcgctgttcgcctaccgacacgccaccggcaccgacgctgcgctcaccatcgtgggacggccggcctcgcgacgctaccttgcccatctccgtcggcgcgtcagcgtgctcggactcaccgcccgcgtccgcatcctgacccatcccctcgcaccacgcgccctggcggatcactttcgagcggcgagcgtctacgtcacggcctcgcgccacgaggggttcgggctgccactcctcgaggcgatgtccttcgggctgcccatcgctggcctcgcggctgcagcggtcaccgagacggtccagacggcgggagtgctcgtcgaccgcgccgacccagtggagctcgccgccgcggccgcgacggccgccgagctcgggccacgtcttcgtcccgccatggacgaacggctccgcgcgtatgacagcgacgccgccttcgcccgcatcgtcgagggactccggagcgtcggcctcgaggtccgagcgtgagggtcctgttcgtcacgcctcgttggggtcccgacatcgcgggcggtgccgaacgagccgcgcgcgcctggggggtggccctcgcccggcgcggccacacggtccgggcgctcacgaccacggcgaccacgctcgactggtccccggtcctcgatgccggtgagaccaccgacgatggcgtcatcgtcgagcggcaccacgcgaccgctcgcgacggcgacatcgatcgcgcgcttcgagccgtcggaccgctcgccgcccacctcgagcgcaccgctgcgcgccgactcatcgagcgtcaagggcccgtcatcgacgggatcgaggatgcagcgcaaaacgccgacgtcgtcatcgcctatccgtacctctactggaccagcctccgcgcgaccgaggtcgccggtcgccggacggtggtccacccggctgcgcacccggagccgctcgtcgcgctcagcgcactcgaacccgtcttcaccgcgcccggcgggctcgtctaccagacggcgagcgagcgccgcacggtggaagcccactggccaacggcgcaggtgcgctcgctcgaactcgcacctccgctggtcgcgtccgcgcgcgagcgcgtgccgtgggacgcacgaacgatcgtgctcgcggtcggacgcttcgagcacgacaagggttccgaggccctcatcgcactcgccgaggcacttcccgacccgttgcgagtcgtcgtggccgggcccgttgtcgaaccgccgcgacgaccgagcccgctccagaccctcggcgttgtcagcgacacgagactcggccagctccgcgccgaggccatcgccacggtgatcctctcacgctacgagtcctactccctcgctgcggcggagtcactcgccgccggggtcccgatcgtcgtcaacggctcgaacgacgtgctcgtcgagctcgctaccacctccggtgccgggatcgtcgccgcggacggcatcgacgtggccgcagcgatcgtagccctcgcgaccgatcgcgagctggcgtcgcgcctcgagacagccgcactcgcctgggcacagcaacgcccgggtgccgacgaggccgtcgaacgctacgaggccttcctcaccgaggtcgctgcgcacgcgcctactcggcgaagaagctgacctcggtcgccacgaggccgcccacaccgaggtgttggtcgacgatcttcagggcggtatcccattggcgccgctcgaggagctcgccgctacgcgcctcgacgacgctgagcgagagctggtagatgccgggagcgagcgggacgtcggcgacctgaaccaagaacttgcccgcgccgtggacgacgaagggatcgagtcccatctcgcgcgtgtgtgcggtgagcacgggggcgccctgaggactcaccaccgcgagctcgaggtgcaccggggtcggacgcccgtcgcgctcctcaagggcgaaacggagctcgagcgggctacgcgcctcgagcgtcaccggctggtccacgacaacaccgttcgcccggaggtcctcgaccacgacgtggcggggcgcctcgtcgagctctgcgacgaccggtgcctgggttccgagcccggagcctgccaactggagctgcgtcagcagcgagatcgcctcctgtgtcggtccaccgcccaccaggcggccgtggtcgagcacgaacgccgagtcacacaccgcgcgaacgagctcgggcgagtgcgacacgaagatgatcgtgcgaccctcggcctggaactcgcggatcttcgcgatgcacttggcctggaaacgggcgtcgccgaccgcgagcacctcgtcgacgaggagcacgtcgggatccatgttcacggccaccgcgaagcccagcctcgcgtacatgcccgaggagtagaacttcacctggttctcgatgaaggggccgagctcggagaactcgatgatgtcatcgatgcgctgatcgacctcacgccgcgacatgccgaacaaggtcgcgttcaggtagatgttgtcgcgccccgacaggtcggggtggaagccggctccgacctcgagcatggccgcgacacgtcctcgcacggcgacctcgccgcgactgggcgtcaggatgccggcgatgcacttgagcagtgtcgacttcccggatccgttgtggccgagcagtcccaacgtgtgaccctgctcgacgtcgaaggtgatgtcgtcgagggcggcgaacgactcgtgaggcacacggccccagtggacgaatcgctccttgagcgacgtgtacttctcctggtagagacggaagaccttggtgaccccgcgtacctcgaccgcggtctgacccaccgctagagctcctccgcgaagttgccttcgagtcgtccgaacgcccacagggcaaccacgaagagcacgacaccagcgacgaggacgccgagcacgccccagaagtaccacatcgggcccgccgtcggcaagatctggacgacggtgtgcgacgcgaccgagtagggatccgtcttggcgtagaacgtcctctggaacgcgagcacgaccggcgtcaccggattgaggagatacacccagaccgggatgtgatggtctgcgaacttgttcgcgacgagttcgaacgcgtacacgacgggggttgcccagaaccaggcctggagcaggatctccatcagatggcgcacgtcacgcaggtagaccgtgatcccagagacgaggatgccaaggccggaagcgaacacgagcagcgcaacgagcccgatgagcgccacccacaggtagctgaccgacggcacgacttggaatacgacgaggaacaccgcgagcaccacggcctggaacacgaagaagaccgacgcggagccgaccgaggccaaggccaggatctcgcgaggaaacgcgaccttcttgacgagtcccgcgttgtccacgactgcgccggtcgcgcccatgatcccggtctggaagaggttccagcagaggagcccggtggcgaggaagatcgcgaacaacgggatgccagaacccagcaccttctggaagacgatgtagtagatcaagatgaacatcgccgggttcaccagcgaccacaagaacccgaggaaggagtccttgtacttgacgcggatctccttgacgatgagtccgcgcagcagatcgcggtagcgccagatgttcgcgagccgctccgtcaccgacacgcgcggccgcaccagccgtatggcgagcgcgcggttcgggtcgtagcgcttcgtgtcgccaggctgggacgctgggagatgggtgtccacccgcgccctcacgcctcggtcgacgaagcgctgcgctgtccgtaggacttcgtgcgaatcacttgatcgatgaagccatactcgagcgcctcgtcggcggtgaaccagcgatcgcgctcggaatcggcctggatccgctcgaggggttggccggtgtggaacgcaatgcgctcggcgagctggcgcttgaggtacgtgatctgctcggcctggatcgcgatatcggccgcctgtccctgcatctgtgcgagcggctggtgcatgaggatgcgcgcgtgcggcaaggcgtagcgcttgccatgcgtgccggcacacaggaggaactgggccatcgaagccgccatgccgatggcgatggtcgagacatcgcagctgacatattgcatggtgtcgtagaccgcgagcccgtcgtagatcgagccacccggcgagttgatgatgaacgagatatcgcgttcgggatcctcagcagcgagcagcagcagctgcgcgcagatctggttcgccgaggcctgggacacctcggtcccgaggaagacgatccgctcacggaggaggcgctgaaagacgtcgccaccagcttcgataccagcggcgtcggcaagatctcggacagaaccctcgacaagggcaggtagggccatgcccgctaggctagcgtgcgttccccgacgggaggctgacggggtcgcgactcgacgtcgaacgcgggcgtggcgaaattggcagccgcgcgaggtttaggtcctcgtgtcgtaagacgtgggagttcgagtctccccgcccgcaccggtcatcggcggccggcgcacagccgatcttcagcgtcaccggtcgcgatcagcgaaagctctcgcccagtcggcgaagccgacgagcgcccgccttcgatgcgacagcgcgtccttccactcaccgagttcggcaaacgttcggccgtcgccaccgagcgggatgaagatggggtcgtacccgaatccctgctcgccacggggctcgagtgcgatggccccctcgacgacaccctcgaagcatcgcggcgggtcctcgtcgaccacggcgcacaccaccgccacgaagcgggcacggcgactacgcgtcgatccgagctcctggagcacacgcgcgatacgctccgcatccgtcggcccatagcgagcggagtagatgcctggggcaccgtcgaggccgtccacgacgagtcccgagtcctccccgatcacgatcggcgctcgcccgcgtcccgcctcggccttgatgatcgcgttctcctcgaaggtcgacccggtctcggcgacctcaccgacgtcgatccccacgacctcgaagtcggtgaggatgcgtcgcgcttccgccaacttgtgcgaattcgaggtgacgagcccgaccctcacgcgagctggggtcctcgctcgaggagctcgccgatgccgcgctccgccagcttgaggagctcgacgagggtcgccttcgcaaagggcgccccctccgctgcaccttggacctcgacgtagcgaccgccgtcggtcatcaccacgttcatgtcgacgtcggcgcgcgagtcctcgtcgtagtcgagatcgaggagcggctccccgtcgacgacgccgacggacacggccgcaagacgaccggtgagcgcagctggctgcacgagaccgccctcggcgaggcgctcgagcgcgcgctcgagcgccaagaagcccccggtgatcgcggccgtcctcgtgcctccgtcggcctggaggacgtcgcagtcgacgacgagctgatgctccccgaggcgctcgaggtcgaccacgctgcgcaacgctcggccgatgagccgctggatctccacggtgcgcccctgctggcgcccgcgcacggcctcacgggccgtccgtgtcggcgtcgaccccggtaggagcgcatactcggcactcacccatccccggccctgcccccgaagccaggccggcacgcgctcctcgagcgagacggtacagagcaccgcggtacgacccatacgcatgaggaccgatccaggcgccatctcggtgaagtcaggtgtgatcgccaccggccgcagctcggctgccccgcgccccactggccgtcgttccacgtcgcctcctcgctgcgtccggcgacccacgctaggcgctacgcgtgcgccggcactccagcgcctcgacgggcacctgctcgatcgcgccgagctccccagggaacaggcgaccgccgatctcgcgaaagacgacagggtccccgctgcaggcgacgcgcaaagagccgacggctcccgagcgtgccagtccatccgcaccgagtcgctgtgcgacctcgaacgccgcctcctctgccggcgacacgagcgtcacctgctcgccgaccaccgcttgaatctcgcgtgcaagatagggatagtgcgtgcaccccagcagcaacacctcgacccccgcgtcgacgacgggcgccagacgatccgcgatgaccgctcgtacggccggaccggtcgtctggcctgcctccacgaactcgacgagtccaggacaggcgacggcgacgcccgcatcgtcggcgagcgcccgctggtaggcgcccgaggcgatcgtgcgctccgtcccgatcacgccgacacgaccggacccgacgcaccggcgcgccgcgcgcgcccccgccccgaccacgccgatcaccggaaccgcaagctcggcccgaagcgcatcgagtgccacggcggacgcggtattgcaacccacgacgacgagtttcgaaccggcctcgtccacgagccagcgaccgatctcgagcgagaaccggaccacctcgtcggcaggccgcgatccgtacggcgaacgagccgagtcgccgaagtagacgagatcctcactcggcaatagatcgcgcagcgccgcgaggatgttgagcccgccaaaaccagagtcgaagacaccgatggggccgtgcgcgcgctcagccgccaccgctcgacgctccctggaccacctgttcttctcgaacgagcccgcggctgatgcgataggcgcggatgtcgactcgaggacgcgcaagcgacgcgatcacgtagacccaccgatcgtcgaccgcttggcgtacgtccgtcggcgacgggaacgcctcggagtgggtgtgcgagtggaacaccccaacgatctcgagcccggcacgctcggctcgctgctccgcgcgcagcacatcctccggggccatggtgaacacccgtgccgagtgcgcctcgttgcgtccggggaacgcctcgacgatggcacggtcgtcgccgagcagcaggccacacgcctcgagcggataggtacgaaggcagtgcgcagcgatcgcatcgagcaccccatcagccacgcggaccacgacaccacgctaccgcgcaggcaccggccccccgggcaccaggagccggagctatgctgagcagcgctcggcatcggcgaacgaggaggcagacgcacgtggcacggcaaggcgcgcgtcctgcgaaggcgcagcagctcggcggcgtccgcgtgctcgcccagaatcgtcgcgcgcgtcacgactacgacgtcctcgagaccttcgaggccggcatcgtgctggtgggcagcgaagtcaaggccgtgcgcgagggtcacgtccagctccgcgacgcctacgcccgcatccgagatggcgagctcttcttgttccaggcagtgatcagcccctatcgacacgccaccggctttgggactcacgtcaccgaccgccctcgcaagctgctcctccaccgcgacgaaatcgatcgactccgcggccgcttggagcaggagcgtctcacactcatcccactctcgctctacctgcgcgacgggttggtcaaggtcgagctggcgctcgcgaagggccgcacgctctacgacaagcgccacgtcctcgccacccgcgacgcccagcgcgaggtcgagcggctgcgctcacgctatcgacccaatcgcagcgcacgctagactgatcacgccacagcgagtcatgagggggctgcgcatcgcagctatcggtcgcgttgttggcatcgacaagggggtgtaccggattcgactctggtcgacgagatggtggaagcgagccgtgctcaccggatgcacgtcaaacagccggtgcaacaataaacgccgagcctgagctcgcactcgccgcgtaacaccggcgacggcggacggcttgcccgtgcccgcgggctgatcccgtcgtcatcacagggcacttaccgtttcgcagctgttggcgctgcctagcgggacacctcgccaacacaacctcaggggacgtgccaggtcgtccccgaggatctcaacctggctgcgctcggagaagcaccatcaaggagccagaggacgcgggttcgactcccgccacctccactgatgttacgaaaggccaaccggtgtccccccaggaggaggacaccggttgcgcgttcgggccccgttcgcccctcgtcggtacgcgatcgcggctcgcgggcctcaggcggagggaaaggcgccggtcgggagtgattgccacccggtcgatcaggtcgcgcaggagctgctcgacggtgtcagggttggcgacctcgacgatccaggagatctgggcgaagagggcctcgagccgcttgcggtctgggaaccgaggagccgctccgctcagctggctgggcaaccgttctcggtggacgatcagttcatcacgctgttcgatcagctcggtgacccggggcaagcagaccgccgccggcatgtcgccggtctcgaaggctcgcaggtcgtggtggctggccccctgcaacgaggccgcggccgcgagttcggcgagcaccgcgcggcgaagcagatcctcgggaggctggtcgagggggacagatgctgaacaagggtgccaccgtcgccgaggtcgcccgcaccttcgcacatcgccgagaccacctggtaccgctggaaacagacctacggcggcatgcagggcgcggacctgaagaggtcgaaggagctctgcgccgaaggccggcgcctgagacgctggtcattgatctcgccctcgcgaacgacaggctctgacgagctggccgaggggatcgtctgaccccggaccgcaggcgaggcgccgtgcgccggctccaccagcggctctcaggcgtccgagccaggggcgtgccgagtgacggtccagccacgagccacccggcgccgaaggtcgacgaggcgctccagcggcctcgacgaggccatcggcgagatcctgcctgccttcgcgctgccgacgaacgcaagggacaccccctcaccgagcgcacgatcggtcacgcagatgccagatctgcctccacgacgctgcacgtcggcgcaccacgcctgctgccggacatggtggcaccatcggctccgtcgggaacgtcaacgacgacgcactcgccgagaccgcgagcggcctcgcggcgaccgaatgggtgggcccgggctcacccgccacgtgtggccctctggccggcctcacgaaccttgaggaggtgacctcggcctggatgcgccgctccgccacgacgaggtctatgcaccggctggggcaccgtccgccggtcggggtcgagtatgagtacgatgatcgccgagcgcgagaccgttcacacgtcacggcgtgtgcacggaacctgggggcttcaccgtgcatcgcgtgggccctgtgccgatcccgcgctgtgcgtgagtccccgacgatgctgcgacaccaaggaggaagcgtgcgtccgaacgccgtcatcatcggccttggccagctcggccgttcccttgccgaaggactggtcctcgcaggctggaccgtgacgggggtccggcgcgatcagacggcgagcgagcttgctcggcccgacctcgtggtcgtcgccaccggtgaggacgatctcggcccagcgctcgagacactgccgcccgactggcgctcgcaccgggtcgtcctcctccagaacgaactcctccccgaccagtggcgtcgccatggcatcatcgatcccacgatcctcgtcgtgtggttctcccgcaagcccggcgagctggtacgggagctgcggccctcggtcgtcgcggggccgcacgccagcgcgatccgcagcgcgctcagcgccctcgatctccacgccgtcgaggtcaccccatccgaggtgatcagtgccctcgtcgagaagaacgtctacatctggtcgatgaacctcgcggcactcctcgtccccgacccgaccacgagccgcgtgctcggcgagtttcgagacgtctacgacgcgctctgtcgagagacggttcacatccacgaggccgcccttggtcatccgatcggcgacgtcgcggcgctgtgcgacggcgtggccgccatcctcgccaacgagggagagcggcgcctcggaggccgcagcgcgaagcgccgagcggagcggctcgccgcgctcgctcgtacactcggcgtcgacgcccccaccgtggctcgcgctgccgagagcgcctgagtcacgcgacagcttcggacccgtcagggcgacccaggctcggcgaggaagaccgcgacgaagtcgcgccagaacggcaccagatagtgcgtcggcgcctgcgccatggacggcaacaggttcgtcgccacgagtccgttcggcccctcggcgaaggtcgcaaagctcacccagtaggggttgatgtcgagctgcatcccacgaacggcaccagcccacaccagcatcgagcccagcgtcgctggcgacagtcctgggccaccgacccacacgagattgccgtgcgaggtgatgccgaggccgctccgccaggtcgcgagcagattgccgagcgagtagccccacgtcacgaggggattctccgacgccgtcgggagcactgctccgtgatcgaccagcaaggtcaagttctggcgaaccgcgctcacggccggactcggaccgacctcggagccccacgcaccaatctcgactcgcccgttcgtcagctcgacgagtgacgcggcaccctcgacgagcggggctcccacgacgccatcctgctcgaagccaccgttcgaaaccgcgaactggaagccgccctcgaacgccgcgacgagattggtgaccaacgaggggggcaccatgccctggtaccgaaagctcccaccgggttgggtcgtgcccgcgaagagctgcacgacagcgtgtgcctgatcgatccaggccaccccgaccggagcggcccccggcgacggcgccacctccgaggtgaataccaccgcgccgcccgagccgaccgcccccgctggcgtccacgtcaccggcgcacccgtcgggccgacctcgatccggggcatcggccacagttgctcgggggcgccgccccccgcgatgggcccggggtgtgcaaggcgggtcacgccgctcgccgcgtcggaggccgccgggaccgggggcggcacgcgcgctggcgacgagcccttagcacgtgcgctccgtgcgctagtgccacaggcagcgagcaccccgcacgcaacgaccaggcaagcgccgccgtagcgccgacgtcgcgccatggcctcagccgtccgtcgccatcgggcgagtgcgaggtcaggcgttcatgaatcggcgcacagcgatggccgatcccgccgtaccgaccacgatccccaccacgaggacgatgccgagcgtcccgatcacgtcgccagtggtgaggacgaagccggacaggaggtggatctggaagtggctcacggcaaagctgatcaggtcacggagtccgaccacgaccccacccgcgatggcagcgcccaggaggccctggacgagcccttcgagcatgaacgggatctggatgaacgagttcgtcgcgccgacgagccgcatgacggcgacctctcggcgccgagagaagatcgcgacccggatgacgttcaaaatgagcaccgcggccgacacgaggagcacgacggcgatcacgaggatcaccgactgagcaatcgtcgagatctcgaggatcgtgtggatcgccgagaagttgtcgttcaccgcgtagaccccgggctcaccacgcacgaccgcggcgatcgccggtgcctctgccgggttgaccagcgagacacgatagaacgtcgggacctgcgattcaggcaccgcgttcacgagatcgggctggttggcgaggaggcgacggaagtcttggtaggcctgagcccgtggcacgtaggagtacgagcgcaccgtcggcagctgatggagctccgcctcgagcgcacggaactccgatcgcgtcgcgttcggctgcatgaagacgaggagctgcacgttgccctgccactcgctggtcgcggtctggacaccctgcttgatgaggagcgcggcccctaccagcgacagcgacaccgtcaccgtcaagatggccgccagtgacatcaagcgattacgccacaggttggtcgcggtctcgcgaaggaagtagcgcagtgcggtcatcgaccctccactccgatgccgtagacgcctcgaacctgatcccgctggacggtgccggtaccgatctcgatcacgcggcgccgcatggcgtcgacgatgctcgagtcgtgggtcgccatcacgaccgccgtcccggtgcggttgatccgctccagcaagttcatcactccccagctcgtctccgggtcgaggttgccggtcggctcgtccgcgagcaggatcagtgggcggttcacgaacgcccgagcgatcgcgactcgctgctgctcgccaccggagatctgcccggggagtcgatccgccttgtcctcgaggccgacgagccgaagaacctggggcacctgctggttgatcacggaacgcggcttgccgatcacctcgagggcgaacgccacgttctggaagaccgtcttgttcggcaggagtcggaagtcctggaagacgaccccgatgttgcgccggaagtaggggaccctccagttcggcatggtcacgaggttcttgccagccatccagatcgtgcccgagtcggggcgctcctcacgcgtcatgagcttgatcagcgtcgtcttgcccgatcccgacgacccgatgaggaagacgaactctccacggccgatctcgaagctgacgtcacgaatcgcagacgacgatcccgcgtactgcttcgtgacatgctcgaagcgaatcatgcagctccttcccccgggcgcctgcccggtgaggtcacgcagccgctcatcctaccattcgagatcacccatcagggtgcttctcgcgcctccaggcgaggaacgcctcgatgaaggggtcgaggcgcccatcgaggactgcttgaacattgcgatcttcgtacccggaacgatggtccttgaccaactggtagggcgcgaggacataggagcgcacctgattcgcccaaccgacgtccacccgcggcccgctcaaggcatcgagctgtgctcgctgctcttcgcgccgtcgctgctccagcttcgacaccaggatctgcatcgccttcgccctattctgcaactgcgaacgctcgttctggcacgacaccacgattccggtcggtaggtgggtgatgcgtaccgccgagtcggtgacgttgacgtgctgcccgcccgctccggacgaccgatacgtgtcgatccgcagatccttctcgtcgatgacgacctcgccagcgtcctcggcgagtggggtcacgtccagtgacgcaaagctcgtctgacgccggtgctgggcgtcgaacggcgagatgcgcaccaaccggtgcaccccacgctccgcgacgagcaagccataggcgtagcgtccgcgcacgatcgccgtcgccgacaagatcccggcctcttgtccctcggtgacctcgtccacctcgaactcgaacccgcgaccttgggcccaacgctcgtacatgcgcagcatcatctgggcccaatcctgggcatcggtgccaccggcacccgagtggatctcgagcacggcatcgctctcgtcgaactccccggcgaggagcgagcgaatctcgatcgcatcgaggtgcgcagccagcgacgtgaggacgtcctcggcctcggcggcgagatctgggtcgtcgtcggccatctcgatggcgacgttgctgtcggcgagcatggcgtcgagtcgggcgatgagctcgacgtcgtccttgagcgtgccgtagcggcgcgagagctcgcgacccttcgcggggtccgaccagaccccaggatcggcgagtgcggcctcgagctcggcaagctctgttcggcgatcgtcgatgtgcaagaacgctcgggcccgctcgagacgctcggccagtgcccgagctcgctcggcgagttccgctctcgtcacgccgaaccgccctcggactcaggaccctcggtgacgtcgcgagcctcgcggatgaggtccaagatgctcatcgcctgcggatcggtggcgccgaagtagcgcgcgcccgacaggtcgagcttcggcacgttctgcgaggattcggttcggaacaggtaccgcacgaagtcgtcctcgatgcggcgcattagctcctggaacatctcgaagccctcttgctgccacgcgacgagcgggtcctgctgacccatggcacgcaagttgatgccctcgcgcagatagtccatgtcgatgagatggtcgcgccagtgctgatcgatgacgcccaagagcacgtcgcgctcgagcgctcggagcctgggggtgccatcggcatcggcaccgagcgcgcgttcgcgctcgtcgtagagctccaaggcctcgacgaccagcgagctcacaagttgatcgcggctctgcgcgtcggcgagctcctcggcggtgaaggcgctcccccaggttcgccgcgcctcgtcgaccaggcccgcaaggtcccagtcctcgccgtaggccccaggagcgtagacgtccgcgacacgccgaaccgtgcgctcgatgctctggcgagcgaactccgacagatcctccccttcgaggatctctcggcgcctggcgtagatgaccttgcgctgctcgtcgagcacctggtcgtacttgagcacgtccttgcggatgtcggcgttgcgcgcttcgaccgtcgcctgggcacgctcgatcgctcgcgacacggccttggcctcgatcggttgatcctccgggaacgcacgattcatcacccacgacacgacgctgccacccgcaaagatacgcatgagttcgtcctcgagcgagaggaagaaccgcgtctcgccggggtcaccttggcgacccgatcgacctcgcagctggttgtcgatccgacgagactcatggcgctccgagccgatgacgtagagacctccgagcgagcgcacctgctcaccttcgtcggcgcacacctgttggaacttgccgagagcttcctcgtaggcagcacgtccctcatcggtcgtggggtcgagtccggcttcgcgcaccgcgatcgccgcgagcccctcggggttgccgccgagcaagatgtcgacaccgcgcccagccatgttcgtggcgacggtgacggcgccgaggcgtccggcctgggcgatgatctccgcctcggcagcgtggtacttcgcgttcagcaccgcatgcgagatcccgcgttctgcgagcagactcgagagcaactcggacttggcaaccgagaccgtgccgacgagcaccggctggcccttcgccgatcgctcggcgatctcctcgacaacggcgccgaacttcccgagctccgacttgaacacgaggtctgcgcgatcgacacgttgcacgggtcgattcgtcgggatcggcacgacctggaggccgtacgtcgaggcgaactccgcggcttccgtctgggccgtaccggtcatccccgcaagcttgtcgtagaggcggaagtagttctggagggtcacggtggcccaggtgtggttctcctcctggatccgcacccgctccttggcctccacggcctggtgcaacccgtccgaccaacgccggccctccaggatgcgccccgtgaactcgtcgacgatcttgacctcgccccggtcgacgatgtagtcgcgatcgcgcaggtacaggtgctttgcccgcagcgcctgggtgagctggtgcaagtagcccatgtgcgcgatgtcgtagaggttctcgaccccgagcgcgcgctccacccgttcgatgccggcctccgtcgggaggacgaccttcttctcctcgtcgatctcatagtcgacgtccggacggagggtgcgcacgatcgaggcgaagcggtagtagagatcggggctcatctccgacggccccgagatgatgagcggcgtgcgtgcctcgtcgatcaagatggagtcgacctcgtcgacgatggcgtagtggtgcggacgctgcaccacctcctccaacgacgtcgccatgttgtcgcgcaggtagtcgaacccgaactcggtgttggtgccgtaggtgatgtcggcgaggtacgccgcgcgcttggcggcgggatcgctctcgtcggccccgacccgaccgaccgtcatcccgagggcggcgtagatgcgtcccatccaggcggcgtcgcgtgcggccaggtagtcgttgaccgtcacgatgtgcacgcccttgccctcgagcgcgttcaggtaggccgggagggtcgacaccaaggtcttgccttctccggtctgcatctcggcgatccacccgaagtggagcgccatcccgccgagcagctgcacgtcgtagtgccgctgaccgatcgctcgccgagcggcctcgcgcaccaccgcgaaggcctcgaccaacaggtcctcgagagtctcgccctcctcgagccgctgacggaactcggcggtcttcgcacgcagtgccgcgtcgtcgagttgggcgatctcgggttctagctggttgatgagcgggacgactgcctgcagacgcttgaggcgcttgccctcgcccgctcgtaggatgcgatcgaagatccccatgggctcgctcgcggacgacgctcagtcggcgacgcccgcaccctcctcctcggcttgatcgatgagcccgacggtgccatcctcccgccgatacacgacagcgggccgcccggtctcctcattgatgaacaggtagaaactatggtcgagcaggtccattcggaacgcggccgactgcgggtcgagcggctggagcgcgaaacgcttgcgccgcctgatgtcgagtcgagcctcgggtgcttcggcgccaccgcggtgatggggatggctgcgggccaccagtcgacccttcagacgctcgaggcgccgcttgagccgctcctcggcacggtcgaaggactcgagctccgtctcgcccacaccgcgtgcgcgcacgaccgccttcgagaccacgtaggtcacctcggtcacgacgcggtccggattggctgggttgccggctcgctcgacatgcacctcgacccgctcaggggcaccgaggtacttctcgagtcgcgcgatacggtcctcgacgtgcgcgcgctgctgctcggtcagcgtgcagcctcgacaccgaaggtcaactgccatgggccacctcctatcgggtaccgacggtccatgaggccaagtatgcctcttgctcaggagtgagcacgtcgatccggatccccatcgctgcaagcttgagggcggcaacctcggcgtcgatcgactcgggcacgccgagcaccgacggctcgaggcgctgcccctcgcgcacgagccactccacgctcaacgcctggttcgcaaagctcatgtccatcacgctggccgggtgaccctctgcggccgagagattgacgagacggccctcggcgaccaccatgacgcgagccgtggtgcccgactcgctgtcgaccaggtactcctccaccatgggtcgcacgggtcggcgacgctcccctggggccaaccgcgccaatccctccaggtcgatctcgacatcgaagtgcccagcgttggccaacaaggcaccgtccttcatacgccgaacgtgctccggccggatcacgtcacggttcccggtgacggtgatgaagatgtcgccctcggccgcagcctcctccatgggctcgacacggaacccatccatcaccgcctcgagggcggccaccggatcgatctcggtcacgacgacctgcgcgcccatcccgcgagcgcgtgaggcgacacccttgccacagaaaccgtaacccgccaccaccaccgtggtccccgcgagcagcacgttggtcgcccgaatgatgccatcgagcgccgattgacccgtaccgtagcggttgtcgaacatgtgcttggtcttggcgtcgttcaccgcaacgacgggatagccaaggctgcccgaggcctccatggcccgaagtctgatgacgccggtcgtggtctcctcggtgcctccgaggatgcgcttcacctggtcgggacgctccgcgtgcagtcgggagacgaggtcacacccgtcgtccatcgtgatggtcgggtccgtgtcgaggacctggtcgatgtggcgatagtaggtctcggtgtcctcggcccgaaccgcgaacaccgggatgccttcgtgcttgaccagcgacgccgcgacgtcgtcttgggtcgagagcggattggacgcgcacgccacgacctcggcgccgccagccttcaacgtacggaggaggttcgccgtctccgtcgtgatgtgcaggcacgccgcgatgcgcacgcccgcgagcggtcgctccgcctggaagcgctcccggatgccacggagcaccggcatggttcgatccgcccacgcgatgcgctggcggccctcgtcagcaagcccgaggtcacgtacgtcgtagtccacgttgatcctttcgaagaggtctgatcgggtcggccgcggactaggccgcagggccgctgaggtactgcttgagtgcgttcagcatcggaatgggtccaggatccgttccgagtgcctcggcgaggcggagcgacatgacgtcgccgacgaaggcgaggtcgaagaacgtcgcgagttcgcccaccccctggccgtggaccgagaccgctcgatgcactcggggtgcgatctcgcgctccatgaaggcgacccgccgtgagatctgcgggtgctctccatcgtggcgcaagaacaccagcgacacggtggacgcgagcagctcggggtaggcctcgaaagcggtcagctcgttgtggcccgcctcgggcaacaccgacgcaaccgcgagtgccttggcgttctcgttgatctggttcttccatcgcagcgccgccacctgaccgacggcacccgatccgagcacgatcgggatcgtaccgacgagcgccgaagcgagatcggaggcgagcgtccccttctcgagttcgtcgcgtcgctggcgaagacgctcgatggcatggccgatccaggccgaggcaccggggaagaagccgacccgctccaacacgccgagcagcgacaccgtgagcgcaccgagcgccgctcgcggctgcgggatcgagccatcgatggcgacgtgacacacaccgcgctcggcggcaacacgagcgagctccccgccggccgagatggcgacggcgcgagcaccatgatcgagcgctcccgccaggacttcgagcgtctcctcggtgttccccgagaacgacaacgccacggccagcgagcgtggaccgacgaacgaagggagctcgtagcccttcacgaccaccacggggatgggcatgtacggagccgccgtcgccaccgcgacgtcacccgcgatgccgctcccgcccatcccgagcaccacaacatgctcgacctggtcgggagcgggaagatcgcacagtcggccaacggtaccgagggcggcttccatctgctcggggagtccgagcgtcgcatcccacatgcctagttcgtccacggcggtcctccctcgggatcggtgttggatacctccccctccggcgagaggccagcggcgactaggagcgcccgatggcgctcgtcatcgaccacctctgcatcctcgaccagcagatccgcgataccgtctgtgaccgcataggcacggtggaggcggggattgtagagcactgactccgactcgatccagagcaggggcccgtggtcgagcggacaggcgacgatggcgagcaggtccggcgagagcgcactcatgcgtcgcgagactccgccttcgcgacgacggcgagcacctgctgcgtccgccgagcgacctcgtcggaggtgcgtgcttccaggttgaggcgcaagagcggctcggtgttcgaggcccgaaggttgaaccaccaatcggggaagtcgatggtgagcccgtcgaggtgatcgacgcgcccttcaccggcaaaggccgtctcgacgaaggcgagcacctcgttggcgtcgcgaaccttggagttgatctcgcccgacgccgcgtagcgctcgtactccttacgcagcgtcgagagctccacccctgcgcgagcgagctcttcgagcacgttcaccgcgccgatcacacccgagtcggcccggtagttctcgcggaagtagtagtgccccgagtgttctccagcgaagatggcaccggtgcgagccatctcggccttgatgaacgagtgaccgacgcgcgtacgaatcggcaccccgccctgttcacgaatgatctccgggacagcccgggagcagatcaggttgtagaggatggttgcacccggctcgcgctcgagcatgcggcgcgcgatgatcgcggtggtggtcgatcccgacaccggcgcggcccggtcgtcgaccaggaagacccgatccgcgtcgccgtcgaacgcgagcccgatgtcggcaccctggctgagaacccgtgccttgagatcgatcaggttctcgggctggatggggtcggcaggatggttgggaaagctgccatcgagctccggatagagcacatcgagctcgacgtcgagtgccccgaagacggctgggaccacgaggccgcccatgccgttggccgtatcggccacgatgcgaagacccgcgagcgacgacgcatcgacgaagctgagcacgtggtgcacgtaggcatcgagcaggttgtcggtggtgcgagccccgcgagcgccgctcgcgctcaccggagctagtccctgctccacgagcgcttcgatctcggcgagaccggtctcgacgccgatgggagcagccccgggaccgcagaacttgatgccgttgtaggaccctggattgtgcgacgcggtcaccatggcgccgtgcgcatcgagtcggccgctcgcgaagtagagcatgtcggtcgagcagagcccgagatcgacgacgtcgaccccctcgaccacgagaccgtccgcaaaggcactggccagctcttcggacgagaggcgcatgtcgcggcccaccaccacgcggcgcggaccgagcgcgcgcgcaaaggcacgaccgatcgcgaaggcgatctcgccattcagttcgtccgggacgacgcctcgaacgtcataggccttgaagattccactcatcgtcgcagggcactccttcgaccgccgcccaaggtccgtccgagcgacgcggccttcgggcaccacggcagcttaccgcaccggcccgggacgtaggatcgacggcttcaggcgcgctggcgacgacgggatcgtcccgaccgagcatcctcttcgacgagcgacacgacgtcgtcgacggtgaccgcatcaccatctcggcgccaccacttggccccgcaggcagcacaggagatcagcgtcagcgcgtggcgagccacgtcgaggtcgatgatcaccaggtcccgctcgcggcacgccggacacactgtgtccatgagacctccctctctcgtgggcctttggacccgatccaggcttcggcacctggggccaggatctttaccaaatgttgagctcgcgagctggtgcttcggcgaccgccccgctcacggaccccgagagggctacactcacaccatgcacgtggcccctgagcagctcgacgacgtcgagcgcatcgcccgagccgccctcgcccgactcggcaccgagggcatcgacgacgaccaagagctcgcgtggcgcctcgcgcacgtcgtgagcgctctcggcgccgtgcgagcactcgtggacgatccggcggtaccccaagcgctcgcgagctacggtgcagccctgttcctgcgggaagcggcgagcgagctcgtcgcgctcggcgtcatcgacgacctcggtgcgcttccgctcccaccgcgaccgtccgaggcggccgctgccgaggtcgccgaggcgcccacgacgtggtcgctgggggccgacctcgatctcgcacgcgacaccttcgggcgcttcgcgcgcgacgagatcgcaccggtcgccgacgaggtccatcggcgcaacctcgacgtacccgagcgcatcatcgagggcctggctgggctcggcgctttcggcctcagcatccccgaacgctacggaggctccgccaccggaagcgtcgacgacacgctggccatgctggttgcgaccgaagcactctcgcaggcctcgctcgggatcggcggctcgctgatcacgcgccccgagatcatcgcccgggcgatccttgccggtggcaccgaggagcaacgggtccgctacctgccagcgctcgcgtcgggcgagctcatgggcgctgtcgccgtaacggagcccgactacggctccgatgtcgcctcgatcacgacgcaggcgatcctcgggcccgacacggccaccgtgcgcggcacgaagacctggtgcacgttcgctggacgcgccaacctgctcgcggtcctcgcccgcaccgagcccgacccgagcctgcgtcatcgagggctgtcactcctcctcgtccccaaggatcccgtcccgggccacagcttcgacctcgagatcggcgggggccggctcacgggccgcgcgatcgacacgctcggctatcgcgggatgcactcctacgaggtcgccttcgacgacgtcagcgttgcgcgcgagcagatcgtcggcggcgaggagggacgtggccgagggttctacctccagatggctggcttcgagaacgggcgactccagacggtggcgcgagcagtcggactgatggacgccgcacttgcgcaggcgcgcgcctacgtcgccaaccggcgcgtgttcggacgcagtctcgccgactacaccctgacccggcgcaagctcgctcgcatggtcgcgacggtggcggcggcacgggccgccgcctaccgcaccgcacgtcacctcgagacccccgaagggtcgctcgcagcctcgatggccaaggcatggtcgtgtcgccaggcagagttggtcacgcgcgaagcacagcagcttcatggtggcatgggctatgccgaggagtacccggtgagccgttacttcgtcgatgcccgggtgctctcgatcttcgaaggcgccgacgagacgctgtcgctgcgcgtcatcgcgcgagcagtcgcatcgtccagcgagacgacacgatgagcgccctccgccgcctcctcggcgatctgctgtactgggccggcctcatcgccggcacgggggccatcgtgatccacctgttcacacttaccgtgctgacgcccgggcgcctcacccaacaagcacatcagctgctctcagccagcgtcgtccagcgcgcgatcgccgactcgctcgccaacgcgctccaacccatcgcttcggctcagggcgtccagctcacgtcgagcgaaaccctcgctgcggtccacagtgcgctcagctcgccgctcgtccagagtgacttcctcggcgccatgacgaccgcgcaagatcgcctcctcgggaagaccagcgcacccgtcgtgatcggcggacccgccttcacgcaggccatcgccgccagccttgcatccgtcgacccgtccgtcgcccatgtggtcgcaggcgaggacctcgccgtcaccgttcccggagccgacgtgcccaaccttggcttcatcgccaccaacgccccgcgcaccgagcacacgctgacggacatcgcgctgctcgccctcgtcctcgccctcgtgctccacaacgaccggcgcaagctcctcgcccgcatcggcacctggctcgtcggctgctcgatcgccgaggtcgccttgttctggttcctcccgaaggtcatcctgccgcacgtcggcttctcgtgggcccagttcgccgcggtggtcctcacgatgaccggggcggccacggtcacgttcttcctcgagctcttcgctgcaggcgccgcagccatcgcgctcgcgcgcggcgcgaaggcgctggtgtgatggctcagccgacgagcgaagcctcgacgatcacattgtcggcataggacccgccgacgccagggacctcagtgaacggtcccccacaggtcaccagcgcgagtgtgggtggcccttgggtcgtgaagagctgtggatgcacgacggtgttcggcgagagcaccggcttcgtgtcgactcgccactcggtctcgcgcccaccccagttgagatagacaagatcaccggggacgagctggccgatctcgccgagggcgccctcgccctgcccgacccagttcacgtgcccagcgagcagcgtcactccgggcgctccgggcgatggcgtctgctcgtcccaccccaccgtgtgcacgtcggacgggatggtcagctcaccgttcaccggcccctcggcgaccaccggcgcgctcacggcaagcgcagggatggagatctcggcgacctcgcccgacacggtcggcgtaaacggcacgagacgactcccgccttggcggggagcgatcgctctctggctcgcgagtgaccgggctcgcacgtgatcgaggtgggtcagacgcgcgatgcgagcagccggcgacgtcgcgataccgtcgtagacgagccagccccccgcaacgatcgcgagggcggacccgcccaccgcgagccggcgccaacgagcgctccgggcgcgctcagcgacgctcatcgtgcctcgcgcggagggaacgacgacgtacggcgaccgccagcgtcccacatcccacgccaccgagcacgatgccgatgggcaccgcagcggtcgtggtcgacggagcgacccttggcccggtcgcgagcagcacgggcgtgaccgacgtcgagctcgtgcgaggtgtcgggagcgaggtcgacgaaccggaggtcgtgggggtgggtcccgagcctgtcggaagcgaggtcgacgatccggaggtcgtgggggtgggtgatgggcccgtcgagccagacgaaccggagccagaggacccctggccttcccccctccaggttgacacctgctataggaggaagggatgagccagacaccgaacccaccaccgggcgacggccccgctggacgacgacgcggccgctacccgagccagttccgcaaggacgcggcagcgttggttctcgaccagcgccgcaccatcgctgacgtcgcccgtgagcttggcatcaacgagcagacccttggtaactgggtccgtcaggaacgcatcgaccgaggtgagcgagagggcctgacgagcgccgagcgcgaggagctgacacggctgcgccgccaggtcaagcagctcaccgtggaacgcgagctgctcaagcgagcgatggccttctgggtgaaggaggggggacagtgagccgctaccactggatctcccgccaggaggccaagggcttctctgtagcggcagcagcacgagtcatcggggtctctcgccaggcctactacgcctggcgacaccgtcgggaccgaggcgaggatcccgagcacctggtgctcgcgagcgagcttcgcgccatctggcacgagagcgacggcacctacggcagcccccgcatcacccacgagctgcgacggcgcgggttctgcgtgaaccacaagcgggtggaacgcctgatgcgcgagctcgagatggcagcgggcccacgccggcgcttcgtagtcacgacgaggcggggagaggacgcagcgctcccggacctcgtccgtcaggacttcgctcctggtgagccgaagcgcaggtatgtgagcgacatcacctacgtccgcaccgatgaggggttctgctatctcgccacggtggcagatcttggctcgaggcgcatcgtgggctggtcacttgggcgtcacatgcccgatgacctggtggtcgaggcgatccgcgaagcactcgggactcggggcagcctggctggggcgatctttcacagcgatcgcggcagccagtacctctcccggaaggtacggagcctgctcgcgacccttggcattcgccagtcggtggggagggtcgcgacctgctacgacaacgccgtggccgagtccttcttcgggagcttgaagcgcgagctggtggctcgctaccgcttcgcgaacctctcaggggctcgctctgccatcgctagctggattcaccgttacaacacggtccgcctgcactcaagcctcgggtacctaccgcccgtcgagtacgagctctcctgggcctgccgggaggtggccgtggcctaaattcagactgtcaagcaaatggggggaagcccacccgaacccgacgaaccgccagagctggtcggcgacgcggggacggtcaccgtcacctggttggacggagtcgtcgaaccgtcgtagctcacggtggcgacgttggtcgcgctctgggtcgccggcgccgatgccgacaccgtgaccgggatcgttacggaaccgaggacggtgccgctcgccacgtcgatgggctgaccgttcaccggcacgagcgtgcaggtcatggtcccagctgagatggcacacggtttcccgcccggagcgctgtcgctcaaccccgccgacggcgtgaagctcggcgagccgtagctgagccaggtcacgctcggcaagttgtcactgaccgtgagcgggtcggcgatgatgcccgagcccatgatggtgatcgtgtactcgccggtcgtccctgggctcgcgaccgaggtcgggctcccgccgctctcgtaccccttcacgaccgtgaacgtcggtggggcaggctgtgggagcgtgcccacgaacccgtggggcgcggtgtggacctcggggaccacgacacaggggacccccgccgtctggacgcagctcgcagtgttcgacaaggttccctcgatgacgtccccgtcgatctgggtgccgccggtgatggtgccgaagggcgcgaggagcgacccctcccactgcacgccacccgagcctcgctggccatcgagcgtgatggactgcgtcgcactcgacgacggcggcgcggcgacgaagatcgccctgctggcgcccgtcgcgctcaccgacgtgatgaaggagagatccgcctgggtcgggagctggacgatcaaggtggccgacgagggcaccgaataggcgagcgtccactccggggacgccgggtacgcggcctggccggcctcgatggcagccaacgcatgaccaaggttcacgacgacgtcccccgtctgcgtcgacgggacgctgatcgtgatcgtcggacccgaggaacccgtcgtggggtaggtgacgctcgccccgctcgtcaccggcaggcccgagagctcctcgtcgagggcctcgagataggtgttctctgcggcaaagtcgagcggactcgttggggacgccgtcgtcaccggcccgctgccgttgttgtagagcgtccatgatccctgcgtccccgtgggcgtcggggagactgccgccccgtagttcccgaggacgaacgtgcttccgctctggacatcgggtgcaacgagcgcgtcacacgtcacgcccggggggcaggagaacccggggaccttctttccgtcgacggtgaagctcgtcccatgcgcggtaccgatgctgccaccgaaggccgcccatccggtcgtgtcgaccgaaccctcgagcgtcgcgtcaccgccaccgacgtagaagccgtacggaaacggattcgccccgccgagcgtccaagtcgtcgagtcagaactcgcccgggcgccggtgccgacgagtccgaacgcgcccgccatccctgccgacgcgactgcgagcgcaaccgcgccaacgaggcgtcctcgccacgcgaggtgtcgacgctgcctcgtgtgacgacccctcctggtgcgccgccgcagtcccctggtctccgcctcgtccatgtgcgctcccaaccctggctaccggagccggccacccaaccatggccacgctgtgtggttcgatggtactacgtcatgtggcgtcttcgccacattgccctcaaggtttgcaccatcgttgccgataaggccacctggccgctgttcaggaccgcgccttggcgacgtcgggaccacgacggtcctcttgaggcgctcgacgctcagcgtgagggcaggctccctacgaggccaacgaccgatgcgtcagcccacgcactcctgtggcgctgcaccagcgcaccaggccactcgcactcggtcgccgcagcgacggcgctacgacgccgacggcgtcatgccggcgcgacggccacggagggcgaacttctccgccatcttgcgactcgcctcgtcgatcatctcgtccccgaacatgaccgctccacgacggtccgacgtcgtggcctgctcgtaggcgtccaagatggcgacggcgcgatcgaagagttcctgtgacggacgatacgtgtcgttgaggacgtccacctgcgtcggatgcaacgcccacttgccgtcgtagcccagcatggccgatcgaagcgcggaggccttgaggccctcgaggtcgtggatgcgcaagaacgggccgtcgatcacctgcagacccgccgtgcgcgccgccatcaggatcttcgagaggacgtagtgaaagtggtcacccggatactccggaatcgcagccccaccggtgagcaccggcagctgcatcgacgccgagaagtccgccggtccgaagacgagcgtctcgagccgtgacgacgcggttgcgatggcctcgacgttgatcagtccccgggtcgtctcgatctgggcctcgatgccgatgtggccgcgctcgagtccgagttcggcctcgagctgcgtgagaacgagatcgagcgccaccacctcgtcggggcgctgcaccttcggcaacatgatctcgtcgagacgcgggccagcccctgtcaccacctcgatcacgtcgcgcaacgtgagcggcgtatcccaggcattcacccggacgcacaccacccgctcgccccagtcgaacgagcggatcgcacgggccacccgcccgcgggcctcgagcttctcgctgggtgcgaccgagtcctcgagatcgaggaacaccatgtcagccgggatggtcagcgctcgctcgatgaagcgatcggacgatccaggtaccgcgaggcacgaacgacggaggagatcacgagatcgggcacccatgggccccagcgtaccaatgcgggtgggtccgcgtcagctcacgcttccgagagctcgaaccacaagaacccgtacggcgcgagcgtcagtgggtagcctccgtcggctgggacctcaggaaatggggtcatgccgagcagctccaccggcacaaagccctcgaacccacgaagatcgaggcggcagggctgagccttcgaggacagattgctcacgcaggccacgacccgctcgtgctcctcgtcgaagcggaggtaggccaagatcgccggattgtcgacgtcgcgcagctcgaaggtaccgtcaccaaagactccctcctggcgacgcgcgagcaggagctcgcgcagccatctgaggaacgacgacgggttgcgcatctgcgattcgacattgacgacctggtagccatagaccgggtcggtgatcggggcgaggtagaggcgctggggatcggcgcgcgagaacccgccgttacgatcgggcgaccactgcatgggggtacgcaccgagtcgcgatcgccgaggtagacgttgtcccccatcaggatctcgtcgccgtagtagagcaccggtgagcccggcagcgacagcaggagcgcgtggaggagttcggccacgcgacgatcgttctcgatgaggggcgcgaggcgccgaccgatgccaacgttgcgtcgcgcgatgggatcggacgcgaaggccgcccagagaaagacgcggtcctcttcggagatcatctcgagggtgagttcgtcgtggttacgcaggaagatgccccactggcaccgcggcgggatcggtggggtctcggcgatggcgtcgcgaatcggctgcgcactctcctgcttcaccgccatgaacagcctcggcatgagcgggaagtggaagcacatgtggcactcgtcgccctggccgaagtactcaacgacctgggccggaggctggttcgcctcggcgagcagcaccgcgtcgggaaactcggcatcgacgagcgccctgatccggcgaaggaacgcgtgggtaccgggaaggttctcacagcgcgtcccctcggcctcgaagagatacgggaccgcatcgaggcgaaaaccgtcgacgccaaacgccagccagtagcgcacgatctccagcatcgcctcttgcaccgccgggttctcgtagttcagatcgggctgatgagagaagaaccgatgccagtagtactgttcgcgttctggcgcccacgaccagttcgacgactcggtatcgacgaagatgatcggggcgtcgcgatacccgtcgtccgtgtccgaccacacgtaccagtccgccttcggattgtcgcgcgacgagcgcgactccacgaaccatgggtgctggtcgctcgtgtggttcagcacgagatcggcgatcacgcgcatcccgcgcaggtgcgcctcccgaagcagctcggcaaggtcgtcgagggtgccaaggtcgggatggaccttggtgaagtcagcgacgtcgtagccaccgtcgcgcagcggcgactcgtagaacgggagcagccacaagcagtccaccccgagccactcgaggtagtcgagcttctcgatgaggcctcggaggtcaccgacgccgtcgtcgttcgagtcgtagaacccgcggatcagcacctcgtagaagaccgcttgctggtaccacgcgggctcgccctcggcgccccgcagcgaggcgaaccggtgttgggccatcaccgtcccacgaagttcgctcgtcccggcccatcggtcaggaacgaccgcacaccgatgcgcgcgtcctcggtggtgaacacctgcgcgaagagtgcctgttcgagcgcgagcccctcctcgagcgagccctgcgtcccctcggcgagcgcgaccttcgcgaacgcgagtgctgcgagcggacccgacgcgaagcgctgcgcccacgctcgcgccgcctcggtcgcctgccctggctcgacgacgcggtcgacgagccccacgccgagtgcctcggcagccgtgagcggctccccggtcaggacgagacgcttcgcgaccgccaacccgacgagccgaggcaaccgttgtgtgccgccgccacccgggatcaagcccagcgagatctccgggaggccgagcttggccgacgaactcgccacccgtaggtcgcacgcgagggcgagctcgaggccgcccccgagggcgtacccctcgatcgctgcgatcaccacgcgtgggagcgccgcgatggcccccaacgcgcggtggaacgcccgggcggtctcccaccccacggggcgctcgtcgaactccgcgatgtccgcgccggccgcgaagatgcgatcgccacccgtcacgaccacggcgcggggcaagtctcgctccaggtccgaggccgcggctgcgagttcggcgagcaccgcgcccgagagcgcgtttgccttcggccgatcgagccgtacggtggcgacgcctgcatcgtccctctcgacgtggacaaactcactcatcggatgaccctcctcgtgctccgtgccctggagcgatctcgagcgcgtcgaggagtgcgtcggccgcggccccagggtccacggtgcccgcctccacctgcgcccacactgcctggtctgcgtcggccgccgcccggaggacgcgatcgacgatgacacgctccaccgcgcgcctccgccgcgcggccacgcgcgacttcaagatgcctcgatcgtcgagttcggccgcgagcgccacgacggcctcggccaccgcatcggtgccctcaccgctcgtcgcgaccgtctcgagaatcggggggcgcggctctcgatggccgagatcgagcatcgcgacgagatcacgacgcgtctcggcgagccccgcacgatcggccttgttgatgacgaagaggtcggcgatctccatgatgcccgccttgttggcctggatggcatcgccccagcccggcgtgatgacgaccaccgtcacgtccgcctcgccgacgacctcgacctccacctgtccgacaccgacggtctcgatcacgacgaggtcgtagccgaccaacccgaggagtcgaacgatctcggggacgctgcgcgcgaggccacccagcgcaccgcgggtcgccaccgagcgaatgaacacgtcggggtcgtgcgtgtgcccctgcatacgcacgcggtcgcccaggatcgcgccgccggagaacggcgaactcgggtcgaccgcgacgacacccacgcggtgaccccgggtccgccacgccccgaccaagcgatcgaccagcgtcgacttcccagcgccgggcgaaccggtcaccccgaccacgacacgagggcgcgctgaccacagatcggcgatgccgatcggctcgccggcccctgcccggcgctcgacgaccgagatcagccgtgcggtcgcacccctgtcaccagcacgagcccgtccaacgagctcttcgaggtcgctcactcgcctccctcgatccagacctgacccccgagtcgctgcaaggttcccgcaagatcgtcgtagccccgctcgatgtgctcgacgccgagcaaccgactctggccctccgcagcgagcgccgccaccaccaacgccgcacccgcacggatgtcgtgcgcgaccgccgtcgcaccgtggagatgatccacgccgcgcacgacgacgtgatggccctcggagatgatgtccgcgccgaagctccgcagctcgtcgaggtagcgaaaccgaccgctgtagagattctcgctgaccaccgagactccctgggcacgcgtcagcatcgccacgagcatgggcttgtagtcggtcgcgacccccggatagggcagcgtctggatgtccccggccctgaggcgctcagtgacctcggcgacgagccgttgacccgcgtcgtcggcctcgatgtggaagccgaggccgctgagcttgcgcagcaggatctcgaggaccctcgggttgacgccgacgagctcgagacgcccggtcgtcgcaccgagcgcggccaggtaggtggccgcgacgacgcggtcgccgatgacgcggtgacgcaacgggcgcaggcgctggacgccctggacgcggatccgagacgtccccgcaccgtcgatccgcgcgcccatcgacacgagcgcggtcgccaagtcgacgacctctggctcacgagcggcgttgtcgatgatcgtctcgccgctcgcggtgacggcggcaaggagcgcggtgtcggtccccgtgtgggacgggaactcgagcgtcaccggcgcacccgcaaggggggagcccttcacgaggaccgatcccgcgtccatcgtcgccacggcaccgagactggccaacgcatcgagatggatgtcgatcgggcgcgccccgaaatcatccccacccggcggcgcgagccgcaccgcgccggtgcgcgccagcaacggtgcgaggagcacgacggacgcgcgaatctgcccgacgagttcggcaggaggttcgctcgacagcgacgccgcctcgggcacctcgacctcgacgacgtgcggctcgggccaggacacccgagcccccacggcctcgagcaggtgggccatgacggtgacgtcactgatggccgggacgttctcgatacggtgacgaccctcggcgagcagcgtcgcggccatgatcttcaggaccgagttcttcgcgccctgcaggcgcacctcaccctcgagccgcgacgtgtgttggaccatccacgaacgcatcgcgcctccctcacgctctccacgccaaccggccacaacctactcggcgccggcgcccggggccaatggcggcgcgtcctcagggttgaggtcctcgagcgtacgagcacgcgtctctggaaaggcgatcagcaccagggcagcgagcgcgatcggcccgatggcgagcgcggcgatcggggtgccgtagcccaatccagccgacgcggccgccccgaccgcgacgagtcccaccacggtgcccaccctgctcgcgatcgcgatcacaccattggccccagagcgaagcctcgtcgggaacagctccggtccgaacaccgccagcgccggcaccgccatggtcccgaccgcttcgccgacggcgtagagcaccaccagcgccacgccgtgggcgaggaatgcgagcgcgaggagcaccccgccgaccgcgagcccaacggcggcgagcacgcgccgaccgaccgtctcggcgaggcgcgcaccgaaggccaggccgatcccagatggcaggttggcgccgatcgtgaacgccgagatctgccaggccgcaaagtggcgatcgacgcgcaagaactggttccgaaactgggaagccggcaggtagaacaggttgaacagcgcggcagcgatggccacgaggatgagacgaccgcgatgctcccgagaggtgagttcgcgaaagcgcacgggggtcgagtgccgaaagcgggccggatcgcggcggtgacggaggcgtgggacgagcacgaggccgacgatcgcgatcgcgaacaaggcgcgccacgcctcgggtgcgatcccaagcccagccaccgccaccgcgcacagtccggcaccgagtgcggtcgcgagcaccagaaagcccatcgtccacgctcgcccctccgcatgcaccgtctcggcgacgatgacgttcgcgagcagtacggcaaccgtcgcgcccgccttggcgagcacctgggtcacgacgaggccggcgaggtccggtgccagcgctcctgccgccgtcgcgagcgtcgcgagcacgagcgcagcccgcaggacgcgccaccgacccacacggtcaccgagcctcgcgatcggcaacgcgacgagcacgtcgacgcgcaccagccccgaaccgaccccttgcgcgaggggtgaggcgtggagcgtgggggcggcgaaggcaagcgtctgtcccaggagcgttccgcagtacgcaacgacggtggcgacccagaacacggtcgcaacgacgtccagtgacccctgagggaagacccctggcggcagaacacgccgcaccaaccggcccttgccgcgcaccagacgcccgagtgcccagcgcacgagccagccgagtcccggcgcgccgacgtcgcagcgcacctcccaacggccgtctggcaagcggcggcgctcccacgccacgagcgagcccgatccctgcacgaagcccgccgcgacccgctcctcgacgagcagggcgcacgcgacgggtgcatctggtccagcgagcgacctcacccgcacgctgatcggctcgagatcaggaacccaggtgctcgtgcaggaacggaatcatgcgatcccacgcctggcgagcggccagtgcgtcgtacacctcgggtctcgagtcgttgaagaaggcgtggtgcgtgccggggtagatgaagaactccacgtcggcaccgagttcccgcagccgcgcctcgagagcacgcacgcgatcgggagacgcgaagtcgtcgtgctcggcgtagtggccctggatggcagcggtgatacggctgtagtcgggctcggccccctgccacgggatcaccccgtagaagggcaccagcgctcggacctgcgttggcacctcggcagcgagcacgtaggcaagcccaccacccatgcagaacccgatgacgccgacgccctggcgccccgtgcgtcgctccagttcgcgaaccgcaccgaccatgcgcttggaggcatcggagagctgcatcgccatcatcgccttggcggcctcgtccggctcgtcgacgacacggccgtcgtagaggtccggagcgagggcactgaagcccgctgccgccagccgatcaacgacatctttgatgtgatcgttgacgccccaccactcctggatcacgacgacgccagggcccgtctcgccaaccggctgcgcgaggtagccagtcgcgtcgtggccattcatcggaaagtgcacggtctcgcccatgcgcccatgctagccagcagggagtggcggcgtcagtaacgtccgccgagcttgcggtggtcccagctcacgatccgctcgggctcgaggcggatggcgacgcgcttggaggccgaacggcgcatcgcctccgcggcctccgcagaacccagctcgtagcgagcgagcagaccctccccgacccggcgcaccagtacggggtcgtcgctgagcacggcccgaccctcgatcagcacgccgcggagctcgtcgtagcgatcgccgagttcgacgagcccgctcgcggtcgcctcccgcgcaaggttgcgcgccttctgcgagcgcgcatacgtccacgaccacaccacaccgtcgaggacaacgtaccacaagggcaccatgtggatggtcccacgaggcccgtgactgccgaggacgagtgtcctcccctcgctgagcagggctgcgatctcgtcctgggtcatcgccacgtgactacgcctcgacggcatcggcccctccctccagctgcgccagtccgggggcaagtcgcggccacccgtagcgcgacggcaggattcgccgcccgtcgacgagcaccgccaggtccgcggtcgcgaacaggcgggctcgatgcctgttggcgaccactcgaaccagctcgtcgggcaggagccgccaggtgcacgtctcgaccgtcgacggcccgacgccgcgtcgggcgacgagcgtcgggccaaccgcgagttctccgccacggccatggagtccgcaggactcgaggtgatcagcgagctcgatcccagcccggtaggcctcctccagtggatcgatgaccccgagcacgcggttcgcgagcgcgagcacctcgacgccgacgcggggatgggcgacaaggagccgaagcgcgctcgtgagttctgggggcgtcgtcggctctgcagcgatgacgagcgcaaccgtgccgacggtgtcagcatcggtgaggtcccacgcgctgagctgacgcagcgcttcgagcaagctcatcacccggcttggataccccctcgtgtcatggctgccacgtcgagcacgcggtcgacctcctcctcccccaagacgccctcctcgagcaccaggctcctcaggtcccgcccctccttgaccgcacgcttgacgatggccgcagcgcgctcgtagccgatggcggggttgagggccgtggcgatcgccggtgtcgagagcgcgtacgtccggcaccgctcgacgtcggcctcgatgccgtcgacgcaccgcgtcgcgagcaggcgggacgccgccgcgagcaacgtgacgctctcgagtgccgcctgcgcgatgacgggctgcatcacgttgagctcgaagatcgacccggcggcgcccgcgaagccgatcgtggcgtcgttgcccaccacgcgcgcgaccacctgggtcaccgactccgggatgaccggattgaccttgcctggcatgatcgatgagccaggctggagatcgggcaggcgaatctccgcgagaccacacctgggaccagaacccatccaacgcaggtcgttcgcgatgcgatacagcgccacacccagcgcacgcagactgcccgacaccgccaccacgccgtcacgagctccgtggacctcaaagtggttcgccgcctcgcgcacgtcgagccccacccgagcgccgatgcgtgcgagcaccgctgcggcgaagccctgcggtgcgttcaacccggtgccgacggccgtgccgccgagtggcacctcgcgaagctcgtccaccgcggccgcgatacgggtgcgtgcccgtgcgatctgggctgcgtatcccgagaactcctggccgagcatgatcggtgtcgcatccatgaggtgcgtccggccggccttgaccacggtggcaaagtcctcgctccgacggacgagcgacgcttccaaggtcgcgagcgcagggtcgagcgcgtcgcgaacctcgagcgcgaccgcgaggtgcatggccgtcgggaaggtgtcgttcgacgattgcgaggcgttgacgtggtcgttcgggccgacggtccgaccgaggcggagcgtggccagatgcgcgatgacctcgttcatgttcatgttggtcgaggtccccgatccggtctggtagacgtcgacggggaagtgctcgtcgtggaggccccgggcgacctcgtcggcgacggcggcgatcgcctcggccatctcgggatcgaggacgccccggtcgcgattctcgagcgcggccgcccacttgatcaacgccagcgcgtggatcacctgtggcgccatgcgctggcccgacaccgggaagttcccgatggcgcgctgcgtctgggccccccaggccgcatctgctggaacctccacctcgcccatggtgtcgtgctcgatccgcacccgttcgctcatcgcctgctccttggtcatcgccgcgtggactaccctggcaccgatgcgagctgtcgtgatcgccgacggtgccgtcaccgtcgcaaccgtagccgacccgaccgttggacgccacgaggcccttgtcgaggtcacctccgcagggatcaacgccgccgacctcctgcaggcgagaggcctgtacccgccaccacccggggtcgatccgacccggctcggcctcgagttcgctggggtcgtcgctgcggtcggggacggaaccaccgaggtacgccccggcgatcgcgtcatgggcatcaccggcggcggcgcacaggcggagtacgtcgtcgtcgacgcagccacgctcgtgcccgtccctgacgagctcgatctcgagcgcgcaggaggctttcccgaggccgccttcaccgccctcgacgcgctgctcatccaagggcagctcggcctcggggaccgcgtgctcgtgaccggcgcactcggtggcgtcgggaccatcgggctccagatcgcccgtctcgccggtgcccgcgtcacggcgctcgtacgcgatgagcgacgtgcatccgaggcctatgccctgggcgcacaccgagcactcaccctcgacgagctgccaggttcggggccctacgacgtggtgctcgagctcctcggagcagccagcctcacgcacgccatctccgagctcgcggtcggtggccgcgtcgtggtcatcggcgtcggtcagggctcacgcgtcgagatcgacctgcgcacggtaatggggtcacgagcagccctccgtggatcgacgctgcgcgcgcgcccgacccacgagaaggcagcgctggcccgagaggtcgcccaccgactcctgccggcgcttgccgaaggttcgctccagatcccggtcgccgcgacgtggccgctccacgacgccgccgccgcctacgaggcgttcgcgcgcccgggcaagctcggcaagctcgtgcttgccatcggcgacgtctgacgggttgcgctccaagcgcccgatcctcgcatctcgatccgcaggagctcaccagcgacgatggacgcagagcccaacgacgccgagagctcccaggcatgcagctccacgttccccgtcgggtcgagttcctcggcgaggccgtcgagtgtctgcccgggcgcgatgcgaacgacgcgcacgatcgttccgatgtgggggcgggcgacggcgcgtagcgcgccacagcacaccgcgaccacgacgagggcgagcgtggccgcgacccgcacccgttccccgcgcccgagacgacctcggccgggcggcctcctccgagcgaggcgctggttccgggcggagccccggctcgtcggctccgccgaacgcgccggcggtggcgtagcgggcgtagcgacgatcgcgagcgcagtcgaggcgggaggcgtacgaacgggcgcggtcacacccgtggcctaacccgagggtcggacacggcacgcaaatgtgacggctatttgcctatgcggatacatcttggcgatatactggcgacatgccgaggatcgaagcaccaaccgtccgcgaacatcacgatcagcgtcgtgagcgtctcctcgacgcggcacgggcgtgcctcgtcgacccggcgattcgctcggtcggcttcgaacacgtcggaccgcgcgcagggatccgacgcaacagcgtctacctctacttcccctccgagacccacctgtatcttgcccttgccgagagcgacgtccccgccctcgccaagcagttggccgaggcagcggcggcagccacgcacgacaagctcgccgccatcgtcgacgtcgtcctggcgaacgcgccccgggaggagttcgagatcttgcgccgcctggcgagtcgcaccgcgtcccagcgtcccgatctcgtcgcaactcgccttggcgagctgcgacgtgagctcgccgaaccactcgtctcggtgctcgccgacgagggtgtggactccgccgacctcgtcggattgctcgcccttggcaccctcgaggcggcactcgacgcgatcgctcagggcgaagatcgcgacgcggtgcgcgaggcagtcctcgccaccgtgcggagcccgcgcactcccagccgctgagcagcaggccacccggcacggcccgccggccgccgagtcacggttctgcctgccgaaggtcggcgtgcgcccgccgccatgcgctctgtgctgctcatcgcgaccggagttcgctccatgaggcaagtaggccgagcaccagcgcatcgaacctggccaactcctcgagtgaggcgcgctcgccgaggctatgaccctcgccctctgccacctggagttcgcacgcaaggctctcgccgacgcgctcgacgaacgcacgagattgctccaccggcaccacacggtccgcgctgccgtgcgtgatgaggaccgggatgcgccgccgcggtcggcggtgcgcgaggtgcggcgcgtcctggccgaccagccagtcgacgtcgccgagcgcggacgggtcgagcagtgggttggtcaacaccaacgcatcgagcagtgtcgggtcctcgaggatgagctgcaggagcgtccagcctgccgacgacgcgccgatgccgacgcgaggacccgcgaccacgccctcgaatccccgcacgacctcggcaagggcctctgactcgaccgtcccgaaccgaccgacgatacgctcgcgtgccgatcgcccgtagccgtacgaacccgggtagtcgaccgcgacgaccaccaagccgtgtcggagtgcgcgacgccacttgtcggggaccgggaacgcgacctgttcgacgggaccgccatggacgaccagcgcgacaccacgaggtaccgggggccagatcgccacgccgcgtgcggccagccccaaggccccaagtggctcgatgcgagaaccgtccaccccgtccgagcccgcctgccggagcgtctcggacccacggcggacccgctccgaccacggcccccgctcgatgcccacgacgtcaccgtcgatggccgagatcgaggtccacgagcccgacgccacgcgacggaggcgctcgtccaggacgacgagcgcgggcgcctccacggaggcgatcactccgagcaccgcctccgagtcggggatgtagccccgacgaccaggcccaagagggtactcacccacgtcgtagtcgagacccgcgatctggggcacccgccccgcgagtaccgggacgtgcgcaccggcgcgatcgtcacgaacccacagaccgcccggtccgaaccgcggctccaccacactcgcaccgtcaccgccgaaattccccgcgatggcgccggtcgggtcgagaagcatcaccgaccccgtgagccacggctcgcgctcccccgcccgggccaacgcgatcgaaccgtcgtcgtcgacggccacatcccagaggtccgagaccccaaggcggccgaggtccaccacgttcaccagccgagcctggtcgtcgaagacgacgacgcgagcgtcgctcaccaccgcaaccatggctccggcgggagaaccggcgatccaacgcacgccgggcacggtggcgacgtgctcgatgcctcgtcccggcacgactcgcacgacggaaccgtcgacgcacaacacccacaagcacgagctgcccatcgcgaggaccccgccgttgccgggacgcgcccacgctggcgtgacgtcggcgcagccgagtgcagtcacggtgctcgccaccacgaccccgcgagcactgcgctcgatccacgcgacgcccagcggacctgccaccacgtcggcgacgcgctggacgacgtcgctcaccgaggcggctcttcgtagaggccgaacacctcgccgagcgccatcatcacctcgccgacgctcgctctcgcgcgagcggcatcgatgagagcgggcatgaggttgcgctctggatcgcgcgcctcgtcgacgaggcgtcggatcgcagtccgctgggcctcctcgtcacgctgacgccgcaccctcctgagtcgttcgatctgacgcgcttcgacctcgggcccgatcacgagcgtcgggatctcgtcctcctcgttgccggcggtgaaggcgttcacaccgacgatcacccgctctccggcgctgatgcgcttctcgagctcgtaggcagagtctgcgatgcggccctggtagtaaccgtcgtcgatcccgacgaaggccccctcgagcatggaccccccaccgaggcgctcgatctcggcgaagatcgccgaggctcgtgcttcgagctcgtcggtgagcgcctcgacgaggtaggagccgcccaaaggatcgacgacgttcgccacacccgtctcgtaggcgatcacctgttgcgtgcgcagcgcgatgcgagccgcacggtcggtgggcagcgagagcacctcgtccatggagttggtgtgcaggctctgcgtgccgcccagcacgcctgcgagcgcctcgagcgcagtccggaccacgttgatctctggctgctgggcggtcagcgacacgccggcggtctgcgtgtggaagcgcaactgccacgaacgtggatcgcgcgccccgtagcgctccctcaaccaacgggcccagaggcgccgtgcggcgcggtacttcgcgatctcttcaaagaaatcgatgtgggcattgaagaagaatgacagctgcggcgcgaacgcatcgacgtcgaggccggctgcctggccgagctcgacgtaggcgaagccgttggccagcgtgaaggcgagttcctcggccgcggtcgagccggcctcgcggatgtgataacccgagacggagatgggatgccacttcggcatctcggccgcggtgaacgcgatggtgtcacgcaccagtcgagccgatggacgaggcgggaagtagtactccttctgcgcctgatactccttcagaatgtcgttctggagcgtgcccgcaaggcgctctcgtgcgacgccacgctcctccgccaccgcgatgaaactggcgaggatgaacgccgctggcgcgttgatggtcatcgacgtggtgaccgcaccgaggtcgatcccgctaaacaggtcccgcatgtcctcgagcgtgtcgatggcgaccccgcacttgcccacctcgcccaccgaccgagggtcatcggagtcgcgtcccatgagcgtcggcaagtcgaacgcgaccgagagcccggtgcccccgttggcgagcagctcgtggaagcgctggttggtctcgatggccgtcgagaagcccgcgaacatgcgcatcgtccagcgcttcgttcggtagcccgaggcgtagacgcctcgagtgtacggatactgaccaggcagctcctcgtcgggatcgaccatggctcccgcgtcgtccgggtcgagcgcgccgtggcgcccgtagaggggagcgaggggcacccccgagagcgtctcgaaggcctcctcgcgcgttccggctcgacgatacgcctccgaccaagccgacagatcacccatgggccgattctaccgaacgtcgctgacgcctccaaggcccgtcacccatgcgatcccccgacgcgggtggtacaggctgctaacgttggcgcgtgaccatcgacgaccgaaccccggaccgcaacctcgctctcgacctcgtccgcgtcacggaggcagctgcgctggctgcgagcgcctggatcgggcgcggacagaaggagtccgctgacggcgccgcggtcaacgcgatgcgctcgatcctcgcgaccgtgcccatgaccgggacggtcatcatcggcgagggcgagaaggaccacgcccccatgctctacaacggcgaggtgatcggcgacggtaccggcccagtggccgacgttgcggtcgacccgatcgaggggaccacgccaaccgcgatggggcgctggggtgcgatgagcgtgatcgcggtcgcgacgcgtggctcgatgttcttccccgggccgatcgtctacatggacaagctggcctccggacccgagggcatcggcgtcgtcgcactcgacgcaacgccacgcgacaacatccgcgagctggcgcgtgccaagggcgtcgctcccaaagacatcacggttgccatcctcgatcgaccccgccatgcggacctcatcgaggaggtccgtagcgccggagcccgcgtgcggctgatcggcgacggcgacgtctcggccgcggtcctcaccgcgatcgacgagagcgatgtcgatctcctcatgggcgtcggcggctccccggaggcggtgctggccgcggctgcgatgcgctgtctcggcggacagctgcaggccaggctgtggccccgcgacacggacgagcgcgaccgggccctcgcccagggctacgacctcgagcacgtcttcgcgaccgaggagctcgtcgacagcgacaacgtcttctttgccgggaccggcatcaccgacgccgagctcctgcgcggagttcgcatcgtgggcggacgcgtccatacgcactcgatcgtcatgcgctcgcgttcgggcaccatccgcaccgtacgcgcccagcatcaactcacgaagctgagggcgatccagctgctgtcctgagcgagcccgagggcccgtgcgagcggagccccaacggcgacggcgccacgttgctcgagcaacgccgttcctgcggggccaacgagtgcggccggggcgagcgaggcgccaagggcgtcgcgtagcgcggagccgacaccgaaccctcgcagatcggggtcgaagacacgcgcatcgacgagcacccaggccgcatcgctcgctcgtcgcgctgagacgacgccgatgacctcatcgtcgacgaaggcgagggcactgcgctggtgcagcgtcggcgccgcggtctgagtcagccaggctccatcgctgacgacgacacgtaaccgcaggtgcgaccgtacgacgatccagctctcgcccacgcgcgcctcgagcacggagcgccaccatcgcctcggatcgcgcatccgcacgagcaggaccgcgaccgccctcggctcgagcggtgctcggaagtcggtcccgaggtcagcgaggtgttcgagcgactcgagcgcacccccctctcgaatggtcacgtggggcacgaacgggcgatcgtccggccacccgagctctgcggcgagcccggcgatccagccgtcagggtcggccacggccagatgcgcggtcgggcgccggttggcgaagacgccgatccccgagaactccgtcactggtggatccagccgcgcgacgacctcggcgacctgccggaggagtgcagcaacgccggcagcgtcacgctcatgcggcggcagcaacgtgatgtgcggcacgatgcgatcgagcgcgcgcgagccgacgacacgcctcacggcatcgatgccctcctcctgggcatgcgacagcaccagcgcgacggcgacccgaacgcggctcacaccgacagccgagactcccgcagctcgaggcccgcccgatagggggccacgaagcgctcgtccacgtcgctcgcgagctctgcgacgacacgccgccgcgactccagcgacgcctgatcgatgtcgcccacgaactccgcggcacgcgcgagcacgacggcacggttgccaccgacgcgcaccagaccgccgtcgatgaccagttcctcctgggtgccgtcggcgagccagagcttggccacacagacctcgacctcaccgacgaaacgcccgtggttggcgaggaaggcgatgtcgccggtcgggacacgcatgacgagttcttcgacggctccctcgaacacgacctcctcgggagttgcgatcacggcatcgaaggtcgcgcgcatctctacccgagctccttggccttggcccagacgtcctcgatgctgccggcgttcaagaacgcctgctccggaacctgatcgaggtccccgcgaacgatcgcctcgaaggactcgatcgtctccgcgatcggcacgtacttccccttgaggccggtgaacacctcggccacgaagaacggctgcgacaggaaccgctggatgcgccgcgcccgggcaacgatgaccttgtcctcctcggagagctcgtcgagcccgaggatggcgatgatgtcctgcagatccttgtagcgctgcaggatctgctggacgctccgagccacctggtagtgccgctcgccgacgatggtcggatcgaggatgttcgacgtcgacgccagcggatccacggcgggatagataccgagtgaggcgatctgacgcgacagctcggtcgtcgcatcgaggaacgtgaacgtcgtgaacggcgccggatcggtgtagtcgtcggccgggacgtagacggcctgcagcgaggtgatggagcggcgcctcgtcgaggtgatccgctcttggagctcacccatctcgtcggcgagcgtgggctggtaaccaaccgccgacggcaagcgcccgagcagggccgacacctcggacccagcctggacgaagcggaagatgttgtcgatgaacagcaggacgtcttgatccttgacgtcgcggaagtactccgccatggtcagcgcagcgagccccacgcgcagacgtacgcccggcggctcgtccatctgcccgtagacgagtgcagccttcgagatgacgcccgactcttgcatctcgaggagcaggtcggtgccctcacgtgtgcgctcccccacgccagcgaacaccgacacgccgccgtgctgctgcgccacacggttgatcatctccatgatgagcaccgtcttgcccacgccggcaccgccgaagagtccgaccttgccaccttggacgtagggctcgagcaggtcgatgaccttgatgcccgtctcgaacatctgggccttcggctccaggtcctcgagcggcggtgccgaccggtgaatctcccacaggtcgtcagcaccctccaacgacggggcgtccaggggttgaccgagcacgttgaacacgtggccgagcaccgcatccccgacgggcacgctcagcccgcgccccagcgcacgcaccggcacgccacggcgcaggccatcggtgggtcgcagacagatgcagcgcacccgtccctcccccagctggcgcgccacctcggcggtgatggtgacggtctcgccgtcgacctcggcgtccatctcgagagcggcgttgatctccggcaaggcgtcgggagggaactccacgtcgaccactggtcccgcgatcgagaccactcggccaaggacatgctcggcgttggtcatagcagctcactttccttcttcagcgcccccgccgtcgcgagagcctcggctccacccacgatctcggcgatctccgtggtgatcgcatcctgccgtgctcggttcatcgctcgtgtcagcgtccgtaccaactcgttggcgttgtcggtggcggtcttcatcgcccgctgccgggcagcgtgctcggcggcggacgcttccagcaagagtccgaagccctccgccacgatgaggtcacgcaggctcacctcggtgagcaccgccagatcggggtcggtctcgacctcagagcgcgactccgtcccgtccaacagatcgtctcgacgcatcggagcgaggtgcgtgacctcggtgcgctgggacccgagcgagtagaagcggttcgaaatgacgtcgatcccaccgatgacaccctcttcgagctgcgcgatcagcggagtgaagagtcggagcgcctgctggtaggtcggctggtgggtgacgtgatcgatctggtgatcgacaccgacaccgcgaaaatgcgcccaggaaccgaacttgcgcccgactcccaccacgacacccacgtcgccaccgcgacgccgccgctcgaaggctcggatcacgttggcgttgtaggctccgcacaggccgcgatcggcggtgaccacgacgacggccacgggaccggaggcctccagcagaggactgcgcaacgctggctgcgccgcgaccagcgttcgtgtggcgtcgctgagttcccgatagtacgtacgcgcctgggcgatgcgccccaccgccttgacgatgcgagaggcggcgatgagctccatcgccttcatgatcttcttggtcgagttcacactgcggatctgtgcccgcagtgctcgctccttgccgcccgccacgcgctaggccccctgatggagtgccttgaaggccttgatcgccatgtcaagccgctcgcggtcgccaaggcgcttcgactcgctgatctcctggagcacctcggggtgctgagcccgcaggtaggcgaggaacgccgcgacgaaggggccgacctcgctggtcggaacgtcatcgacggcaccgctggtgccgacgtaaatggagacgacctggtcctcgagcgacactggctgaccttgaggctgcttgaggatctcggtcaagcgatacccgcgatcgagctgggcctgggcgaccttgtcgagctcggagccgaaggtcgcgaacgcctccaactcgcggaactgcgcgagttccaggcgaagcgagccagcgacctccttcatggccttggtctgcgccgacccgccgacgcgcgagaccgaggcgcccacatcgatcgccgggcgcacgccagagtagaacaggtcggcgtcgaggaagatctggccatcggtgatcgagatcacgttcgtcggaatgtaggccgagatgtcgcccgccttcgtctcgatgatcgggagcgccgtgagcgagccaccaccgagttcgggcgacagccgagccgcgcgctcgagcaaccgggagtggagatagaagatgtcacccgggtaggcctcacgccctggcgggcggcgcagcagcagtgagagctgccgataggcatcggcctgcttggagaggtcgtcgtagacgatgagggcatcgtctcccgactccatccagtgctgaccgatggcacaacccgcatacggggcgaggtacttgaacggcgctggctccgacgctggcgcggagaccacgaccgtgtaggccaacgcaccggctgctcgcagcgtctcgacgacgctcgcaacgctggtgcccttctggccgacggccacgtagatgcacttcacgccctggccacgctgattgatgatggcgtcgagcgcaatggaggtcttgcccgtcttgcgatcgccgatgatcagctcgcgctggccgcgcccgatcggcacgagcgtgtcgatggccttgatgccggtctgcaggggctggttcaccggctgacgcttggtgatgcccggggcctgtacctcgagacgacggctaagactcgcggcgatcggcccgagaccgtcgagcgggcgccccagcggatcgatgaccctgccgagcagctcgtcacccaccggcacggacaggatctctcctgtcgagcgcacgatctgaccctctcggatcccctcctggtcgccgaggatcacggcaccgatggcctcttcgtccaggttcagggcaaggccgaccgtgccgtcctcgaagcggagcatctcgttcaccgcgaccgacggcaagcccgagaccagcgcgatgccgtcgaagagctgcagcacgcgcccgatctcctcgccgccctggtgcggcgcgaactcctccatgcgtcgccggatgaccccagcgacctcttcctcggagatttcgaagtgctccatcaccatttcactcccctacgcgctgacgagacgacgagcgtcgtcgagctgacgtcgaacgctttgatcccagagacgatcgccaacgatcgccacgatgccgccgatgaccgactcgtccaccacccactcgacctccacgcgctggccgacgagccgctcgaggtgcgtacggacggcgtccgcctcatcgtcacgcagcgaacgagccgtgcgaaccgttgcgacccgcaacgagagctgtcgggcggcgagttcgagcagccgatcgacgacccggccgatcggtcgcacggaactcgtcgcgacggccgcacgaaggatccaggtcgtccggacgctcacgcgcggcccaaacagatccccgatgatggcgaggcgtgcttcgcgcgttccctcgaaacccgacagcacgcgctggagtgcccgatcccgttcgagcacctgtgccacaccgcgaagttcgtggagcaccggctcgagctcgtcgcgcgctccgaggtcctcgaagatggcccgcgcatagccgatgacgcgcccgatggtggcaaagtcgccggggccctcgaggaccatgtcggaggcgaccagctcagggagttcctcgagcgaatgcaccacctcgccgacgacctcccacgcgacgacagcgtcgaagagccgcagagcgagcgagctgacgcgctccccgacgaggtcgtggagcactccttgacgacgatcgacgtcggcggctcgatcgtcgagggcgacagcgagctggacgaagcgctcgcacagctcggcgacgccgcgagcgtcgcgttcgagctccgaggccgttccggcctcgcgagcgagatcacgcagggcgagggcgtagcccttcacgagctcacgcatcagtcagcgggctccgcctctcgcaagaaggcctcgatgagcggatcgaacgatgactgctcgagctctcgtgcgacgatcttgccagcgagctcgaccgcgaggtcagcgacctcggaacgcagcgagcgcagcaactggacacgctctgccgccagttgcgcctccacctgcgcacggatcgcctccgcctcggcacgggcccgctcgctcgcctcctgcctgagcgcctccgcggtccggcgagcgtcgtcgaggatgcgacgcgcgtcctcgcgcgccccctggagctctcgttcgcgctcggcccgcagggcctcggcctcgcgtcgcgcagcatcggctgcctccagatcggcacgaatgcgatccgaacgctgcgccatcatccgcgcgaccggcgggtaggccaccttggccaacaccaccaacaagatgacgaacgagatcaccgaccagacgatctcccccgtgctcgggaggatcgggttcggcgactgagtgacaaccgcctcgagcatgcgatcagccggtgtacttgaggagcacgaagacgacgaagccgatgagggcaagcgcctcagcgagcgcgaaaccgatgaacgcgagcgagcggacggctccagcggtctcgggctgacgcgcgatcgcagagaccgcctgcccgaagatgatgccgataccgatgcccggtcccaacgctgccaaaccataggccaagcccgaaccgagttcggcaagacccttgcgcaggttgacgctcgacgctgccgcgatcaccgtggcaacaacgttgtgcattgatcctctctctctccgctgtggtacccccgggttctccacccgagatctcgatcccccgaccgtgacgcacaggcctcggaacccgacgcgccgggggcatgctagtgcccagccacccccatggcctcgccgatgtagaccgccgtcaagatcgtgaagatgaaggcctgcaagaacccgacgaagatctcgtagcccgtcaccacgaccagcatcgcagctggcagcggcagcgcaacgagggcgatcgacttcacgaagagcgcctcggagatcaccgcgaacgtgatgagcagcaggtgacccgcgagcatgttgccgaagagccgcaccgcgagggcgaacggacgcacgagaaaggtcgacaagaactcgatcgggacgagcaggatgagcaggacccccggaacgcctctcggcacgagcgcgctgcggaagtagccagcgaacccctgtcgcttgatcccgaccgcgaggaaggtgacatacgagatcacggcgagcgggatggtgacgctggtgcgagccgtggccggcatctggatgaaggggacgacctcgaacaggttgttgaagaggatgaagaagaacatcccgacgagccagggcagccagctcaagccctcagggcccatcacgtccaacacgatggtcgagcgcacgaaatcgacgcccgcctcgacgacgttctggacgccccgtggcacgagttgggcgcggcggccggcaagcccgaagagcacgagcgtgatcgccgccgatgccagcgtcagcaccgcgatcttgttgaacatgaacgcagtgccggaaaaggcgatcggacgccagttcagcacctcagcgatcgggggaaagctaatggcggcgagcatcaccgaagcaccctccacggacgcagtccgtcgtcaccgatccgcccggacacacgccgcgcttcgaggacgaccgcaacgagatagccggcgatcaccaccgtcgcaaagacaccgaggcgcatccagtgagcatgcaccagggggacggtgatcgcggtcagcagaccgagcccaaggatgagcgaggcaaacgccgccaccatcaagcccccgatgccaaacctcgcgccctcgcgaaacgccacgaccatgatcgcgaaggtcagcgcgacgccggcgagcgcgaacgcggcggtctcgaggccagcgataccatcggcgatgccgccacctgcgagggcaaccggcgcaaccaaggcgagacgggtgagaaacccgagggcgagacgcgtctcgggactggtggtactcatgccctcggacgccccccgaactcgggagcatcgagcgtacgggcggcctcacgcacctcgtcgggtacctcgagcgatgcctcgagcacgcgcccacgaccaggccgctcgggcgcacgagacggtgcggactcgacgacagcggccaccgaccgctcgagtccctcacgcgctcggtagatcaacgagagcaacgagccgacgaccccgaggccgccgatcacgaagccaaggatcacggagtgagacgcgcgcccggcccagaagccgagcaggatcacgatgacgagcgtgccgaaggcctccacgaagtgggccacagcctcactcgcccccgagatcatcgggtgcgcacccgcgcctcgtttcaccgcgtcctctccccacgactggcccactcggccgcgctcatgctagcaggcaacctcggagcggccgccgtcaggaaccctcccgggtacccgagtgacgccgtagatccgggtgcaacaaggtgaacagcagcaccgccgccgccacgaccacgatcgggagctcggccgtcaaggacggaacgaacgacggcaccaacgcaaaggctgacagcacggcggtccaggtccacaagatcgccaccgcccgtcggggcccatgccccatctcgcgcagccgatggtgcaggtgcaagttgtcgggcgtggcgacgctctggtggtgccgtgctcgacggagcaccgcgagcaccatgtcgaccatcggcacgccgaggatcacgaacgggatgacgaggggcgcgaagaagaagaacgtttggtccgagacgttggcggtacgacccccgacgacggacgtcgcggctgcgagcagcaacccgagcagcatggcgcctgcgtcgcccatgaagatccgcgctgggttgaagttccagggcagaaatccgatggccacgccagcggttacgaaggcgacgaccggaccgatcgacgactccggcagctggcccaacgcctggaggtgcaagctgtagatcccaaaggcgatcgacgcgatcgcgacgatgcccgcagcgaggccgtcgagaccgtcgatcaggttgatcgcgttcgtcatggcgaccacccagatggcggtgagcaacggcagcatggacggcgcgagcacgacgatacccgcaaaggggaccttgaaccagaacatcgtgacgccgaagtaccacaggatgctcgcagcgagcacctgggtcgcgaccttggccggcgccgacaggtcgaccacgtcatcgatcgctccgagcacacagatgacggtcgcggcgagcgcgacccccagcggctctgacgagtcgaagaacaccgcgcggaaaccaccgatcatgctcgcggcgccgaaggcgacgagcacgccgaccagcatggcgagaccgccgagggttggcgtcgcacgttcgtggacgtggcggccaccgggttggtcgatcgcgccgactcggagcgcgagcacccgcacgagcggcacggccaaggcggtcacgaccgcgccgatcgcgccgaccagcagatagcgcatcaggacgcgaggccaggcggcacgaaggccgcacagagctcgcgaacctgctggcgaacctcccgaaccacttcgtcggtgcgggcgcgcagcacggtcgcgatcagcgaccccacgcgcttcatctcctcctcacccataccggtcgtggtgagggccgccgtcccgagacgcagccccgaggtgacgaacggggaacgcggatcgaacggaatctgattgcgattgagcgtgatgcccgcggcatccagcaggtcctgggcggtcttgccgtcgagttctggatcgaagtcgcgaagatcgacgaggatcaagtgcacgtcggtgccgccagagacgagacggaaaccctcggcctcgagcgaggccgcgagcgtctgggcgttcgccacgacccgacggccgtagtcgcggaacgacggtgaggcggcctcgcgaaaggcaacggccttggctgcgatggcgtgctcgagcggtccaccctgcagtcctgggaagaccgccttgtcgatggccttggcgacgtcctcatgaccgacgatcgcagcacccctcggtcctcgcagggtcttgtgtgtcgtgaaggtcacgacgtcggcaccgcgctcccccgacgcgagccacaacggattggggtacaccccagccgcgatgagaccggcgacgtgggctgcgtcgaagagcacgcgcgctcccacctcgtccgcgatggctcggatcggggtgacgtcgatgacgcgtgggtacgcggtcgcccccacgacgatgaggcgcggatggtgcgcccgtgcgaggtcggcgagctggtcgagatcgagccactcgcgattcggatcctcctggcggacgccatagccgacgaaacggtagagctggcccgagaagttcacgggcgagccgtgggtcaggtgtccaccttggtcgagccgcatcgccaacaccggatcacccggcgccaagagggcgaggtaggcggccgcattcgcgttcgctccagcgtgcggctgcacgttggcccacggcgcgcgaaagagcgctcgcgcgcgctcgatcgcaagggactccacctcgtcgacgacggcgttacccccgtagtagcggcgaccggggtagccctcggcgtacttgttggtcaacaccgaaccggtcgcctcgagcaccgcagcggaggtgaagttctccgacgcgatcagctggagcgtcgaacgctgccgctcctgctcgcgcacgaggagcgcggcgagttcagggtcctctttgctcagcacgcccatggctcctcccttctcgcctcattgtaggcgtctcgcccgtggagcctcagcgaacctcgaccggctcgccgagcacggcttcgacgtccgatggcgcgaccgcaccctggcggagcacccggacctgcggacccgtcaggtccacgatcgtggacgcgacccggcccgagggacctggagcccacaggacgccagcgagccgaccagcgaccggactgccgtgggcgacgaggtcggcgagcgccgtgtcgacgtccgatggcgtcgccacaccgtgccagttcgccgaggaggcagcgagcggccgaccggtggcgagttcggccagccactcgacgtcggggacccgcagtgcaacgctccggcccgagggattgaccacgtccgcgagcgttggggcgtccaccacggccgagatcggtcccggccagagcgcgccgagggcccggagcctcgaccggcgacgtggctcggcgtaggcgagcgcctcgtcgatcgatccgacgagcaccggcggcggcgtcgtggtcgagcgacccttcaacaccgcgatgcgctcgagcgcgcgtcgactcgtcgcggatccgaccaaccccgggaccgtgtcggtcggcatgaggaggaccgaacctccatcgagaatcgtggccgcgcgtcgaaacgcctcgactccttcgagcgagggctcagccggctgatcgccgaggagttcacgaagccgcacgagtcgctccaggccaccgcgcgacgagcacccggggccggccggcaagatcgcgttccacggtcacatcaccgtagccctgcgcgctcgcctcggccaccaaccgctccccttgtgtctcaccgatctccatgaagagccaccctcccggccgcaaggcgacccgcgcaccaccgatgactgccatcggaccctcgagacccgacgggcccggtacgagtgccacccgaggttcgaacactcgcaccgcagggtcgagacgctcccactcggacgctgcgacgtaggggggattggcgaccacgacgtcgagcgactcaggttctgccccctcgaaccaggagcgacgcacgagcgtgacgagcgcacctgtcgctcgaacgttctcccgcgcgagcgcaagcgcacggggatcgacgtcgctccccgtcacctcgaggcgcggaccttcgagggcaagggagatcgcgatggcacccgagcccgtaccgacgtcgagcacgcgcatcccggtgcgcacggccgcgaggacgtgctcgaccagctgctcggtctcgtagcgcggaatcagcgcacgatggtcgacccggagctcatgacctcggaacgaccacgtgccgagcacgtactgcaggggctcgccggccgcgaggcgggcctcgagacggcgcgcgatgactgcggcgctcgcaccggacgaggcggcgcgtcgcgccaccgcctcgtcgaaccagcgtcgctcagcaggtcgcatctccgcgctcacgcatcgcgcaacgcggcgagctgctcctcgcgctcgtggacgaggagcgcatccgacagctcgtcgaggtcgccctggaggatctggtcgagccgatagagcgtcaggccgatgcgatggtcggtgacgcggttctccttgaagttgtacgtgcggatcttctccgaccgaccccccgagcggatctgcgccttgcgcgtggcggtgagctcggcttgacgcttgtcttgctcgagcttgagcagacgcgcgcgcagcacctggagcgccttggcgcggttctggatctggctcttctcgtcctgcatggcgacgacgatccccgtcggcaggtgcgtgatacgaaccgcagagtccgtggtgttcacggactggccacccggcccggtcgatcgatagacgtcgatgcgcaggtccgacgggtcgatcgacacctcgatctcgtccgcctcgggcagagcggtgacggtggccgaggaggtgtggacacggccctgggtctcggtcaccggcacccgttggacacgatgcggacccgcctcatgcttgagccgcttccaggcgtcatcccctctgaccagcagggtgacgtcgtcgtagcccccgagatccgacacgcttcgcgacaggacctcgaccttccacgaccgtcgatcggcccaacgctcgtacatatcggcgaggtccttggcgaagaggttcgcctcctcgcctccttcggctcccctgatctcgaggatcaccgcgcgaccgtcgttggggtccgacggcaggagcaacagctcgagtgcctcgcgagctcgcgcgagcgcggcatcgatctcatcgagctcggccttgagctcctcacgttcggcggggctcgcgccccgatagagctccctcgccgcgtcgcgatcgccttcgagcgcctgcacccgtcggagggctccgacgatggcctcgagctctttgtgacggcgagcgacctcccgggcgcgtcgctggtcctggaagatcgcaggatccgccagttcctcgagcacccgagcgtactcgtgctcgaaacgctcgtaccgatcctcgctcatggcgtctcctcgataagttcacacggtccaaaggcctcggcgatacgagccccgaggggcgcgctccccgcgacgacgagccgaacgacgctcgaccagtcaccggccagggcacgcgcctcgatggggagccacggatcgaccgctcggccgaacccgacgacggtgccgtccggcgcccacgcccacgctcggcccgccgcctcacgaacgcgatcgggctcgaagggccgcagcggctcctgctcgagccacgtggctcgagagcggcgcgcaatcgcgcgcggcacgctctcgaccccggggcttcgaccatggtggccatcacggagtcgccgggcgagcaggcgcgcctccgccagcagaccctcctcgtccaatccgagctcccgacgcatcgcccagtcgcgcggatcgacaccgacaacacgctcgccgtcggctcgcccaccgatcgtgacaccagccgattcgacgaggaccgcatccggccacgacgtcacgccgaccggcacgacgtcggccacggctcgatacaaggcacggagccacgcatcgcgctcccagtcggcgtcggtcgtgacaggcggtgcccagggctcgacagggacggggcgtcccccaacgagctgctcgagcaccgcgtgcgtccccttgagggccgcagcgacgcgatcgagacgctccgttggcccgagcgtcacgatacggacacgctcaaggtggcgatactcgacccaggccgcaaccgcgccggccgcgcccgtcgtcgtcaccacgacgatctcaccgtctcgacgacgcgcagcgccgtctgcgaacgcgccacgatcggggagctcgacgacgacgccgtcgggagccagcgcgttcgcgacgacaaacgcgagctcagcgtgcctgctggccgcgccgtgctcggtcaccgtagcggcgctggaagcgctcgacgcgaccaccggtgtcgacgagcttctgtcgaccggtgtagaacgggtgacactggttgcacagctcgatgtgcagttccgacttggtcgatcgggtctggaacgtgttgccgcatgagcagtgcacggtcgcgaccacgtactggggatggatcccttccttcacgatgcctccttcacactgatggtggactccgagagcgctgccgaggatgcctgggctgcgctagatgccagggctacgcgcgatctcggcgagaaactccgcattcgagcgcgtcgagcggatcttgtcgatcaagagctcgagacccgcagccggtgtgccctcctggctgatcgcaccgaggactcggcgcagcttccagacctgcgccaactcgtcgcgagtgaagaggagctcctcgtgtcgcgtcgacgaggcgttcacgtcgatcgctgggaacaagcggcgctccgcgaggcgccggtccaggcgcagctccatgttgccggttcccttgaactcctcgaagatgacctcgtccatcttcgagccggtctccacgagcgcggtcgccaggatcgtgagcgagccgccttcttcgacgttacgggcggcaccaaagaacttcttcggaggatagagcgcacccgagtcgacgccaccggacatgatgcgcccgctcgcgggctgggcgaggttgtaggcacgagcgagacgcgtgatgccatcgaggatgatcacgacatcgtgcccgagttcaacgagccgcttcgctcgctcgatcacgagttcggcgacctgggtgtgctcctccgcgggccggtcgaaggtagacgcgatcacctctcccttgaccgagcgtcggatgtcggtcacttcctccggtcgctcgtccacgagcaacacgaagaggacgacctcagggttgttgcgctcgatcgcgtgcgcgatctgcttcatcacggtcgtcttcccggccttcggcggcgagacgatgagtccgcgctgacccttgccgatcggcgcaacgagatccatgatgcgtgtggtgagctcgagcggatcctcggcgttctcgagcaccagccgctcgtccgggaagagcggcgtgagatcctcgaagcgagggcgacggcgagcatcctcgaccgtcatgtcgaagacgcgctcgacgcgcacgagcgccgggaacttctcgttctgggagctcgcccgcgcctgaccgacgatctggtcgcccttgcgcagcccgaacttgcgaacgagcgaggccgggacgtaggtgtcccgcgatgacgtcagacggccattcgctcgcaagaagccataaccctcgtcgcgaagatcgagcacaccgacggcctcgatgagctcttggacctgcggtccttccgcctcggccggccggtcaccgcgatccttgttgcgccgacgacgcgagcgacgactactgccctcgtcgccacgacgagcaacctcaccgcgcacctgctccgatgcttcaggagccccgtcgctctctgcgtgtgcctccgtccgcgctgcggccggactggcctcgccgcgtcctggcgagccatcgctccgttgcacactcgcatccacggcgatcggaggcagcagccgcgcgaggtcgaccgcaaggcgatcggcctccgcgagggtcggctctcgggtcccctcggtcgcgctctcggcttggggccgacgctcgcgtcgccgagtcgacgactgaccccgctctcgcggtccgctcccgacgacgctcagcgcgtcacgagcctgggcatcgtccgcgggcagcggcggaagcaccgcggcggctgcgtcctcgttcgcgaagaggctgcgatccccctcgtcgctcgcggatcggcgtgccatcgacgacgcctcgatcgcctggatgatctccgctttgcgcgatcgggacgaaaccttgacaccgagctcacgcgcgatcgccagcagcgactctcgatcgcggcgtgccagatcaccgagcacgtcggtggaactcaccatggggtagatcccttcttggtcaggaggaacaggcgcagcactggcgcggtcacgccagtccagcagctcgagcaatcgcgtcaagacctgcagacgacggcacgggtccctccacagtgcgcagcgcggtgtccgggtccttcaagccatgccctgtcaggatgcacactaccgtgtctgaccgcgctaggtccagtcggaggaggccagcaaccgaagccgctgaggcgggctcgcagaacaccgactcctctcttgcgagcagtatataggcctcgagaatggcgtcgtccgagaccgcgagcaccgtcccacccgagtccgacgtggcgttcagggcaccttgccacgaagccggacgcccgatccggatcgcgctcgcgatcgtctcgggatgctcgacgacctctccgcgcacgatcggagcagcgccctcggcctggacccccaccatcctgggcagacgcgtcgtcgcacccgcggcatgcgcttcgcggtagccacgccacgacgccgtgatgttgccggcgttgccaacgggcatcacctggaccgtcggtgcatccccgagctggtcgacgatctcgaacgcaaccgtcttttgaccctcgagtcgatccgggttcacggagttgacgagcgcgaccccatcggcctcggccagctgccgcacggccaccagggcatcgtcgaacgacccctcgatcgcgacgacgcgcgcaccatagagcaacgcctgtgccagcttgccccgtgcgatgcctgccgacggcacgacgaccacgctcgccaggcccgccgctcgcgcatacgccgcagctgcggccgaggtattgcccgtggacgcgcagatgaccgccctcgctccgcgagccttcgcgttggtcaccgcgagcgccatcccgcgatccttgaacgaaccggtcggattcaagccctcgagcttcaagaacacgcgtgcgccgacccgctcggacagatgcggtgcgtagcgcaacagcgtccccccttcgccgagcgagaccagctcagccccgtcctcgatcggcaacgcgctccgatacgcctcgaggatgcctggccaccgcagccgtctcacaacgccatcgtcgtgtgccatcgctcgcttcctcacagcacccggtatcgttgccgacgtccgaccacgtcgccgagcgtcaccaactggcgatcgatcgcctccatctgctccagcgtcgcctcgtgcgtcacgagcatgaggtgggcgtggccctccccggctccgagctgctccacctgcgcgatcgacaccccttcctcgccaaacacctcagccacccgcgcaaggacgccagcagcgtcgcgcacgagcagcgagatcgcgaatctgccggtgatcgacccagccgacagcattgtcggctcctctcgagccggtgccgtactgcggcgccccgcccggcggttctgcgcagcctcgaggatgtccgcgagcacggcggccgcagtcggcagcccacccgctcccgggccgatgaagaccagctcaccgaccgcctgaccttcgacgaagatggcgttggcggcgtctcgaacgcccgcaaggggatgctccctcggcacgagcgcaggaaagacctcgacgctcagcgcctcgccatcggcctcgtcgagtcgccgcgccgtggcgaggagcttgatctcagacccgctcgcgtgcgcgaagcgtacgtcggcggcggtgacgccgacgatgccctcggtccgcacgtgatccgcgcgcacgctgcgctcgaacgcgagggatgcgagaatggcggccttcgcggcggcgtcgcgaccgtcgagatctcgactcgggtcggcctcggcatagccgagtcgctccgcctcggccaccgcctccgcgagttctgcgcccgtctcgctcatgcgcgtgagcacgaagttggaggtcccgttgacgatgccttgcaaggaccagagacgctccccgaacagcgacgtgcgcaggactcggatcagtggcaccccacctgcgacggcggcctcgaacagcagatcgacaccgctcgcctcggcgagtcgctcgagcctcccgaggtggtcggcgagaacgtccttgttcgccgtcaccaccgccttacccgccagcaacgcgcgctccagcgccaacagcgccaccttcggctggcccatcagctcgacgacgatgtcgacgctcggatcggtgatggcagcatcgaggtcatcggtgacgagtcccatgggcacccaggcgtcacgtggtcgctggatgtcacgcacgacgatggaggtgagctcgatcggttcaccgaggcgccgctcgagcagcgcagcgtcgcgatcgagcaaccggacgaggctcgagccaacgacgccacacccgagcagcgcgactctcacgagcccacctccagacggaacagatcatcgagctgctcgcgacggacgatctcgcgggcgacgccgtcacgaaccatgaccacgctcggacgcggcaaccggttgtagttcgaccccatcgagtagccgtacgcccccgtgaccggagtcacgatgagctcgccagcagcgaggtcttccggcaacagggcgttggccaccagcacgtctccggactcacagtgcttaccgaccacgcgcatcgccgtcgtgtgcggcgcctcgagtcggccggcggcgacggcctcgtagccagacccgtagagcaccggtcgagggttgtccgacatgcccccgtcgacggccacgtaggtcctcacccccgggatccgcttgaccacgccgacacggtacagcgtgatcgcggcgggagccaccagcgcgcggcccggctcgacgaaggtgcgctccggatccatgccggccagcgttgtcgcctcggcgatggagcgcccccactcctcgagcgtcggtgcccgttcgtcacggacgtagggcacgccaatgccgccaccgaggctgacctcgtcgaccccccaggcttcgcgcaccgcccccatacgcccggcgagctcgccgaagggatcgaggtcgaagatctgtgacccgatatgggcgtggatccccacgaccgtgaggccgtgcgcacgcgcccacgtgagtgctcgctccgcagagccatcgtcgagctgaagcccgaacttggagtcgacctgccccgtgcggacgaaggcgtgggtgtgggcctcgatccccggcacgacgcggagccagagtcgccgacggccgagaccaagacgcgcgatgcgctcgagctcctcgtgggcgtcgacaacgattctgccgaccccaacctcgtcggcgagcaggagctcatcgacgcccttgttattgccatggagtacgatacgctccgcaggcacgccgcctcgacgagccgcctcgagctccccggccgaggcagcgtcccaccagagcccggtgtcggcgacgatgcgggccatcgccaccgcagagaacgccttcgacgcataggtcacctgcagcgcacccagccccgaccgcagctcgtcgatgcgtgctcgtacctcgtcctcgtcgtagacgaacagcggcgtgccgaagcgatcggccagctcgtgcacgctgatgccctggatcgtcagctcgccgctcgcgccgatgcccgccccacgaggccacaggcgcactgggagcgcaccgaggcgctcacccacgcctacatctcctcgaccgcgcggaccccgatcaaggcgagcgtccgcgccagcacctgaccggtgaggtccgcaagtgcaaacctggccccgcgtaccagtgggtcgggctcgaccaggatcgggcagtcgtggtagaagccgtggaacgccgaggccgcctccagcagccaggcgacgacgcgatgcggcgcacgttcgacgatcgcggtctcgagcacacggttgaggcgcaagagcacacgagccagctcgagctcgcgagggtggccgagggcagtgagcgatgcggcggggtcgagagcgagacccatggctgccgcctgtcgacggagcgccgcgaccctcgcatgggcgtactggatgtagtacaccgggttctcgctcgactcggcccgagccttgacgagatcgacctgcgaggcacggtcgatcgacgacgacagcgcgagcaagcgggtcgcatccgccccgagttccttcacgagccatgagagcgcgatcgccgttcccgcacgcttcgagaacttcacggcagcaccgttgtcgaggagcgacaccatctgcccgagccgaatctcgagacgccggtcgtcgatcccgagggcgcgcatcgctgcatgcaggctcgccacctgcccgtggtggtcggcgccgaacacatcgatcgcgaggtcgaatccccgcacgaccagtttgtcgtagtggtaggcgatgtcgcccgcgaggtaggtgtagtcaccgttcgccttgcgcagcacgcgatcacgcgtatcgccgaagcgttcggccgcaaaccagagtgcaccgtcggcctcgtaggtcgcgtcgagagcactcaggcgtgcgacgacctcctcgacgagtccgccaccttcgatcgctgcctgggagtaccacgaatcgaagtggatgttgagctcttcgagggtggctcggatcatggcgaggatctcgggcacagcccagctgcccgccgcgaccacgtcgtcggggccgtcgtagcggcccgagagctcgtggacgtagtcgccgcggtagccctcttcggggatgggctcccctcggcgtgccgcgaggatcgaggcaccgagcgagcggatctggccgccagtgtcgttcacgtagtactcacgcgaaacctcgaaccctccgtgggccaacaagcgtgcaagggcgtcgccgtagatgctgagccaaccgttgccgatgtggagaggaccggtcggattcgccgagacgaactcgacgagcgcccgtgcaccgtgaccgacgtcgacagcgagcgcggccgcaagatcggccgccatcgcctgcacgtcgccgagcagggccgctgggctgagatggatgttcacgaaaccagggccagcgacctcgagacgctcgacacggccagcgacacgcggttcgagacgcgcaacgagtgcctcggcgagcacacgaggtgcgaccccgaccgtgcgcgccagctcgagcgcgataggcgtcgccaagtcgccgtgcgcgcgctcgcgcggctcgacgagtgggccgacctcgaccgcatcagcgatgccgcgagcgcgaagctcctcgtgcaccgccgtcaccagaacctcgtggagccaacccgcggtggtcacctacgtcctttacgctgccaggggcgcttgcccggggatactgccgagccagcctaccggcccgcggcatcggaaccacgaggtcgcccgacgagtacactcgaagcgtcgcagcgtgtggcccccgtagctcaggggatagagcaccggcctccggagccgggtgcgcaggttcgaatcctgccgggggcaccagagcgtcgcgcgtcgacgagcctggtgcctgagcctggcgacttgagcacccgtcgacgacgcgtggttccgacgagggcacgtcccagtgggctcgcatccggtgggctcggtccccgatcgagcgaggccggtactccgttgctaccgagccagcttcgcgaggatcgcctcacgtgcggcctcgcgatcgtccaaccggtagaccgtctggcccacccggaaggtctgctcgtggccgcgccccacgatgagcacgacgtcggactcctcggcgatctcgatcgcgtggccgatcgctccacgccgatcgagttccacgatgatctgcttgtggtccacgtcgagcgtgcctgcgagcagctgcgccacgatctcacctgggtcttcgtcgccaggattgtcggccgtcaagatggcgacgtcggcggtcgctgcggcccgtcccagctcgggacgcttcaggcggtcacgtcggccccgagcccccgcaaccagaatcactcgtcccttcggggagagcgctcgtgcggtcgcaatgagcgctcgcagcgaatccggcgtgtgcgcgtagtcgaccacgaccgtgaacggttgtcccgcgtcgatccgctggaagcgccccgcgacctgatgacactcggccagcccccgctcgatcgtgtcgccctcgatcccgagcgcttctgcgaccgccaccgccgctgccgcgttgtaggcgttgtgaatgccgtagatgggcacacgcagacgccagcgacgccggccgccgacgaccacggtgaagatcgtcccgtactcgtcgtagcgcacgtcctcgacgcgatagtccgaaaacggggctggcccgtaggtcaccgcagggatgcgaacctgggtcgcgagccgcacgccccactcggtgtcggtgccgatcaccgcctgcttggttcgctcgggtaggaagagctgggccttggccgcgtagtactgctcgatggtgccgtgatagtcaaggtgctcgggcgagaggttggtgaagaccccgattcgaaagctcgtgccgtcgatacggtgctggtcgattccgtgcgacgacacctccatcacgacggagtcgactccgtcgtcgaccatctgccggagcaagcgatgcagctcgggcgcctcgggcgtggtgaacatcgacggacggttggagtccccgaagcgcgcctcgatggtgccgatgagtccagttcggcggccggcaaggctcaagatggagtcgatgaagtacgaggtcgtcgtcttgccattggtgccggtgatgccgacgagatcgagccgctccgatggacggccgaagaaccccgcgacgagcccgccgatcgcgtgccgcaccgacggaaccacgagttgcgggatgtcgagtgccacctcgtgctgcacgagcagcgcgacggcgccacgcgcgatcgcatcgctgacgaagtcatgaccatcgaaacgcgatccccgcgtcgcacagaacatcgctccaggcgagaccgaccgtgaatccagcgtgatgtcggcgatcgccaccgaggggtcgcccaccagacgagcgcttggcacgagtccatgcagatcacgcagcgtcagcacaacggcccttgcctcttcctctctgggttcttcagctaggctagcgctccccatggagcgatcaacggccccctctcccacctcgcacccagcgatcaccgtgagcgtcgtcatcgccgcctacaacgccgcggccacgatcaccgacgcgctcgagagcgtgcaccgccagcagtatcccccgatcgagatcatcgtcgtcgacgatggctcgaccgacgacaccatcgcggtcgtcgagcgcagcggccttacgagcgccatcatccgtcaagccaatcaaggcccgtcgcgtgctcgcaacgccggggtccgcgcagcccacggagactggatcgcgttcctcgacgccgacgacgtgtggcatccagccaagctcgccgagcaggtcgcggtcgtcgagcgccacggcgacgcagcgatcgtcgccaccgattgggcgcgggccctcgaccagctcggggtgcctgccgcgagccacctggagtggttcggctaccgcgacctcgtcgtcttgaatcgctttcagacctccaccgtcctcatgcgacgcgctgtgctcgatgcgatcggaggattcgacgcctcgctcgacggcgtcgaagattgggactgctggttacgcggtgcactccacggcccggtggcactccttcacgccccgctcgtcctctaccgcgacagtccgggtggcgtctcgaaggatctccgacgcctgcgcgcaggagcgatcgccgtcatggagcgcgagcgccagcgcggggtgctccatcccgacgacgcacaggaccttctcgcatggcacctcgaacggctcttcgtcgccgaggtcctggttcgcgattggcccggtgcgctcgacgcgctgaaggacgtcctgctcgctccgccccacgctcaccttcgcgctgcgaggggcctcctcggaccgttcctcctcgaacgactcaaccggcggcgcggtcgcgccgcggcgtgatgacgtggtgccacaaccagagtccgagcgccaccaccacgatcgccgccagcacagccgtactggtcaggcttgccgaggtgaggaccgagctgtagttccttccagccacgtaaccgagacccgtgtagagcgctgcccacccgacgccacctaccacgttggccggcagaaagcgacgacgatagggcatctcggccatgcccgcgatgcccggcaccagcacacgaaggacggtcgtgaagcgaccgacgacgacgccgagtgctcccctgcgttggacgaatccaaccgctcggtcacgttgtcgcttcgagagcaggcgctccgggaccttggcaaggagcggctcgccgaaacggcgccccacccagaacccgaccgagtcaccgacgatggcccccagcgcagccagtgatcctgactcccacaccgggaaccggtgctccgcagcgagcaccccgccgagcaccaccgacgtctcgccagggaagatgaacccgagaaagatcgacgactcgagagctggaaagccaaagaccaggaccaagaccagccatgtcggaaccgacagcaaaagccgaatgaataccgccacgccacgcgctccccgagtaggctagatcgggagactaaggagtccgatggtactcgcagacgtgctcggtccgttcgacctgatcgtcgtgttgatcgtagcgctcctcatcttcggcggttcgaagctcccgaaggtcgcacgctcactcggaacagcgacccaagagttcaagcgcggcgcccaggaaggtccgaagcgcacgacgtcggagcccccttcgccagagagtccctccagcgacgacgcaagctcctagcgcggcacgccccaccgcgctgtcgcaccaccatcggtgatgcgtaatcgcctgtgacaggtgtgggtgatgcgaatcggtgctgcgtgacgtcacctcgcacccgtgagcgcgaaggctcgtcggcaccaagacgaggaaccaaagaccggctcagtgccacctgccccggggacggctgcgacgctcggcccgactatcggtacgaccgtgcgagcgctcacgcacgagtctcttcatcgcgcgctccgggcatcgcggctcccgcgcgaagctcccgtcgacacgattcactccggcaccacatgctggcggcgctgcgcgtacgcacggacggagagcgtccggcccgagcacccagctcaccctggttcgatggctcgtgcggacgcacaggcatctgctcgctcgcccaggagtgtccacacggccgagagactctctagggtggcgttctaggaggtggcgatgcgagcagcgttctaccgtcgctttgggtcactcgacgacctcgaggtcggtgagctcgacgaacccaagctcgggcccgactgggtccgcgttcgcgttgaggccgcggccgtcaatcccgtcgattggaagattctcctcggtcgcctagccccgatgatctatgccacgtttccagtcgtacccggttgggatgtcgcgggcacggtcgaggaggtcggacctgccgtcacgcgctttgcacccggcgacccggtcttcggctatgcccgcctcgacttcgtgcacgtcggcacgttcgccgagatcacctgcgtccccgagcgagtcctagcacgccgcgacggcatcgacgcggccaccgcagccgcgatccccctggccggcctcacggcctaccaggccctgaccgaacgactcacagtcgcagcaggcgaacgtctcctggtggcagccggagccggaggcgtgggaagcttcgcaatccagatcgcgcggatcctcggtgctgacgtcctcgcgacggggtcggccgcgagcgccacggcgatcagcgacctcggtgccgagccgatcgatcgcaccgtcgcgctcgcggaggctctcggtgggcggcggatcgacaaggcactcgatctcgtcggtgcagactggtcccgcgaggcgcttgcgatcctcgccgatccttcgcgtctcgcctcggtcgccgacccgagcgtgcgggccctgggagggcactacgtcttcgttcgaccagaccccgacggcctcgacacgctcgccggatgggttcgagagggacgtctcactgttccgatcgccgaacgattcgagctccgcgacgtgcgccaggccttcgagctctccatggggggccacacccgaggcaagatcgtgatcgacgtcgacgcatgaccgtcctgctcgacccgtccgacgtgaccgctcggctgacgcctgccattgccatcgaaggggtgcgcgacgcgctccgggccgcagctcggggcgaacttgccgcccctgcgcgcacagtcgttggcgtgggagacggcgcactcgtcttcacgatcggagcagcgccgtacggctatggctttcgggtctacgatcggttcggctcgacctcggtcgacgaccagctcgtcgcgctctggtcgcgagacggccgactcacggcggttgcccacgggcccgagctcggccgccggcgcaccggagcgatcggcgcgatcgccatcgacgcgttgcgtccaccgggcccgctcaccgtcggcatcgtgggtgcgggacagcaagcgtggcaccagatctgggcccttcgcgcgttgcgccagatccacgaagtgcgtatctttcgccgcaacgcggccgcgcgagccgaatggctcgagcgcttccgccgcctcgtcgaccacgtcgccgaagccgagacagcagaagacgcggcggtcgaggtcgacgtggtgatcttggcgactccctcgacccagccagtggtggatccgagcgcggtgcccaaggacgccctcgtcagctccctggggcccaaggacatcggagcctcggagctgcccgcgctcctcgtcgatcgtgcacgcatgatcgtcacggacgcaccagcccaactcggcccatcctcggttgcgaccgatcgcgcgctcacgccactctggtcgctcatcgaggatcctccgcgcaggcgcgaaggatccgtcttcctttcggcggggctcggagggaccgaggtcgccgtcctcgcgcgcgctctcgacgctcgcgccggctgacttttcggccacccaacccgcccacggcgcacctccgtgcgaccgggagggagggagcgacgacagaacaacgacccttggcgcgccgccccactccggccattacgggctcggtaccttctcgcgacctcagcgcgaccgcgccgagccaaccgcacccggagccctaccatgccctcgatcgatggtcggccacctcccgcgaccctgctccgagacgagggagcggcggggctcgtgtgccccgccgctccaagccacactgcccgccgcgctactcgcgcgtacgggccatcccggcgttctccggctccgaccaggaggcgcgcttcgactcttgggtcgccccgtacgctgcaccgagcacgaagccgatcccgatcatcaccaaccagactccgtacacgaagcccagcgcgaccaaccagacgccagcgcccagtacgaacgggaagatcgtgtgctcggggaactgtccgatcacgccggagatgtcagctggctccacgacggacacgtcctcggggcgcggcttcatccgcctggaccaccagccgatgtagagacctggcaacagcccaagtccggccgaggccagcagcagcacggaaccggtcgactcgtggctccagaagaagtacacgagcaagatgacgacgaagaacgaacctaccccgaggtagacccgcgactcattccgcactctcgtcacctcccgtcacgaccggcactgcatcagagtgctccgggtggttcatgtcccacaccgggcgcgtcgagcgcaccggcggcagcgaatggaagttgtgcgctggcggcggcgacgaggtcgcccactcgagcgtatgaccatcccacgggttgtcaccggccggtaccgggtgacgccacgaccagtagaggttgacgatcagcatcgccatgccgataccgaggacgtacgcacccaccgtcgacacacggttcaagaatgtgaagttgggggagtacacgcccacccaccgcggcatcccgcgaaggccaagcaggtattgaggcatgtaggtgatccagaagccgatgaagctgatccagaagtgcgccttgccgatcccctcgtgcaagagccgcccggtgaacttgggataccagtagtagaaccccgccaacatcgcgaacaccgtcgtcccgatgagcacctggtggaagtgtgcgaccacgaagtaggtgtcgtgcgtgtagaagtcgatcggaggcgacgccaacatgacgccggtgatgccccccatgacgaacgccgcgatgaatcccaccgcaaagagcatcgaggtgttgaacttcacctgcccaccccacatcgtcgcgatccacgtgaagaccttgatgccggtggggaccgcgatcagcagcgagagtgccgagaagaacggcaacaggaccgtgcccgtggtgaacatgtggtgagcccacaccccggtcgacagacccgcgatcgcaagggtagcgaagaccatccccttgtagccgaagatcggcttgcgcgagaacaccgggaccacctctgagatcatgccgaagaacggcagggcgaggatgtagacctcggggtgcccgaagaaccagaacaggttctgccacatgacgggcacaccaccgccggacacggtgaagaagtgcgccccgaagtgtcgatccgcgtacagcatcacgagcgccgccgtcaagacagggaaggcgatcaggatcaggatccccgtgatgagcatcgaccagacaaagagcggcatgcgaaacatggtcatgccaggcgcacgcagatagaagatggtggtcaccaggttcaccgcgctgaagatgcccgagaagcccaccatcgcaacggatgcgatccacaggtcagccccgggtcccggcgagtaggtcgccgtcgacagtggggtgtagccggtccaaccaaaggcggccgcaccactcgccgtcaagaacccgaacagcatggtggtgcccccgaacaggtagaaccagtacgagaggctgttcaaccgcgggaaggccatgtccggagcgccgatcatgatcggcaccaggtagttggcgaacccagcgaacgcgatcgggcccgcaaacagatagagcatgatcgacccatggatggtgaccagagcgttgtacgtctggagcgacacgacatggccgttcgggttgaacagctgcgtgcgcatgagttcagccatcaatcccgcgatgaagaagaacaccagcgcggtgtacatgtagttcttgccgatcaccttgtgatcgacggaggtgacccaccggtagaacccccccggctcccgatgttccccctgctccaccggctgctctgctccgaggagcagctccggctcgtgcagcgtcgtcatgcgctggccctcccttgctgctgatgaatccaggtcatgaactggctcgcggacacgaccttcacgtagaagagcatgtcagcgtggtacaagccgcacaggtgcgagcaacggcccacgaaactcgcatcgtgctgcggggtgaaatcgaagtagttgacgacaccagggagcgcgtaccgcgagaagtcgaagttcggaaggtcgaacccgtgcacgacgtcgttcgacaccagccggaacgtcgacgtctcgccgacgggcagcaccaacgtcgggtatcccgtcggcccctgggtgatctcggtgacgtggtagctcggatagacgaacttccagccccactggaacgccgtcacatcgacgcgcagcgccggtttcttcgcgacagcatcgaccttgttctccactcgaaccgtgaagaagaacagcaccgcgacgatcaggatcggcaccgcggtgtagaagatctcgagcggcgtgttgccgtggacctgcttcggaatcgcgtcgccccggcggcgaaaccggatgatcgcgtagatgagcaaggcaaacgtgatgccgcccacgaagatcgaagcgacgaagaacccctgccagaggtggaacgtcgcgttcccttgaactgtgttccccgtgtaggccccaaacgtcggtagcttgcaggccgcaagcaccgtcccagcagcagccacgaccgcaggtccgcggagtcgtcgacgccaccgtcgacgattggtgatgctccgcctcgacatctcagtcacgtggaacctccagaatccccggtcgcccatgaccattgccgttaccgctgcccgccgattcggactcgtcgtcctcgtgtgcatgtccgttcgactgcggctgcgtcgccgccatcgcctgctcctcagggagcgtctcgaacgcttcttcatgaccgttgtgcacctggagctcgacgaaggcgaacgcaccatcgtcggtacgacggatctcgaccggaaccttcggctcaccaatgtgctccttgtgcccgacctcgcgcgtcagcaggtacgtcgcggtaccggcgagcaccggcatcgcgatcaagagcacgcgcatcgtccacagcaccaagttgagcgaggtatcgaagaagttcgcgagcacgtcggtcgcactggcgaagaagagcacgatgtagaacatcagcacgcccacaccgatggaggtccgcaccgggtgctcacgcggacgatcgcagatgttgtgctcctcgttgtctcgcgtgaaccgacgctcaatggccggccaggcgtacaagagcccaaaggtgatgccaggcaagagcaccgccgggaagaacacgttcgggatcatgtgtccgccataggttgggccgaagaccacctcccagctcggcatcagccgcagcgcgccgtccaaccagcccatgtaccagtctggctgcaccgcatagctcaccttgtaggggatgtaagggccatacagccagatcgggttgatctgcaccagaccaccgagcgccgcgagcaccgccgccgtgatgaagaagaaaccaccggcctgcagtgcgtacgctggccagaacgcgatgccgaccacgttgcgattggttcggccccgccctgggtactgcgtgtgcttctggtgccacatgatcgcaaggtgcgctccgatcaagcccgcgatcgcagccggaaggatcagcacgtggatgatgaagaagcgcgggatgatcgcggttcccggatagttcccaccgaagacgaagaaggcgagatagctcccgaccaccgggatcgagagcaggatcgagaacgcgatgcggatgcccgtgccggagatcaggtcatcgggcagcgagtagccgatgaacccgttgatgatcgacagcacgagcagggtcaatccgatggtccagttgatctcgcgtggcttgcggtaggccccggtgaagaagatgcgcaacaggtgcacgacgatggccgcgatgaagacatcagccgcccagtggtggatctggcgcatgacgaggcccgcgcggacgttgaacgagatgttcagcgtcgacgcgtaggcctctgacatccgctggccgcgcagcggagcgtacgagccgtggtagatcacctgctgggtggacgggacgtagaacagggtgaggaacacgcccgtgaagatcaggactacgaacgagtagagggcgatctcccccagcatgaacgaccagtgatccggaaagatcttgttcagcgagttgcggacgaaccgtgccgagccaaagcggtcgtcgatctcgtccgccgcttgcagcgctcgttcctccaacgtactcatgcgccacgctcccagaacccaggaccgacgggctcgtcgaacccggcctgcgcccgaaggacaccctcgctgtcgatgtagagcggcagctgtgggaggggtcgcggcgcgggcccgaagacgttggtagccccggtcaagacgtcgaacaagctctggtggcacggacagaggagctgctgggtgagttcctggtagagacccaccgggcaccctgcgtgcgtgcacaccttcgagaacgcgagatacccctgtggcccccacgtctcacggcccggccgcgtgacgaggtcggttgtcgctggacgaaccagcacaacctgatcgatcgcgttcatcggggagttctcccaaccctcggggaacaccgtcagcatcccgccgacctcgaggtcgttcaccgtgacgacacgaccactggccgtcacaagccgtgaacctgccttccagtcggtgaggaacagggacttcccggggacggggccgagagagcgaaggaacgggaagaggttgatcaacccgaaggctccaaccgacgcaccgagcagcctcaacaagaacgagcgtcgctgcacctggttgagtcctcggctcagcgatgcatgcatcgcctcgcgctcgacgtcgtccgagcgaagctcgtgacgctcctgcacgtagggaccctggggcacgaggtacttgccccacgcgacgataccaacgccgatgccaccgagcgccacgaacagcaacgcgccttcgacctgtggctgtccaccgagccagtaggtcacgcccaagccgatagtggcgagcaccgacaagctgaacgagatggcgatcagccgctcgacgaacggccgacgctctggcgtctcctctgtcgaggaggttggaccagtcctcgagacggtcatcgaggagccctcccgccgatccaatagccagcgaccatcaaccctcccaaaccgaacacgatcgcaacgagtccctccgtgaccggcccgacatgaccaagacccgcgccgccgcgatcattcggcgcgtggaggtactcgacgtagcgaaccacgtcggcgacctcctggttcgacagcgtgccggggccgaaccgtggcatgttgccagggccggttcgaatcgcctcggcaacttgcgtcggggtggccggatagagcgacggggcgaacacgttgttcgcgagggcatcgcccacacccgtgatcgtgtgacaggcggcacaatcctccgagaagaggaactcacctcgggatatgttggccgccttcagattgacgctcggaatgccaggaccccccggcgccaacgacacgatgtacgaggcgatcgcctcggcctgctggttggtgaggcggggcggcttctcgatcgcctgcgtcgtcggatcggcgagcggcatgcggccggtcgtgatccagaagtccaccgtggcggctccgaggccctgcaagttcggcgcacgcgtcgacccttgcgcgtccacaccgtggcacgtctcacagtcctcagcgaagagcgcttgcccctcgggaatcagacgcttcggagggttcacgtacacgatcggtgaaccacccgacgagccgccggagttcggtgcctgcgccagtgccgtcgacggggccgccaccatggccacggcagcgagcgtgccaaggccggcgacaccagcgatcgccgacagcacgcgcggtcgtcgcagcgaacccttgctcaaccaacccaccgagttcactcccttcctcggacgcacctagtgcaccaggaacaggcacgcaaagagcgcgacccacaccacatcgacgaagtgccagtagtacgacagcgcctggaacccagggagatgtcgacgtccccccttgacgcctcgcaggcgcagcagcaagaacaacatggcgacgaggcccacgatcacgtgcagtccgtggatccccgacatcacgtagaacagcgacccgtaggcattggtctgcggaccgaaggtcaaggtggcccactccaccgcctggttcgcgatgaaggacccacccatgacgaaggtgagcgccacccaccacatcgccgcacggggccgatcgtgctccgcctcgaacaaggccttctgcatggtgacgctcgacagcagcaagatcgtggtgaagatcgccgactgcaccgtgtcgaggtgcgtgcccgcgggtggccacggcgagccgacgtgtgctcggatcgtgaagtaggcggcgaagaggccactgaagaacatcagctcggatccgagccacaccatcgtgcccacaccgagcaacgacggtttcgagaacctgatcggctcccgccgtggcgcgccagctagcgtcgcctcgaccatgaacgcaccctccagcccactcaagcctcacccatctgcgagtgcctcgtggagccaggagggagccgacgctgctgcacacagcacgacgtgctgcgtcgctcgcgtcaacgcgacgtagatcgaccgctctcccgtcggtcccttcgcaagggccgccgcatcgagcacgactaccgcgtcgaactccatcccccgaatcccaggcacatccgtcactctgatcgtatcgaggtcgccgagtcgagacaaaatcgagccgataccccccactgtgttctcggcgacggaggggtcgaggacgagtgcgacggagtgcacctcgttcgcgagcgtccgcacgcgagcgagcgcgaactcgaccacgttctcgccaagatcgtcgatcagctccacggccccaggggtccgacggagcacgacctcggcaccttggtcatcgccgaggatgcgctcacggaggcgagcgaccgctcgtccgatacgcgcaggcgagcgatagttcacgcgcagctgctcgatcgacacatccttcaggcgcagctgctcgatgacggcgctccacggctggaccccccacggggccagcgactgcgcccggtctccgacgagtgtgatcgatgagcccgacagccgccggcgtatggctcgagcggccatcgggctcacatcttgggcctcgtcgaccacgacgtgtccgaagacccgcccctcgtgggtgccgagcaggctgtcgagctcgtcgagcagcggcacgtcctcgacctcccacacgtgccgagagggatcctcccccggctcgagcgcaaggagagcagcctcgtcggcactcaagacgccacgcgtggccgatgccagcagagctggacgcgcgcgcatgtcatagagcacctcctcggcgctcagacggggccacagccgtgccatcacccgctggaaggcctcgagatggcggatctcctggcgcacttcgcgcacgatgtcctcgtccgagtcatccgggaagcggggaggccaatctgccccaggaccgaacagcgccacgactcggtcgtcaccaccccacgcctccctgatcagcggcccgccttggaggaccgcgtgtgcgagcgcgtcgaggagcgcatcttcgaccgagcgacgccgctggttgtggcccccgcgcacggatcgagtcgcagcgatcgcgcgacgtgagagctcgggcgtcacggtcagcacacgagatccgaacgggatctcgatacgatggcggagcggacgctcacgatcgcgaaccgccctggccagaaccttcaccatgcgcgggcttcctcgcagtgcgcgcgattcgggcgtcgagtccgtatcgccaacaagcgtccccggtcgcagtgatgccaatgaccgcagctcgaccccactctcgccgagcgaaggcaagacgtcgcgcacgtagagcacgaacccaggggtcggtccgaccacgagcagcccctggtgttcgagccgccaccgataggtgtagagcaggtacgccgctcgatgcagcgcgacggcggtcttgccggtgcctggcgagccttccaccaagagcgcgtggccaagaggtcgtcgaatgagttcgtcctggtcggcttggatcgtagcgacgatgtcgaccatctgagctccgcgcggtcgctcgagcgctgcgtagagcgcggtcggtccggcagtcacatcctcgctgccacgccccgacaacacctcgagctcgagccgacgcagctcgccgtgttccaccgcgaggtgccaccgacgctccacgcccatcggcacctgtgccgtcgctcggtagaacggttcggcgaccggagcgcgccagtcgacgacgagtggatcgccgtgctcgtccgacagggagacccgtccaatgtggaaccgctcctcgtcgtcgcggtcgagtcgtccgaagaccaaggcgtggtcaccaagttcgagggcctcgagtcgacgcagcgcattctccacgaagacgtctcgctcgagccgagcctggtgcgtaccaccacgctcctgggcgagcgcctcttcgagcgagcgctcgacccctccccgaaccgcgccaagccgccgataggccagctcgacgaagcgccgctcctcttcgaacgcctcgtcgaccacgcggccccaccctcctagactcgggagcacttcagtctatggcctcacccgtgcactcacctgagccagcgctcctcgcggcgcttgcccgtcggcccggtcaccacgttcccgtttggttcatgcgccaggctggtcgctccctccccgagtaccgcgcagtgcgcggcgtggagtccatcctcacggtcctcgaggatcccgaactggccgcgacgatcaccctgcagcccgtcgagcgctaccacgtcgatgcggccattctgtacagcgacatcatggcaccgctcgccgcagcaggggtcggggtggacatcgtgccgggcctaggtccgacgttcgacccgccgatccgtgcacgcagcgaccttgcacgtctcgaccggttccaccccgaagcgctcgaggccatggcgtcaacggtccggctcgtcaccgccgcctcccccgtgccgctgatcgggttcgccggcggacccttcaccgtggcgagctacctcatcgaaggtcgcccctcgcgtgactacagcgccacaaagcggctgatgctcgccgatgccggcctgttcgccgccctcctcgagcgcctgaccgacatcgctgcggccagtatcgccgtccaagtcgaggcgggcgcaagtgcggtccagatcttcgactcctgggccggagccctgtccggaccagcctttcgggaccacgtcgcccgccacctccggcgcctcgcagccgtcatcggcgagctcggcgttccgtccatctacttctcggtcggcacggcgcacctcgaggccgacatctgcgaactcggcttcgacgccgtcgggatcgactggcgcgttgacctcgaagggttcgcgactcgccacgggagccggctcgcactccaggggaacctcgaccccgcatatgtcttggcccccgtcgatgtcgtcctcgccgaggcacgagcggtcctcaccgcctcggctcccgcgcctggctatgtcttcaatctcggccatggcgtcctgcccgaatccgatcccgacgttctcgcccgcgtcgtcgacctcgtgcacgacgagggcacccggctgcggacgaacgcgctggaggcgacttcgtgaacgtcatcgtcgtcgggggaggcatcagcggacttgcggctgcatgggaggcggcgcgccacggtgcatccgtcatgctcctcgagtcctccgaccggctcgggggcaagctcctgacctcacacgtcggcggctcgctcgtcgaactcggccctgattcgctcctcactcgcacaccgagtgccctcgaactcgtcgactcgctcggactcgacctcgtggctcccacagccagccgagctctgctctggtcgcgaggtgcgcgccgccccatccctccaggcctcgtgctcggcgcaccaccgaacctcgaacgtgcgctcagctcggatctcgtcggtcccatcactcgccttcgcgccgcgtggggtgtgatcgcgcgatcccggcgtggccacgagaccgacgacctcggtcgactcgcagcgtggcgttgggggcgaacctggagcgaacgacacatcgagccactcgtcgggggaatcaacgccaacaccatcgtgggcctgagcgcccgggtgagcgcacccagcatcctctcgatgccgcccagcggcccaccagcaccagccccctcccgaccgacgcgccctgcgttcgtcgccccttctggaggcctctccaccctcgtggacgccgtagcgcaggtcctcgtggacctcggcgtcgatgtgcgctcctccacctcggtcaccgaactcgctccggcccctcacggcaccgccgtcaccacctccgacggcagctcgttcagcgctgatgccgtcgtcctcgctgtaccggccttccgtgcggccgagatccttgcggcctcagcgcccgaagccagcctcctgcttcgcgggattcgctacgcatccgtcagcgtcctggccctctcgatcgcgccgacgctcgcgccgtcgctcaagggcgtcgcgggggtgctcgtcgaccgacgcgagggtctcatgaccaccgccgtctcgctggcgtccgagaagtggccgcactgggcaggggacgacgcgttgctccgcgtgtcggcgggcaacctccacgacgtgcgcccgctcgatcgggacgacgatcgcctgcgcgacgatctcgtcgccgaggccgagggcatcctcgaggcgaccctcgagatccgcgatgcccgactcgcgagatggacgaacgccttccctcacttcgcgccgtggcatctcgatctcgtggagcgaatcgatcgcgaactgcgcgacgcactgggctcgaccgtggcgctcgccggcgcgtggcgtcgcgggagcggcatcccgacgtgcatcgcgagcggacgcgacgctgctcgagcgacgatcagccgagacaactgaccgcgccgtcaggcctccgaccgctcggccaccccggccgcatcaaaggtcgccatctccgcgaggatgcgcgccgcggaccgcaccagcgggatcgccagcgccgcacccgagccctcaccgagacgcaaatccagatcgagcaggggacgcagaccgagatgctcgagtgccgccgttgcgccgggttcgaccgatcgatgcccggcgatcacaaagtcagccgccacgggatcaatccctgccgcgaccagcgtgccagcgagcgagatcaccccatcgaccaccaccgggatccgcacatccatcgcgccgagcactacgccagcgatgactgcgatctcgccaccgccgagctccgccaagacgctcatgggatccgtgggcgggccggatcgtgcgagggaccgctcgatgacctcgatcttgcgagccagttgcgcatcgtcgatgccggttccacgacccgtgaccgcagcgggtggcctgcccgtcagcgccgcgatcaccgcagcgctcggcgtcgtgttgccgatgcccatgtcgccggtggcaaccaggtcgatgccgtaggcgtgcaggctcgacaccagcgcgcggccagcctcgaccagtgcgcgagcgtcatcgagatcgagtgcggcttcttgggcgatgttgcccgtcacgcgccgtcgtgcgacgtcgaggagagctgggtggcgctccagctccgtcgcaacaccagcatccaccaccaccaccgacgcgccgacctcgcgcgccagcacgctgatggcagcgcctccagcgaggaagttcgcgaccatctgcgccgtgacgtccctcggccagggggtcacgccctcgtcgacgacgccatgatcgcacgccgcgacgacgatagcaggacggcgcggcaccggcggggggtcgaccccagcgatgccggcaagctgggcgccgaggtcttcgagcacgccgagtgagcctgccggcttggtcagacgaaggtgatgcgccctcgccgcagcctcagcgcgttcgtcgcgccccttggctgcggatcgcgtggcgtccaccccacgatcggtcggcgcgcgcatcaagcgacagggtccgggacccggggagtcccaaacatgaaccggctgaagatcacgtacttgccgacccacacgacgccgaaggcgacgagtgatgcgaggttgatgagcacggcatcggtcaggtgaccaacgtgggccgccgaggcgcgagcctgcgtccacgcgacggtctcgatcgaaacccacagcccgatgaaggccagtgcccagaacgggatgacctccttcaggaggtgtgagcgtcccgacttgccccaagcccagcgacggttgaggtagtacgaagggatggccgcaacggccgtcgcgaccacgttggaggtcacggcggaaaacacgcgcatcacaccaaagagcaagaacaggatcgcctgagtaatcagcacggaaatgaccgaggtcacggcgtacttgaccgacgccggaccaaaccgagcggtgatcgcgtcattgaggtggagtacgagggagcgcacgcggctagcctaccatcgagtagcccgtcgtcggcgacgcgtgatcgtacatcgatcgcatcgaagggatcgttcatgagcgaggctttggaagcggtccttgacctgctcgatctcgagccgatcgaggtcaatatctttcgtggacagagcccgaaggaggaccgacagcgcgtcttcggcggtcaggttgctgcacaggcactcgtcgcggctggtcgcacagtcgagcgtgatcgaagggtccattccctccacgcctatttcattcggcccggagatccgaacacaccgatcctctacgaggtcgagcgcattcgcgatggtgggagcttctcgacacgccgagccatcgccatccagcacggtcgtgccatcttcgccctttccgcgtcgttccaggtccccgaagagggcctcgagcaccagctctcgatgccagaggtacctgatcccagcgccgtcgggacgctggagcagcagctcgagccgtggtcctcgcaggtacgggaatggctcgaccggccgcggcccttcgacattcgcttcgtcacgttgccgccactcgcccgagccgaggggtcccgcgagccagtccaacggatctggctccgtgccgacgggaacgtccccgacgaccccttgctgcacgcgtgcctgttcgcctacgcctccgacatgacgctgctcgataccgccctcatcccgcacgggttgacctggttcgacggcaccatcttcggtgcctcgctcgaccacgcgatgtggtttcatcgcgagggccgcgccgaccagtggttcctctacgacaccgtgagccctacctcccagcagggccgaggattggccgaaggcgccatgtacgaccaagccggccggcggctccttaccgtcatacaagaggggctgatccgtcgggtgcgctgaagcggtctgccgcgcgcacccgacgccgatgtcagcgctgctcgaccggaacgtagtcgcgcttcggagcgccgatgtagcgctggcgagggcgcacgatcttggcgtcttgatcgagcagttcgttccagtgtgcaagccaccccgacatacgagggatcgcaaacagcaccgggaacatctccacggggaaacccatggcttggtagatcaggcccgagtagaagtccacgttcggatagagcttgcgcgagatgaagtactcatcggagagcgcgacctcctcgagcttcagggcgatatcgaggagtgggttcttccccgtgacctcgaacacgtcgtaggcgacttccttgatgatgcgcgcgcgaggatcgtaattcttgtacacccgatgcccgaagccctggaggatgccatggccacgcttgatggattcgacgaacgcgggcacattgtcgatcgagccgatctccgtcagcatgcgtacgacggcctcgttggcgccgccatgccgcggaccatagagcgccgcgcaggccgctgccgcggatgagtaggggtcagagtgcgctgagcccgtgacgcgcatcgccgtggtcgagcagttctgctcgtggtcggcgtggaggatgaacagcacgtcgatcgctcgaatgagacgcggatctgcctcgtagcgaggctcggcgatcttccacatcatcgacaggaagttcgccgggaacgacagcgagttgtccggatagacgaacggcatcccttgcgagaatcgataggcagccgcagcgagggttggcatcttggcgatcagacgaatgatctgtcgatgtctggcatcgggatcgaagatgtccttggcgtccaggtagaacgtcgagagcgcggcgaccgccgagaccaagatgcccatggggtgggcgtcgtagtggaatccctcgaggaagcgcttgcgaacgttctcgtggatgaaggtgtggtgcgtgatctcgtcgacccacgtctcgagctcgctcgcggtcggcaattcgccgtggagcagcaggtacgccacctccagataggtcgagcgttcggcgagctgctcgatcggatagccccgatagcgcagaatccccgcctcgccatcgaggtacgtgatcgcgctctcggccatcgcggtcgataccagtgcgggatcgaggaaccagatgcccggcagcgccttgctccaatcggccgccgaaaccgtaccgtccacgatggggatctcgacggacacgccggtgcggttgtccgtgatggtgatcgactcaggcattgcgacccaccttcctactcagtcgaaactgaagggtcggacgccaccgattcggtgacactccgaccccccaaccgataacggtacacagcggtgtcgcgctccacaaacccgaccgaccgatagagcgcatgcgcagccacccgcgtgggccgcgacgtcaggtccacggtggtcgccccggcctcctcggccagtgcgagcgctctggtcacgagcgcgcgtcctaccccgtggccacgtcctcgctcgtcgaccacgacgtcctcgatgatcgcccgcagtccggtcgggatcggtaccagcacgagcgtggtcataccgacgacgtcctcgccagcccacgcaaggaggagacgcgtcgcctctgaggacacgacccgttcgagatcggcctcggtcaacggtgcagccgtggtcgacagctgtcgaacgaggtggttgaccacggcgagcatgccgggctcgacggtggtggcctcgcgaaccacgacggccgatggcgacgcgatcatcgccgccagcctaggagcgccgacgcgatccctcgaaccgcgaggatgaggacgactagcatgggagtcaatggtggagttcgcctggcaccgccgcgttcgtcagcgccgcaggccagcggcgctcatcttggcgttgtccggttggaccgacgctggcgaagctgcgtccaccgcagcgtccacactcgaacgactcgcggggctcgtcccctacgctcacgtcgaccccgacgagctctacgacttcactgcggtgcgtccgctcgtcgagatcgacgagcgtggggtgcacggcatccaatgggggaccctcgtcctccggggcccggctcgccaacgcggtcccgcgatcttctccctggccggaccggagccgcaactgcgatggaaggcgctcgccagccagattgccgaggttgcacaaggactcgcgatccagcacgtggtcacgcttggagcgttgctcgcgggcactccacacacgcgcccagttgcgctcgtgggattctcgactcgtccggaacttgcacgcaagctcgatctgctgccctcgcactacgaaggtccgaccggattcttgagtgttgcccagggcgtgctgcaaagttcgggggtcgacgtgacctcgatctgggcggaagtccctcactacctggcacagtttccggcctatccggcggccctcgcgctggcgcaagccaccaccaccgcgctcgacctggatctcgatcccacgccggagctcgacctcctcatcgcgcggacggcggccgaaatcgaccagtacgtcagcgacgatccagaactcgtctcctacgtcggatcgcttgagcactcctacgagatcgatcaacgaacgcgccgatcggccgagcggatctcctgggaggcacaacagtacctccgtcgtttcaacgcggagtgacgccgtcgacgcgtccgggccgaggcggatcgaagtaggcggcccacgcgcgggtcagcggttcgtctcgatgaaaggcgcgctcgagccacgggagccgcatcagcgcagccacgttctcggggagctcctcacgttcgaaccaccgcaccgcacgcacctcgagcggatgcgcccgaagcgtcccgccgaccggacgacacaagaagatggtcgaatacatcgcgaccctggtgaagccacgccgcaggccgtcgatctgaccgaggatcgcctcgggcacgacctcgatgccggtctcctcgaagacctccttcacgacgacttcggccgcggagtagccgacgtcggcccaacccgtcggatagagccacacacccgagtcggctcgctggatgagcagcatgcggttcgagtcgtcgacgacgaccgccccgaccgcacacttgggcgtgacgtagccggcgacaccctcggcgactcccctgatgagcgcaccgacggtctcgtcctcgggctccccgataggggcttccgcgttgcggagtctcaccacgactcgcaagatctcctcgtagcgctcgcgctcgtacccagaactcgtgaacgcgagtcccgtccgcgcaatgctctcgatctcgaggagcgccacctcgagatcgcgtcgctcaagctccatgagggcacccctctgtccgcgcacggtcactcgtcacatcccatgctacgctcgagccgtggccgcgcaggtgacctgcaagcactacctcgtcaaaacgctcccgagcggagaccgcctcgagcgatgccgagtcgacgccgcgcgcacactgcccttcgactgccctgacggctgcctcttctacgagccgcgtgctcgtatctcgcggctcgggtgggtcgatccgcgaagcggagactagagccacccgctcgatcaccgacgatctccatcaccgacgatccggcagctcgaccgcggctgcgttcgccgtgccccgggcaccgcgcaggacgaaccggcagccccacgcgccagccgcgaggtcgctcagctcagacgtgcgtccttcgacacgacacccagcgactcggccttcgctcgaccccactgcacctgaatcgcggcgaggtctggcgaaatgtcgaccgcgctgcgcggcaggaggccgcggcgctcgagtcgctcgacgttcggtcgctcgacgtgggctcgcaccgactcgagcacgagacgacgcaccaagccgatgggcggctcggcctgctcctcgacgggtgcgccgagcagggcggtcagctcgttcgccacgtgctcctcgagtgcatccagccacgtcaactcacactcgccctcacgcgcgagctcgttgccgaggcgcaccatgaaggccgggagtgcgtcgagcaacgcctcgagataggcagcgctcgcgcgagcaaacggaagagcatcagccttgtggtccatcgcgatcagctctcgaccacgtcgccgaccagctcgacgtcgacaccgacaccgcggagccactcgatcgcctgctccaaattgtcggggttcccttcgagctcacagacgatccagccactgtcgtcttccacgttcgcccgtcgaatgttcgcgatgacaccgtgatccctcgccaacgtggcgatcacgggttcgttgatcagctcgccctcgtaccagagcttcgccttgaaccgagccatcccgcctcctccgaacctaccggacccaccgagtgctgacgcccacgaaggtcggcgagatcgagcgtagtgtacgtgaagccaaggcgcgagccgagctcggtgagctcctcggcgtgcgccaacaccgccgctgcgagcgctcgtggcacctggatccgcgccgtatcgccatggtggcgcacacgtacatcgacgataccgaggcggtgcaacgcggcttcgaaacgctccacctggctcagacgacgaggcgtcaccggcgtccctgtcgggatgcgcgacgcgaggcaggcggcagccggcttgtccgcgagccagtcgacaccgagctccctcgcaaggctacgaatggatgccttgttgacgccgagctccaagaacggcgcgcgcaccccagcctcctcggcagcgagcatgcctgggcgccagtcgccgagatcgtccacgtgcgcacccgtcaccatgacggcacggcgctcctcggctaccggcccagccgctcggaacaggtgggtcttacagacgtagcaccgcatccggtcgttgcgaacgtaggcggggtcctcgccctcgtgtgtcgcgacctcgacatgacagatgccgttctccaagaccagccgggcgatggcgtcgcgctcgtcggcggcgagcgaggccgaccggccggtgacggcaacggcttgatcgccaatcgcgcgggtgccggccaccgcgagcactccggagtccacgcctcccgagagcagaaccacgacccgttcctgccgctcgaaccacgccgtcagcgcgcgcagctcagtagaggttcgcaccccgacgagcctaggccgcggacacctaggagccctctgaacaagcccctccctggtggtggctgagcacgcccacccagcccgggaacgagcccagctgacccgttcccatctcgctcctcaccctctcctcctcgcccctcctgtggggcgaggaggagaggacccgagcgcctctcaggtggcaagcacccagccaccacccacccgggtgagccccaggcgaaggagcaccttcaggttccaggtggcacagagcagctcgaagtggagtcggttgcgcacgagccccaggtagcgcagcctcgcgccggagagcttgcgtttgagctgtgcgtggatccgctcgacgttcggtcgggtgcgctgatagtcgagacgaacggcagggtccccaaagtgcgcccgctggctgattgcgtgccaggtggcaggggtgaaggtgaggacccgtcctcgcttcgagcgcgtgcagcgatcccggagcggacagccggtgcagtgcttgacaaaggaagcacgacccttggcggagatgggtactcggtgtccttggggacagctgacccatccctcctcgacgacgaagtcatcgatggtaaagccaccagggaccgccatggcaaggggccgaggcttgatcacctcgtcgtggccacgagcggcgagctcgttggagacctcgctcgtggcataggcgctgtcgccatagaccgtgcgcgggccgtcctcgtcacgaaggagctcgctcgccactgctgcgtccggcacggtgcccttcgtgatggtcgcagcggtgacgatgccactgtctggctcgacggccacgtggcccttgtagccatcgatggcacgggcacgtgacttgtggacgtggcgagcgtcagggtccacggtggagatgaccctgtctgtggctacccgcctcgcgatgcgccagcgaccttccttggcatcgacacactccacgtcttggcccgccacgagcccaaggagaccaagggcttcggtctgtggctcggtgagggatgcgagcttctctgcatgggcgaggtgggcagtggcatcggcgacgagggcactcaccgtgcgcaccactgcctcttcgtcccgatagtcgatggcaggctttgcgcgggtgtagtcgatcgctggtgacagaggaatttcgcgtagttcggggatcagcctgcgtacccggttgatctgggcgacaagttgggtcatggtgtcttgggtggcaaccgcatcggcgagcacggtggagtcgacgacgcgcttcgtcttgcccttgagcacccccgtggcaccgatcacctcggccacgagctcgccgatgagtcttggggtctcggaggtggcgatgcgcctgcgccagtaggtgagcaccgtggggtgaaagcctgggtcctcgagatcaagaccaagggcgtacttccagcggaggttgtagcggacctgctctgtcgcctcggtgtccgagagcccctcgagcacctggagcaccatgaccgcgagcaccctcgaggcggggatggagggtctgccggtcgtggaggggtagagatggcggaagcgctcgtcggggaagagctctctgcggtgctcggcgaggaaggcgtagatggaccctggctcgatgagcgaggagcagaaggcctccgtcgcggtgaggtgtgcctggtctgattcggtgcccagcatgcaaaaagtctagctgagctgggcaaatggcgcttgacaggcggagggaagcgcttcccgtagccgccctacgtggaggagttgttcaggggactcctagggccgagcgaggacctccgctggatcggcgagaaacccgacgtagaagcgaccaaactcgccgtagtaggccgacgcctcgtcgtagcgcaatgtgtagacgacgtccttgatgtcgtccggtcgtttcgcgaacaacgtcacaccccactcccagtcggtgagtccggtggcacccgtcaccagttggatgactcgtcccgagaacttgcgccccgacgccccgtgtccatacatgagccgctcgcgctctgcatacggcagcgcgtaccaattgaaggcgtcgccccgacgcttcgccatggggtagaagcaccagttcggaaagccctctggcggcaacaccgggtagaggcgcggacgcttgcggtcctccggcaagtgctgtgagtactcggagacctccgtgatggagacgaaggaatcgacgagcgtgagccccgctcgcgacaggccggcctgcaggtcacgcaagaccgcaaagtcctggtggagggccatgacggcgacctgcgcatggtgaccgagcagactggccgtcatcacctgtgcccccgcagtctcgcactgcttgagttcgcgcagtgcctcctcggcggcgtaaccgggacctggattggcgaacagatgcagcacgccgaggccggttcgcacctgcgagccgccgacctcgtccgaacccatcacctcagtgctgtcactcatgattggtctccatcatgctcactcgtgagcgcgcgatggcgcatcgcagcctcgcgtcgatcagcgatcgtgccagcgccgagggcgctccctgccggtagcgggaccgtcatgggttgcgactcctggagccgatgcgcccgagccacagcgtcgtggtacgcctcgatctgcgcacgcatggacgggtctgcgtagaccgttccatcgatgagcaacccctgacggcgctccatgatcgcgaggatgtcgtcaccggtgatcgtcttctgagtctcgagagcatgagcgacggcgaggatgtcgtagcggtgctcctcgacgatctgggccacgcgctcgtagagggcctcgagtcgccgctcgacacgatcgccgatgccccctttgcgagggtcgtccgcaggcccgactctccggcgctgcggcccgtagccgccgatgccgaggtcgcgaaccgcatccagctggagaatggtgtcgcccataccccacgacgtgtccatcagggccgcgagcctcgaggcgctgaagagatcgcccgagacgcccgaggtgttgtcgccgccgaagaaggcgcgctcgccagcgagcgatgccagacccaccatgatgtccgcttcgaactcagagcgccaccgggtgaatcgctcctccttgggcaagtaggacacgagtccgaggaagttcgaacccttctcgatggtggcgatgtcgatcaccgaattacgccgcacgacaaccgccgttaccgcatggcacgcctcgtggacggcgacggcgtgccgctcgcgctcgacgtactcgacgtcttcgggcagaccgaaggtcttgatctgcttcgcacggatcatgtccggccactcgatgacctcgcggccctctcggatcgcgataatcagcgcctcgttcaccatgtccttgatggcggctcccgacaagtacggagtcatggtggcgagccggtcgatgtcctcgtccgagagagcgtggtggaccttggccaagtagccctggaacgtcctgatgcgaccctccttggacggatagcccaccttgtagatgcggtcgatccgaccggggcggagcagcgcctcgtcgagcacgtctggaaggttggttgcgaggatggtgagaatccggtacttcggcggttcctttggcttgagcccgagcgcgcgccgaacgaccctgttccagaacccacgtggcttctgcaagcccgacagctccgtcagaagggcttggagcgtcccgtccatgccgccaaaccccggcactacgtagcgccagaccgatcggccttgcgcgcgaggctccggcgcactcgcacgagcacgacgaagttcctcctcgaagagcacctgctgggtcgccggatcgaagtaggtgccaccatggcacgtgggcgcatcaccgaggatcggcgaacccgcgaagcggaatctgccatcggcaccagcgatggcgcctcgcgaaccaagcgagtccgcctcgtcgaagaaggcgacgaccccgccatagcgcaccgcgagcttgcgcagacgacggaagatcgacttgaccttcaaaataccgaccccgatgaacatgttcgcgaaggcaccgggctcgacgaagacgaacggcacttgggtctcgccggcgaccgcctcggcgatcagggtcttgccggtgccaggcgggccccacagcaagataccggtcgggacgtagccacccttctcctcgatgcgctcgggatcggtcaggaagatcaggttctccttgatccggtcgagtaccgcgtcttggccccagacgtcgctaaagcgcgtcttgacgtcgccagggaagtagacctcgtagccgcccttggagagataccaaaagatcgcgacgaaggagccaaccccgatgagcagatagaccccgatctcgatgatcgtcgggagcgagttcatcaccatgcccggcacgacgaacagcgcgaacaggggcgagacgtggtagtgggctgccagcacgaccgacaccagcgcaaggagaacgatgatcttcgcagctcgcgcgatgcgatagcgcgtccaatcgtcgcggccgtggccgaggcgctggatcggtcggacgacggcttcttcccacgcctggttccaggacgacgagcgctccaacgccagcacgttcacctggcgcaccacctcgaggaccacgagtacggtgagccaccaatcgctctgaagggtgctcgcaagcgcgacgcccaccggttcgagcggattcgcgttcgtctttgtcgccgtcacccaggcgatgagcaccgcgaggacgacgaggaacttcaagcggtcccacagcgactgcggaggtcggcagcccggccgcgcagcatgccgcctggccccggtggactcggtcatggtgttgcctccactccaaaggaacgaatgattgagtcgatcacacctgcattgcgtgcaaagcacgcgacgtcacatcccaccccgaggacataggcccacgtcgtcgagggattcacctcggcgatctgctcgagttcgatcggcgagctcgtaccgacgcgctcttccacggtcatctcagaaccccggaacccgcccttgcgcacgaacgtctggtaggccttgaccgagaagtggtcgatcgacgacgacggattgaagggatcctgctggaggatcagcgtgcgcaaggtcgccaacgagaacgaatcctgctcggcggaggtcaacgcctgcgccttcacgattccgaatgggaacccctcgctgaagccgttcgagaccgcagacaggccagcgacgtgcttgccaacgatgatgttgccccagagactctgctcgacctgtcgaagcgtcgtcgaactcgcacgaggatcggccgaccggaagacctgctggaccgtaaagcgctgccaacccgaaggaatcgcgtagtagaccgactcgcctgcagcgtcgccgtgactgacgtacgagagcccgctcgccgagcagctcgcagcgagggcacccaacgtgatcgtggccagggttctgcgcccccatcctcgcgaacgagcgaacgaccacactccaccacgccttcctgagcgaatggatccccccgctcggggaccgagccctcttccatgctaccgccttagcttgtggacaactcaggcgcaccttcacgcgaggtgagagcgcagaagccagcccagctctgccacgtccgaggtttcccgctcggctcctgcgaccacgccggtctcgagcagcacaggccccacaacgcatcaaaggggagcaggcaagcctgctcccctttgactgtgcgtcgcctgccgcatgcgacccggcgacgccgtcgtcccttagaagtcctccatcccggcgccagggttgaccgccggcttgggctccggcttgtcgaccacgaccgcctcggtggtcaggaagagcgccgcaatggacgccgcgttctgcagcgccgaacgggtgaccttcacggcgtcgatgacaccggccgccaccagatcctcgtaggtcccggtcgcagcgttcaagccctcgttggggttggtgagtgccttgactcgctcgaccacgaccccaccttcgaggccggcgttggtcgcgatctgccgcaacggctcctccaccgccttggcgacgatcctcgcaccggtcgcctcgtcaccctcgagcttctctgccttgtcgagcaccgcacgctgggcacgcagcaacgccacgccaccgccgggcacgacaccctcttcgatcgctgccttggtggtcgagacggcgtcctcgatgcggtgcttcttctccttgagctccacctcggtcgcggcgccgaccttgatgatcgcgacgccgccggacagcttggcaagacgctcctgcagcttctcgcggtcgtagtcggagtccgtcgcctcgatctcgttacggatctgctggatccgacccttgatgtcggcgtcgctccccgcgccctcgatgatcgtcgtctcgtccttcgtgacctcgacgcggcgcgcgcgacccaacaggtcgagcgtcgtgttctcgagcttgagcccgacctcctcggagatgacctggccaccggtgaggatcgcgatgtcctgcagcatggccttgcggcgctcaccaaagccaggagccttgaccgcgaccgaccggaaggtgcctcggatcttgttcacgaccagcgtcgcgagcgcctcgccctcgacatcctctgcgatgatgaggagcggcttgcccgcttgcatcaccttctcgagcaccggcaacagctcacgcaccgacgagatcttcgagctgaccagcagaatgtacgggtcgtcgaggatcgcggtcatggcctcggtgtcggtggcgaagtacggcgagatgtagcccttgtcgaagcgcatgccctcgacaaggtcgatctccatcccgaaggtctgggactcctccaccgtgatcacgccgtccttgccgacgcgctcgatcgcctcggagatcatggctccgacctcaggatcggcagcggagatcgcggcgacctgcgcgacctgctcgcgcgtctcggtctccttcgcgatggacttgagcgcgaggactgcgtcggcaacggcctcctcgatgccacgcttgagtgacatcgggttggcacctgccgcaacgttcttcaggccctcgcgaaccatcgcccacgcgagcacagtggccgtggtcgtaccgtcaccagcgacgtcgtcggtcttcttggcgacctccttcacgaggtcggcaccgagcttctcgaacggctcctcgagctcgatctccttcgcgatggagacgccgtcattggtgatcgtgggtgcgccccacttcttgtcgaggacgacgttacggcccttcggtccaagggtcacccgcacggcgtccgcaagcttgttcatgccctgctcgagcttgcgccgagcatcctcgtcgaacgcgatgagcttggccatcgttgcctccctggtctctcgcgagcagcgttttcaccacgtctgtgacggctctctcggccgcccagcatgcgtggttagcactcagctatgccgagtgctaatgatagcacctcgccgctgcttagccgccggcgaccgcaggaacgaccgacaccacatccccgtcgccgacggtggtcgcaagaccatccagaaagcgaatgtcctcgtcgcgaacgaacacgttcacgaagcgccgcggctcaccctcggcgtcgaggatacgctcggcaagctcggggtgctcactcgccaccacagcgagcacctcaccaaccgtctgcgcctcgccgaccgtgagttcgcccgcgccgcccgcaaggctgcgaagctgcgctggaatgcgcacccgtaccgtcactccaacccccatttccctctcgctcccgaccgctagcgcgcctgggctccgagtaacgaccaaaacgcatcgatcgatggacggatcacggtgccggtatcgacggtctgctcgatggcttcgaccgtcttcaggccattgccgctcaggtacgcgaccaccgtctcgtccggtcgaacgatcccctgcgaggccagcttggcgagcgtcgcgaccgtcactccacccgcggtctcgacgaagatgccctccgtgcgcgccacgagcgcgatcgcttcgaggatctcgtcgtcagagaccgcgccgatcgcgccgccggtcgctcgtgcgacatcgaccgcgtaactgccgtcagccgggttgccgatcgcgagcgacttggccaccgtcgatggcctgaccgggcgcaccaacgagcgacccgcctcgaacgcctgcgcaaccggtgagcacccctgcgcctgggcaccggatacccgcacgctcggcggctctggcatgagtccagcgagggccagctcctcgaaacctcgatggatgcgcgtgagctggcttcctgaggccaccggcacgacgacgtgatcggggtagcgccaacccagctgttcaacgacctcgaaaccgagggtcttcgagccctctgagtagaacggccgcaggttgacgttggcaaagccccaatcaccgcgctcggagacgatctctgcgcacagacgattgacgtcgtcgtaggtcccgtcgatcgcgacgatgttcgctccgtacaccgcggtggccaacaccttgacgcgctcgagattcgcgggaatgaagacgtaggcctccatccctgcccgagcagcgtgagccgcaaccgagttggcgaggttgccggtggaggcacacgatgcgacgcgcatgccgaactcacgagccttggagagcgcgacggccaccactcgatccttgaaggatccggtgggattcaccgtgtcgttcttgaggtagagctcccccagaccgagctccgcggccagcctcggggcgggcacgagcggggtgaagccagcaccgaggtcaatacgggcctcgtcgcgctcgatgggaagcagctcgccatagcgccacaaggtcggtggccccgactggatccgctcgcgcgtgacacgtgccgcgatctgctcgtagtcgtaggcgacttcgaggggaccaaaacagaactcacacacgtgggttgggctgatcggataggtccgcccacactcacggcacaccaggttgacaaccgctgacgacatcgtccctcccgccgccatcgctcgggcattggcacctggttcgacgtatcgaactggttgccgcggtatcacagggcccgtccctacaccgctctcgatgattcggcgtcactcatgctagcgactcggtcggcgctctgcgctgctcgcacgcgtgccaatggacgcacacgacctagcgtgaggtcatggctccagcgcgccagtacctcttcgtgacgaatcgagggccgttcgcgatctcgccgtccgggtcgctccacgaggcgggcggtggcctcgctgccggcctgcgaggactgctcgcaacgggtcaagcgcgatccgtcttcgccgtcgacgacggaccagaacgcgagcactggagcgccgtcggcgacgatcgcctcatcccagctgctgtcccggaggaagtgcaccgtagcgcctacgacaccatcgcgaacgagctcctctggtactgcgctcatcagctgttcgacctcgcgttcgagccgatcgacgacgctcactcgcgaagggcgtggtcgcactacgaaacgttcaacgagctcatggccgaagcagcgcacgccgttgccaatgttgacgacgtcatcgtcgtcaacgactaccacctctatctcgtgcctcgggcgctccgagcacgcggctggcaaggcacgctggtcttcttcctacacatccccgtgccgaccgagcaggagtacgcggtcctgccggcagtggttcgtcgggccctcctcgatggcatcgccgaagctgacctcatcgccgtccacgcaccgacgtgggccgagcggctgcgagcactcttcgatgcgagcggactcgtggcgccgccgatcgtggtcgcccccctccccgtcgacgtcgttggattgctcgagcgtgccgcacgtcccgatgtcgccgaagcgggcgagcgcctcgacgcaaccggcggcgcactccccacgatcacgcgcgtcgaccgcatcgagccgtcgaagaacctgctgcgtggcgtcgccgcgatcgaccggatgctggagctccgccccgacctcgcgggccggttccgagccctccacctcgcctacccctcgcgcggcaacctggacaagtaccatcgcctccgttcgtcgctcgtcgacatgatcgacgccgtcaacgaccgctggcggcgttcagggtgggtgccgatcgaggcgcacctcagcgacgacccggcacgatccatcgctgcctaccagcgcttcagggtgctgctcgtcaacccggtgcgcgacggactcaacctcgtcgcacccgaagcgagtctgctcgcccccccagacgcccacatcgtgctctcgcgtagcgcgggtatcgcagagcacatcggagaccatgtgacgctcgtcgacccgttcgacgtcgacgagaccgctcgtgccctcatcgatgcgctcgagcggcccggtgatctcgaaccggtgcgccgctgggttcacagcaattcctgggatcgctggcttgccacgatcaccccgaccgccacggagacgcgatgacaggctggagggacgtcgtcacggctctcgtcagagcgcaccgcccgctggttgcgctcgacttcgatgggaccctcgcctcgatcacggcggatccctcgcgcgccagcatcgctccggatctcctcgacgatctgagcgggctcgcgcgcacgctgcgcatcgcgatcgtgtccggaagacctcgctccttcctcaccgatcagcttggcgaccttgccgtgcggatcgagatcgcctccaactacgggcgcgacgagacggccacgcccgcagatcgcgacctcctcgaccgggtggcgagaggccttgcggacctcgcggccgatggcgcgctcattgaacgcaagccgacgtcggtggccctgcacgttcgggagcatcccgaactcgccgctcgagccgcggtgacggtccagaggttggccgccgcctaccaccttgatcttcaagaagctcgccaggcatacgagctgctcttgccttcatcggcgacgaagggcacggcagtctcgtccctgatcaccgacgacaccgacttcgtgctctacgccggtgacgacgtcggcgacatcgccgccgtcgaagccgtgcgcggtcacggcgggccgtcgtggtgcctcgcgatcgactctggtgagctccctcctgcgctcgcggcgatcagcgacgaggtcatcgatcagcccgaactgcaccgccgtctccactccctccgcgaactcctcgcctcgcgtcacgccgatcatgacggtcctgtcgacgattttgctcaacgaagtcgcgaggccgaccgatagccaccgcagtgatgacccgaggagggccatgatggtctcggttggcacggaggtaggcgccgctccgtcgcgtcgtgccgacatcttgcgcgcaacgtgggagctcctcgccacgaccggagccagccacctcaccatccgccgcgtcgcccagggagcggccgtcgaccccgccctcatctaccactacttcgggtcgaagcgcggcctgctcggagcggctcgcgacatgccagagggcctgagcgacatcctcaaggcccagcgagggccactcgaacggcttcggatcctgcaaaccccaccgtgggcgacgtgggtcagcgccctcgtcgcctcggtcatcgatgatcgagaggacgcgctgcgatcgctgcacgaactcatcgcgagcgtcgacaccaacggcgccctgccgcgccttgcgctcctcggcttcttcgccgatcgcttcttgctgcacgtgtggtcagctggacccgatccggccgcgccgttcgatcatgagctgctgcgctagcgcgcgcgggtcatccgcatcctgaaggtcggcctcgagcggcgatgggacggtgacgagacgagccccgggccacagtgcgctgagacgtgtcgcacttcgatcgacgctggcgacccagccaccagcgagatcccatgctggaccatcggcccgtcgcacgacgaaggggccctccagcgccacgcgccacatccagctcagcgcatcgacggacgcccgaaagagatcaacgggcaccacgacgacgaggtcctgcggtcgcaggtcgagctcctcaagggcggccacgatggcgcgatgcggaccgaacccggcatcagcgacagccgcggctcctgacaccccaggaccgacctcgacgacgcggtacgacgcacgttcgagtgcgtcgcgcaaccactcggcctggatcgcccctccctcgcgggggagacgagccttgtcggtacccatacgccgcgatcggccacccgtgagcaggagcgcgacgcgcaggcgtcgagccggagccgactcctcatgccaccccaccatcctggtaggctaggtccatggacgcagcgacgccgttgatcgatcccttcgggcgggagatcaccgacctccgcgtctccatcaccgaccgctgcaacttccggtgcacctactgcatgccggaagagggtatgcactggctggaccgaggcgaactcctgagtttcgaggagatcactcgcatcgcgcgcgtcatggcgacagccttccggctccagtcggtgcgcatcaccggtggcgagccgacggtacgagcgcaggtaccgtcgctcatcgaacagctcgcgcaggttcgtcgccccgacggcaccggtctcgagctctccatgacgacgaacggcgcgacgttcgcactgctcgcggacgacctcgtctcggccggtctggcgcgcgtgaacatctcgctcgacaccttgcgtcccgagcgcttcgcacagatcacgcgccggacccgcctcgaacgggtcatcgagggcatcgacgcagcaatccgcgtcggtctgtcaccggtgaagctcaacaccgtcgtgatgcgcggcgtcaacgaggacgaactccctgacctggtgcacttcgcggtcgatcgtggcatcgaagtacgcttcatcgagttcatgccgctcgacggggacgggcactggtcgccccgcgacgtcgtctccgaggccgagatgctggagctgctcgccgcgcacttctcgttccaccccctcgcacggtcatcggctccggcgaccacctacgaactcgatgatggatctgggcgcttcggggtcatcccgacggtgacgcacccgttctgcgacgcctgtgaccgcgtgcgcctcagcgccgacggccgcttgcgcacgtgtctgttcgcgctggacgagcacgacctgcgcccgctactgcgcggtggcgcaggcgacgatgcgctcgccgagcgcatcgtcgccatcgtcggcacgaagtgggcaggccatcagatcggtaccgtcaggttccgccggccatcgaagtcgatgagccaaatcggcggttgaatcggatcgctccgtggcgaatatgccacccggcgagtcattcctggcctagagtgtggccatggccgacggcaagctgacccacttggacccgctggggcgggcccgcatggtcgatgtgactccgaaggagcccacgcaccggagagcgctcgctcgctgcaaggtcttcatgaagcccgagaccacggcgctcgtcgccaacaacgccgtgaccaagggtgacgtgctcggcgccgcgcggatcgctggcatccaagcagcgaagcgcaccccggacctcatcccgctgtgccatccactcctcgtcggctccgtgtacatcaacttcacgctcggcgacacctacgtcgaggtcgaagcccaggtcgagaccgtcgaccgcaccggggtcgagatggaggcactcacggcggcgtccgtcgcagcgctgaccatttacgacatgtgcaagtcgtacgaccgcaccatggtggtcggtgacctcgcgctctgggagaaggtcggcggtcgctcaggccactggcgtcgggaggaggccgtcgagctgtgaccatgcgggtgctcgagggaatcttggccatcggctggatcgccatcctcagcgcaccgatcgtcgctcggcgcaacgaccctgacggatttgtctcgctgcgacggtaccgcaaggctcgggtggcactcgcgcgtcgcttcgatggtacggtggcggttgaactcccgattccttcctctccacggggctcgtcccaacagctggtcagacgtcgtcgggtctatctgctgctgggagccgccctcctcgctgggctcatcgcactgcccgtcgatccgctcggagggtttctcacgagcctcgtcgccgcgaccatgttcgttggctacgtacggttgatccgccggcagcggacaccgagtagttcgattcgccagatggtgattcagcccgaaccgagccgctagcatgctcgttcatcggcgaccacgccgatgaaccctcgggggtgtagctcagctggtagagcgctacgttcgcaacgtagaagtcggcggttcgagtccgctcacctccaccgacggtcagcctcacctgctggatctggtgggtccgatcacggtttgcatgacagcacgcgatgggttcaccagcgcgcgggcacgtgctcaacagacccgaccgcgccgagctgttggcacacatcgacgggcgcagcggccgttcgacggcatcgtctcttcgcgctcggctggtgcgtgtgcccacctccgcgagcggcgtctcgcaacgatcggttgaaccgagtgtgcagcgagccggcccgcttcgagcccctgggagtcctcgggatcgggagtgccgggcatacccgcagttcggcacgggctcgccgtggcgtggtcctcaaggaggtagcgatctccttcgtcggccgccccctcgagacatcgatgggggcagggggagcagtctcacccaacattgacatggaggggaactccgagcacagcgggttgcgccgctcgaggctgcctggcgcaacaatccggagcgcttcgtacgcaagccgccggagccgcctgccctaccgaggcacgtcttgatcaatccgccagaggaagtggcagcgccgacacagtgaagtgccgaccaggggtgtccgtcaaggctttgacaggttccggagggcgtacgatgcacgagcccacacgatccccgtgatgccgatcccccgtctgcgaggaatcaacgcatcgtgcgccgataggtaggccacctcggtggagattccccgtcagcgagaacacaacgctgccaccgcattcaggtgagcgctaccggtatggctcagtgctccgatgtgctcgggagccttgacagaacatcgtcgtcggatcgaccaaggagctgtgccagcgctccgagccgctcggggaccaggcggtagtacacccacatcccgcgccgctggcggctgacgatcccggcatcgagcagaaccttcagatggtggctcacggttggctgcgccaggccaagaggagccaccaggtcacacacgcaggcttcacccagaggcgcaccctggagtaggctgatcaattggagccgagcaggatcagccacagccctgagcagggtggcgagtctctgggccgctgcccgatcaagcgtcgggcgcgtcagggttggagtgcagacatcggccgccgtcgactgaccggcatcaggacggaccagcggccgtacggcgttcctcacagccctcatcctacaaccgccctctcggcaccgaagggatccgtcgaccgtggcctggatatattgatgaccatcaatacattacggtgcaaccacgcaggtcgaagaccgaccgccccgttgggcggcgtcaccaacgtgcagcagcactggacgtcaccgacgagcagcagccatcggcacgcgcatcgacctcgaaccgtgccagcgacgaggaccctcggacccaggcacgctcctctgataacccctcggtgtcccttccctccacggcggttggactctcagggagtcacgaactcccgaaggccgcgccgtagtgccactgcgcggaacacccgagcgcgccgacagtccccatcgcggagcgcttcccagtcgtgcagccgaaggcgtatggagctcgcgtgctgagcctccacggacccgccctcatcgtcacggccatcgcgatcttcgtcgcgaccctggccctcgtgatcacgcaacccaagggactgtcgatcggctggtcagcgaccggaggcgcgctgctcgctctcgcgctcggcgtcgtccacctcaccaacgtcgtcacggtttggggaatcgtctggaacgccaccgcgaccttcgtcgcgttgatcgtgatttctatggtgctcgacagagtggggttctttcggtgggccgcactccacgtcctgcgcgcagcccacggcagtgccgtccgtgccttcttctacgtgctcatccttggcgcggtggtcgcagccctctttgcgaacgacggcgcagcgttgatcttgactccgatcgtgtacgagcaagtgcgtgcactcgggttcgggcctcgtcaggcgctcccgttcgtgatggcggcaggcttcatcgccgacacaacgagcctcccgctcatcgtgtcgaacttggtcaacatcgtgagtgccaactacttccacatcggctttgctacctacgccaagacgatggccccagtcgacctcgtggccttcgtcgcgagcaccgcggtcctctacctcttctatcggcggatgctgcctggtcgttacgatccgaacgcgcttgccgctccccacagcgccatcgcggaccacggcctgtttcgggccagctgggtggtgctcggggtcctgctcggcggctacttcctctcggagccgctccacttcgtggtgtcgatccccgccggtcttgcggcgatcttcctcctgctcctcgcctcccgctctgccgcactctcctcggccgccgtgctccgcgaagccccgtggaggatcgtggtgttctcgatcggcatgtacctggtcgtcttcgggctgcgcaacgctggtctgaccactttcctctccgacgccctcagcgcaaccgctcgcgccggactcgtgccagcggcccttgcgagtggcttcggtgctgccgcgttgtctgcggtgatgaacaacttgccgaccgtcctcatcggtgcgctgtcgatcaacggagcacatctcgcaggactcgctcggacggcgtcggtgttcggcaacgtggtcggatcagacctcggcccgaagttcaccccgatcggctccctcgcgacgttgctctggctccacgtcctcgagaccaagggcatcaagatcagctggggccgctacttccgccaaggcatcgtgctcaccgttccggtccttgccatcacgctggcggccctggcagggtgggtcgccattgcgcactgaaacagcgtcagcccgcgatcgatcaaggagccttcgagagcaaggagcaaccatggacccacgacgtcgtctcgaccagccgcagccgacgagtgacccccgaccgatccggtgccgatacccggccgcctttcacggaggagacctcgggccagccgagaggcgcatcggtcatctcggacccggtgccgctcgatgggcgcagaggtcagcatgatgcgccttctgtgcatcggagggagcgacggcgggatctctgccgcgttgcgcgctcgagagctcgacgcctcggccgagatcaccgtcgtgctcgcagacgactacccgaacttcagcatctgtggcatcccgtaccacgtctcgggcgacgtcgccgactggcacgacctggcccaccggacgcgctcagacctcgaagcgctcggtatcaccctgctcacgggacacaccgcccgccgcatcgacgtcgctgggcacacggtcgtcgcaaccgatgccgacggacgcgagatcagcctcggctacgaccgcctcgtcctcgccactggcgcgacgcccctccgcccaccgatcggcggactcgaccagctcggccacggggacggtgtccacgccgtccacgccatggaagaccttcacgcggtcatggcgagtctcgccacccgcgcaccgtcgcgagcggtcatcgtgggggccggctacatcggcctcgagatggccgaggcgctcacaacccgcggcatcgccgtgagcgtgctcgaagcgctcccccacgtcctaccgacgctcgacggacccctgggcgacgtcgtcgccgaggaactcgctacccacggcgtggcggtctacacctccacaacggcgaaggccatcacgacggaaggccgtcggctccgcgtccacgccacgtgggcacccgaggctgagcccagagcgctcgaactcgacgccgaactggtcctcgtcgtcaccggggtcgcccccgacaccgcactcgctcgcgcggccggcctcgagctcaccccgaggggcgcgatccgagtcgaccgaaccatgcgaaccaacgccccagacgtccttgcggccggggactgtgtcgtcacgtaccatgccctcctcggcgagacgtatctcccgctcggcacaacagcccacaagcaggggcgtatcgcgggcgagaacgcccttggcggcgatcgccacttcgccggcagtctcggcacccaggtcgtgaaggtcttcgacctcgtcgcagctcgtacgggcatccgcgacggcgaggccgagcgcgccggttttcgaccgcgcaccgtcgcgtcctctgccgacgatcacaaggcctactatccgggcgccacctccgtccgggttcgcatgacaggcgatctcctgagcgggcgcctcctcggtgtccagatggtcggggcactgaccagcgctgtccacaagcggatcgacaccgcagcagccgcgctcttcgccggcctcagcgtcgatgaactcggcgacctcgacctctcctacaccccgccgctcggcagtccgtgggacgtcctccaggtagccagccagcgctggatcagtgaagcacggcccgtcgacgacgcacactgaggcgtggacggcgcgactcacacaacgagcaggggccgtcgcggcgaactcgcgacggccaggctaaggggtctggcgagcgcgagactgccccatgtcgggtgagctcggggctgattccgccgaccgcgcacctaccagttcacgacccgacatgaagcgcgacacttcgactcgtgcgctagcgcaccccatcccgtcatcgcaccccgccgcgggcactctggtccccaccaggggccaccgaagcacacgagccctccccgggaccaccccgagccccatgggatcggcgcgcagactcctggctcccgactgcgctcgtgagcgtgcggctgcgacctgcacgtcgagcggcgctgtggtagcctgatgcttgccacgggagcccagtcgggctgagagggcggaagagccgccgaccgttggaacctgatccggctcgtaccggcggagggaggcagtatgaacaccattcctgtcgcgtcattgcggcgccgtcacgtcgacgaagcgccaaccgatcacgtcgtacaagctgcacacccgcagcagcgccgcgtggttcgtgaggctccgccactgccccatgacctctctggcgacgacgataccgtcctcgtccccttcttggaggtggcgaccgccgagggtcccgtcatcctgccgacgagcctgcccggtgccccactcggatcagacggcctaccacaggtccgggcacaggtcctccgccatcgctatggcgccaccgtgacccgtacgctgcctggggggccgctgcccaacggtgctcccgcccgtcccacgtacgccgccaaccagatcctgacgcagcggaccctcgcgcgccgcggatttggctcgtgggagctgcgcttcgtggcagcccgagagcaggtcacgctcgagcgcgtgctcgacgacgtcgcgagcgggcgggcggtcgtgccggcaaatcccaaccatccggaactcgaaccgacgatcatcggccggaactaccggaccaaggtgaacgtcaacctcggggcgtcgagcgtacgcgccgacatcgacgaagaactcgccaaggtcgcggtggcgctccagggtggcgccgacaccatcatggacctctccaccgggaccaagctcgcctgggtgcgcgagtggatcctgcgcaacagctcggttccggtgggcaccgtgccgatctacgaagcgctcgatcgcgtcggtggtcggcccgagcggctgagctggtcgctgttcgccgaggtgctcgaggagcaggcgctccagggggtcgactacgtcacggtgcacgccggcctgctccgcgactacgtgccgctcgcggcacgccggaccaccggtatcgtctcgcgcggcggctccctcatggccgcatggagtcagcatcaccaacgcgagaacttcttgttcgagcacttcgatgagctgcttgctatcgccggtcgctacgacctcacgctctcgctcggcgacggcctgcggcccggctccaccgcagatgccaacgacgaagctcagctggccgagctccgcacgctcggcgacctcgcacgacgagctggagaggtcggcgtccaggccatgatcgaagggccaggccacgtcccactccacaagatcgcggagaacgcactgctcgagcaagaactctgcgacgatgcgccgttctacaccctcggacccctcgcgatcgatgttgcggcggggtgggatcacgtctcatcggcgatcggagctgccgtgatcggagcgcacggggcagccatgctgtgctacgtcacgcccaaggagcacctcggcctcccgaacccggaggacgtgcgtgcggggctcatcgcctatcgcatcgccgcgcacgcagccgatctcgccaaggggatcaacggcgcacaggcgtgggacgatgccatgagccgagcccgctacgagtttcgctggaacgaccagtttgccctcgccatcgatcccgcaggagcgcaggcacaccacgacgaaagcctgccagcgcgcgcagccaaggatgccgagttctgctccatgtgtgggccgaacttctgcgcgatggcacactcgcatcgcgcgcttcacgacgcctgacggcaaccgagacagcgctgccgatcgacactcgttcgcgtcgcgatccgatcggcgcaccgcacagcacactcggcgacagtcggccatgcgtcgctgtggtcgatctcagccgagagcactcgcatctcgagccggacctgggtcgacgatggcgtcggaacgaccgacaatgcctcggcgacccggtaggggcatcgaccgagctgggcaccggaacctcggaccagcacgccaccgagacgaccagacgctcggtagcccggctcgggcgcgcctgtgctggtgcgtgagcgggcccgctcgcgacgtcatcgtcgggtgcgcaccagcatgcctgaagtctgcttctcccatcttgctacggtggagccgtgccaaggccacagaggacgtcgagctcccggtcgtcggaggggctcaccacgaatccagaagtgacgtgtcgcccatctcgcagctggtcgcgggggcaccacccctacgctggtctcacagccgtactggccaccaagcacgacaagctcccgctcatcgctcctccactggaagcagcgatcggtttgcaagtcgaagccgtccccgtcgacaccgacgtcctcggcacgttcactggcgatatccctcgccctggacctgcgctcgacaccgccatcgccaaggcgcgccttgggatgagagcagctggccgttccctcggccttgcgtctgagggcagcatcggccccgacccagccctcccgttcgtccatgccgatcgagagatcgtcgtcctcgtggacgacgagcacgggatcgtcgtgtgggagagccatgcgagctgggatatcgtcgccgcctcgacgaccgtccgccccgacgatgacctcgaaccgtttctgcgcgaggcgcacttcccggagcaccaggtcatcgtccgtccgaaccacggagtgctgcatccgatctacaagggcattgcctccctcgaccacctgacttcggccattgcagagtgtgctcgtgctgcgacagacggtttggcccgcgtcgagactgacctgcgggccaacgcgtgtccctcgcgtcggagcgcgatcgcagctgctgctcaacgccttgccgatcggatcgctgctcgctgtccgggctgcggcgcacctgggtgggggcgtgtcgacgtactcgtcggcatcccgtgcgcgtggtgtggcaccgaggtccccacaccacgcgccgagatcgacggctgcgtggcctgcgattgccgccagatgcgtcctctcgtcgcagccgagcatcgagccgacccgagcgaatgtcctgtgtgcaatccgtagtgaagaacgagagacggtagcggtcgtcacacagcgagcacggcggagcgcgtgaacgttggccacctcgcgcaccgacgcctgtccccttgaggacaggatcccagcgtcctcgagacgttcgacaatgctgatcaacgaggcccatggctgcttcgttctccctcaccagagggaacaccgctcgccgcgcgcgtgctcgtagatcgcgcttcgcctccggtcggtcaccaccagtcagcgagctcggtacgacataccgcagacaattgtcgacgccgttcgagaactgaacgatgtcaccggtgaacagtgaacagccgaccatggagggtgatcgctgtggaagactgggcactcgtcaggcggctggtagctgagggcgtccccaaggctcgcatcgccgagcgactggagttctcgcgcacgacggtcgtaaggctggccgcccggagcgagccgccgagctatcggcgagccccgaccgacagatcccttacgagcgtcgaggcccgggcgacggccccgctcttcgcagacgagcgtgacctcagccagttccgaacggatgcagcctcactggtcctcgaccagcgccgcgccatcgctgactgaggtgccccagaagttatagacacccaggttacttcatgcgagccccctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatgccgtgtcgggcacagaaggccacaactcgatggtcgctgaactgactccctcggtcggtgtgccagatgaccccctgcgcgttggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccgccgatgccgcccctggccatcgctgccgccaccgtgttgtggctcgtcaccacgccagcggctcagagtgccgccgtgatccgtcgtgcgccgtaggtgccagaggatgcctggtggaccgcgaccactcggtcctcgaggtcgcgtctcgcacatgcccgacgcgacggtgctacctgggtgcgtcgccatcggtcgtagccagcccgggagacctcgaggaagcgtgccatccgcttgatcttgaagcgagcgtactccgcctccatcagcgcgaatctctcttgcgtggtggcttcgcggcgaagtacgcggctgcttttcccaggaactcgttgtccttgcgcagctcctcgagctccctgcgcaacctgatgagctccgtgcgctcctgcgccgtgaggggcgggctgccagtggcgtttgctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggtgtaggcagcggccttcttttgacccgggatcagcggtgcgaactgacccacccgtggcacaactataggtggtagtggtgaggatcgtggtgctcggcgtcacctcccttcgccatggcctcggccgcctggggcaacagtccaccggggagccgctgcttggtccggtccttcaggcggtagctctcgcctcggatgttcaggaccgtggcgtggtgcagcaagcggtccaatatggccgtcgcgagcacctggtcccccaccagggtgccccactcgccaaagcccttgttcgaggtgcagatgatgctcccggtctcgtagcgagctgagatcacctcgaagaagattcccccggcctccgtcgaaagcgcccggtaaccgatctcgtcgatgacgagcactttgggggcgaggtacttgcgcagacgcctcgggctgcccatgccctcgaggtcggccaccatgcgggccatggtggtgaagtagacggagtgcccggcctcgagagccgacagggcgagccccaccgcgaggtgggtcttgcccaccccaggaggtccaaggaacaccacgttggtggcgttcgccacgaaggcgcacgaggcgagctcgttgacgagggcgcgatccaccccggcggcaaagtcgaagtcgaagtcgccaaggcccttgcgatggggcaggcccgagagcttgagcctcgtctcgtagctgcggtggcgacgctcgtcgcgttcggcaccgaggagggagatgaggaagtccacataggaggcctcgcgttgggtggcggcctcgatggcggccccgacgagctcggcgctgcggggaaggccgagctcgccaaggagtgcttcggcgacctcaagcatggctcagcgcctcgtaggcatccagcgagcgcacctcgaccgtggtgtcgacgagctggcgggctcgggggccacggagtgcgccagcgagctcggcgcgtgggatgccctggtactgctggggcaggtagaccaccgtgcgggtcttgaacccaagcgagtgggtggcgatcacccttcctgtctcgtcggtgatctcgagggtgcgccctctgggcagcacccacaccgtgcgcgtgacgtaggcgattggtactccgtagctgacgccgccgaaggagacgaagccatcgaggctcacccgacgagggcggcgcacgaaggcatcgagctcggcgcgtggcggcaggggacgtagggcctcgcgctcggcacggtcgaagacctccatgggcgtagcaccgaggctcggatgcagcctgtggtcgcgctcgaggctccagcgatgggcctgctcgttgaggtcggcgaggtcacggaagcggcgggctggccagaagtgctccttcgcgtagcggatggagcgctccaccttgcccttggtctcgggccgtcggacccgacacagcgagatcgagatcccgaggtagcgggcgagatcgagcagctgggggtggtactcgtagccgcttgcggcgtccccgccgagcacgacggtcttcatgtggtcggtgagcaccacgttcgtgagtcccccgaagtggcagaaggcctcgagcagcgcaccgatgaagccgtagctgtcggcgctcggggcgaaggtgacgaaggtgcgccgcgagtagccaagcgtcgccacgagccccgggatgcgtcgctcctcgcccctggcgtccacgtaggagaagatgccccagtccacctggagctggtggccaggcggggtctcgtagcggcggatggggacgggtttcggaggtgcggtgtggcggatggtgcgcacgtagtcgcgcacgatggtgaccttgccggtgtagccgagctcggcgatccgttccacgatggccggggccgaggtgagcccgtctgccaccagccggtcgatctcggccttgtaggggtccagcttggaaccccgtcgggggcgggtggccttccccgaggtgccggcgccgtcgcgcaggtagcgccggaccgtgttccgggagtggcccgtgcgccgcgcgatctcgcggtagccgtagccctcagcctgcagttcgaatagcctcatcaaagacctgcccttcagcatcgggttgcccccttcttctggacccttgagggcaacctaccctggagggtgggtcatttttgttccgctgctcgtgggtcagttctagcccgctgcctacatctggggcggctcagatgggaacgtgaccttcgtgggtttgctattcgtggcaagcgtcagacagccagcgctgtacttgcgttcaagcaccaaccggtcacatagcacctcatatcgcttggcatacgacgcacccgcgaagatcggatcaactggaaagtacggttccacgttgcgaacgggcgcatggactttcgcacagtcctccagcagaaagaagtacccgaggaaaggcgcgggatgcttaccgaatcgaccttcccggtatgccgtccaaatgtcctcggcgttgccgatggcttcttccgttcggttgttgaagttgttaccgaagctcggaccgacctgtgacttgaattccacagccacaaggagctggccgtcaacgaccaccagcaagtcccacttcctttccggtcggtaatagccgggcagctcgagcgccgtgcggaccctgacatggtcaggctcgagcccagcatcgacgagtacgtccgtgagcagcacttcgagcgcacccatctgcgctcctcccgtgaccgcaccccgggtgcctgcgcttccccccatttgcttgacagtctgaatgtaggccacggccacctcttcgcgggcccagatgagctcgtactcgacgggcggtaggtacccgaggctcgagtgcaggcggacggtgttgtagcgctgaatccagctagcgatggcagagcgggcctcgtcgaggttcgcgaagcggtagcgagccaccagctcgcgctcgcaagctcccgcagaaggcctcggccacggcgttgtcgtcgcgaggtcgcgaccctgcccaccgactggcgaagcccgagcgtcgcgcagagctggcgaaccttccgggagaggtactggttggcgcgatcgctgtggacgatcgccccagcgaggctgccccgagtcccgagtgctccgcagatcgcctcgaccatcaggtcatcgggcatgcgacgctggagcgaccagcccacgatgcgccttgagcgcgccctccttggccaccgtgcggatgcgcatgatcacactgcgatcgacctgccactggtccgcggcctcgatcaccgtcacctcctggcgcaccagctggaggaagatctcgtacttctgcagagtggtcaggaaccgcttcgcacggcgtccagcccggtcagttccacgggtctcctcggtcatcggaacatggtcttccactcgtcgtggagacccgcggatgctgcttgattcgtgggccgatccctatcgcgaagtcaggcgcaaaccaaggccgtgtggctccgtgtgatcctgggaagcaccgaatcccacacaacggagagagggcggcagataccgtcgtgccgtcatgacggcatagtggtaacatgaagccatggcaaagaaaaagacgaccgtctacctcgactccgatgtactcacggcgacgaaggctgcagcgctcacctccaagcggtcggagagcgcggtcatcgaggatgcgctgcggtcatatcttcggagcggccacggcgatgcggcacgagatgagctgcgggaactcctgaagcgtgtggccttggcaagcgaccttgacgaggatgcagcgctcgcgcaggcagtagacgaggtccgagcggttcgtcaggagcgtcattcgcgatcggtgcgtggtgggtgagctgcgtcgtgttgtcttcgacacaaatgtgttcgtggcggcggtcacctcacgagacggcgtgtgcgcccggctcctccttgctgcgacaagtgggcggtatcgcctcatcgtctctccgatgctgctcgacgagctttctgcggtgctcgtgcggccgaagttccggcgatacctgagcgtcgaggacgcgcgtcggttcgtggaggtgatccgggagctggcagacgtcgtggacgatcccccggaggaggatgatcccatcaccggtgatcccgacgacgacttcctcgtcctcctggcggaggtggcgggtgccgacgtgctggtgtctggagacccggacctcaccacggtgcagcgtccgggacttgtcgtgaggacgccccgggcgttcctggaggacctggagcagccgatctgacggcggacatccccggcagggctcagtgagccccaccgggaacgagcccgggcgctatgccgccggggctgctggagcgctcttccgggagagcgcttggagtcggttggcgacgatctcgacagtgcgtcgagtgctggcgtcggtggcgtgccactggcgtgagttaagcctgccagccacgtacacgagccgacccttcgtcaggtatcgggtcgcaaactcggccgcctgaccccagagcacgacgtcgaagaagcccgaatgataccctgcctgcacggcgatccgtacggtcgtgacgtgcttcccggaaggagtctcccgaagatcaggggatgagatgaggcggccgatgagggtcacctggttcacggactctccccggctctggcgggatgccgccattgcggcggtcatcgtggtggttgtgttactgcgcattgctgcacctcttgttgtgtggatcgatgccacggtgacaagcgggcagactgccgagcggaattggccattaagccggtacggcttctcgctcttgggccttgcagcggacaggcaggggtctgctatcggggatgctcgcgtcccgtatggcgttcgtagacgatccagaagggtccagaaactccctgccaccgccttgacctgccaggatggagtcggcgaggctgctcagcgtagtgccctcctgtagacctcggatggaggtggagggcaccagcccctgcacgtacgcagctgactccgtcagcggcgagttctcggagcgtcaagggcagcgctcgatcgctgccaggcgctctgttgccgttgagcgcggctacgagcatccgagcactataggcaccgccgaagcaggtgactcgctggcaccttgtctgcaggaggagcatcctccttgggcgtgacaacttccgctggggcggtgatgccgtccacccccaaaggagatgcggaagaagcacaagatgatcgacacgagattgatcagggcactgcgtacgcatgccctgtgcatgcacacgcagggatccctacgagggcgacatcggcaagcccgccgctgcgcaaccgcagctcaccggcgacgtcgcgctgcgcacaccctgcatcggcatgcgtacgtagcgctgagcaggtcccgagaaatccacccgagaaactcgcccctcggacgagcgccggaatgacaaaccgctggccagacacctgcacccctgcacgaggtgcgtgcttgaccagcggtcatagtggcgggggcaggatttgaacctgcgaccttcgggttatgagcccgacgagctacctggctgctccaccccgcggcgtggagaacagtgtagcggcgctccctctaccccgccgccttgccggtcacgctcgcggccttgagctccgacaggatctgaccgatctgctcgatgtcgctctggtaggccccgaggttgccggacttcaaggcggcttgcgcctcactgtagagctgatcggccttggcgagcagcccggcggctgaactcggaacggtagccgtcgtcgacgtgcgcgacgaaccctgcacgcccgacggcacgacgccgaagatgtcgcgcaggacacccgcgaacgtcggctccatcgcaacctgcgtcccgtacacgccgatcacttccttgatctcaggcagcggattcgcctggctcgagacgtacatcgggcgaacccacaggaggttctgaccgagcggtagcgccgtgaggcccccgagcgacacgttcgagccgtgctggtcgagcagcgtgatctcctgagacacattggtcgcagacacgatgcgcgacgcaaccaatgcggggccgtcgatctggcccgaactcggagtcgtcaacgccacgagctgcgtcggatcggacgccgacgcctcgccaaagagcaggccggtcaggttctgctgcccgccgctctgcgagaacggcacgaatgcctccatcagtgccagctgcggcgaggaggtgccgggcacctttgccatctcgtagatcgggctcatcaggttttggctcgtgccgccgaagctgaacgagcttcccgacgagatcgagccgttctgcggctgtgccgacagcgaccacgcgttgccacccgagtagaacgtcgacggattcgtcacgtggtagatgccgtacatcgccgactgcacggcgaggagatcactcgggtagcggaggtgactcgcgatcgcggctggcatcgccgagaccggctggaagacatggggaaacgccgcctcgtaggcctggatgatcggatccgaggggtcggtgacatagaagtgcatggcaccggtgtaggcgttcacgaccaccttcaccgagttgcgaacgtagttgaacgacgtgttggcaagcggtgcgctcgacgacagcgcctgcgtgttggcctgctccgaataggggaagttcgctgtggtggtgtagccgttgatgacccagtcgatgtggccgtcgacgatcaccggatagggattcgacccgtagtgcaacaccggcatggccatctcgacgcgctggaggagatcgcgctcgaacatgatgcgcgagtgggtggtcagcaggctcgacaccaggatgttgatgtcgccgaagcgcatcgcaaatgccgcacgcacgagcagcgacgagagtcggacaccgcccgagccggcgtagtgggtctccgacgacgccccatcggggagctggtagtcgatctccgcttggcggctgtcagcgatcacgtagcccgagagaccttggccgtagtagacctgcggctgcgtgagcgtcggagcaccgcccgacgaggtcggcggaagatcacggatcaagaagatggggttgcccgcggccgagatctcgttcgccggtgccagcgcgacaccgtaaccatgcgtgaactgcagatgctggttgacccaggactgggctggaaggttcgctgcgttcagctctcgaacgccgatgatgaccggtgtgggcttgccgttgatcgtgtcgttctcgatcgagagcgaggggaactggtagtacgagcgaatggcctggagcttgccgaaggtctgctggggcgtcgaggttccccagagccgcgccgcgccaagggagtccaggttcgcctgctccaccgacgaactcgtattcgcggtcgcagaatagggctctgagggaacatcggcgatgtcgtaggcgtagcgcgtcgcagcgatgttgcgcgcgatgtagggaagctccttctgaccctgggcgggatccaccacgaacttctggatgatggccggatagatcgctcccagcacgatcgagatgaacgcccacaggcccagcccgatgaccggcaacacccaaccctgacggaagatgttgatgacgaacaggacgcaggccaccgcggagatgaagatcagcagattgatcgcggggagctgggcgtggacgtcggtgtagctcgctccctcgacgaagcccctggtcgagaagtccaactggtaacgctggaagtagtaaccaatggccttgatgagggccatcactgcgagcaggaccgacaggtgggccttcatcgagggtgcgacccgctgctctcggcgctggggctggatcgatccggtcaggtacccgacgaccgcggtgagcacgaacgtgaaggccgcagcaaggaagaaccacgagatcaggaactcgatgaacgggagtcgaaagacgtagaacccaacgttgacgtgaaattcggggtctcgcatcgggaaggactcgctgtggccgaagagcagccagttcttccattcggcaggtgcttgggaggcgacgatgagcgtcgtcaccacggcgagcacgacgggcagcacccaccgacgacggttggcgaaggcgcgatagcgctgcaccagttcgtcgtcgtggtcggccggttggcgcaggccctggcgttgcgcgacgaccatgctggtgagcgcccctgcgaggtagatcgccgcgaacacgacccacagctcgaccttggcgagcaggaccccgctccacacctcgccgaggtgatagttcgagaaccagaggtaatccgtgaagaagacggcgagacccttgagcgacagcagcaacacgatcgcgatgacgaccacgccgacgaggatgagctgcgcccgtgatggtccgcgacgctcccgggtcatgtcctgggggacgcgcataccatcacgagcctaggcgaagaccggcacaacgaggcaccggcacccgggatgcgctggcggtctctcatgacctgttgggaaagcctcgtcagcagcgacgacctcggcgagtgcgttgtcctcgcagtcggggcaggcacgacgcgtcgggtcgaggagccagcggtaccctcgcggcgcaccgacgctccgcacgcccgcgaagaaggcatcggtggcggcgtcgtgcgcaacctcatcgagtcgaccggctcgaagctcgcggtggattgcaccgacccgctgcgcgagctcctccggctcgccaccatcctccatcgtgcgcacgagcatcgcgagcacttcgtcgtcgagacgagcgacgagccgtgcaagtgcgtcagcgacgacgccatctgtgccctggtggtgcggcgcgacgatgccgccgagaccctcggcgaactcgaccccagccgccacgttccgttggatatggagttcgcagctcgcgcgcaacacggacgggtcggcccgcagctcgacgagacgagcggtgacctcctcgggatcgcgctggcgcaagtcggcaagcacctcgttgatgaggtcccccacgacgcgcttgacccggcgcgcaagatcgaccccgcgcggctctgcgagctcgagatagcgccggtacaacgatggtggacacgtattggcatcgtcacgatcgggctcgacgtcgccaactcgccccgcatcgccatcgtcggcctcagcgccgaggaccgcggactcgccacggtcgtggttcgtgtcgccaccacgctcgtcgacctcgtcaagttcgagcgtgtcgtcaccgtcatcgcgcacggccaagggctcgcgctgggcccgatcaggggacacgacctcgccggcgccagccaccgcctcgctgggagtgacgacatctgcagtgatggcgaccgcaccaccagcgtccgcgaggctcgagaacaagtgctcgaggcgctcgagacgctctcgtgcaaccgccgaccgatggctgggggagtcgtcgaccggcttacgtgcaccctcgccgagagcctcgctcgagggctccgagtccggtgacgttgcgtccgatggcgtcgcacctgggagatccgtgtccagaagtgcctcgtcgtgcggtgcaccgtcagccagtgcggtgtcccggagctccgtgtccgctgacaccgagacggccggctcctcgtctcgcgacgcctcgacgctctcgggcccctcgtgctcgtcggctcgagccgcacgtggccccccctcgtcccgtgaggcggtcgccaccgcatcgacctcaccggtcgtcgcaacgcgaggagcgagcacgtccgaggcgagtgagccggatggcccctcgacgacccggaccccactcgccggcgcaccctccccagcgagcgccgccgaaggagccggggcaccaacagggtcggcatcggaggcggtgctcgtcgcgtcgtgggcctcgtcggcgatcatccgaatgagcgacgtcacctcggcaagatcgaggtccggtcgcgcgagacgctcggcgacctcgctcaggtcggaggacgaacgctcgcgcgtgtctgcgacgtccgtcgacggatcgatcggcgtggtggtctcggccccgtcgctcggaggactcggaggctccgcgactgcgctactcggtccggcgatctcacgccgttcgacgaccgacggctctgcatcaaccccatgacgccgcgttcgccgctccaccgcgtcgacctggaccagcgcctctgtcgcaaccgttcgcacctgctcgagcagctggcgcagcgaaaggcgagtgaggtcgagattcgcaagttcttcgcgccgctcggccaccttggcctcggcgtcggcgaggagcttacgggcgtgctcgttggcgcgcagcaccagcgatcgcccctcttgcttcgcgctctccacggtggtctgggcagtccgatccgccattcgcgtgagctcactcgcctgagcgcgaacctgctcgaggtaggcctccgcagcctgccgcgcctcgccgagggcggcctcggccgcatgacgtgcctcgtcttcgatgcgctgcgcctcgcgtcgtgcacgctcgaggaggtcggcagcctgggcttctgcccgacgacgcagtgctgcggcggcctcggtcgcgctccgcaagacgtcggcagcttcgcgaccgacgagctgggcagcgcggtcggggtcttggagcgcgccgtcgagctcgttcttgaccttgagtgcctcggctcgcgcctcgtcgcgctcgagttcgcgcttggctccctcgcgacgagactcctccagcgcatcgcgcaggcgggcgacctcgtcgcgaagttctgagagcgtcgaccgaacgcggtcacggtcgaaaccgcgccgcacgaccgggaactcttcgtctggctcatctcccgagcgccacatcgctcctcctaccgagcgctgtgcgccgccgcctccggccggagccggtcgaggagctggagggctccacgcaaggtggcagctgcaagcacgcgcattctccccgccgcgtcggccctcgcctgcacgatttgcgatgttgcgacgatgaccgtctggatgccggcaactctagccgcgaggagacgctggcgaagtccggacacggccacgagtgccccgctcggatcgatcccggcgagcgcggcgatcggctggcgcggggcgcgggcgagcagcgcaggacgaagttcgtcggcgatcgccaggcccaccgccagccctgacgacgccgtgtcggcgtcgggcaggcgcagctcgagatgcaccggcgtgatggcggcggtcgcaggtgaggtcacgagtccgagttccccggcgaccgagggcaccgtcaccgacgagacgaaccgcgagagtcctgaggccgtcgaacgcaccaacgacaaggtcacacgcgtgtgggtgacggccgcggcgacggcgctggcgaacgctgctggcgtcggcacgggaacgccgtcgaccccgaccacgagatcgccagcgtgcacgacaccccggagcggagacgtcgggagcacaccacgcaccacctggccctccatcgactcgacccgaacgccgactgctcgacaggccgcgaccagcgcagcgatctccgactgctgcgatgcgctgagcacggctggatcgccagaacgtgcccccacgatctcggggaccaccgattcggcggggtcgaagcttgcgatcagccaaccaagtggcgagagcggtcgcgcggtcgtggtcgcgctcgcgatgtccagcgtggcgggcggccgccccgccacgcgcacgagcggcgcgatcgccacggtcgcacccggcgcaagggccacctcaccgatgcgtccgaacaccccccacccgagcaggaggagcagccatccgacgacccacagcttcgccccggcaacgacggcgtcgctcatcctcctctgacgcacgaggggagcctacgagttccgaggccgaaccaatctgtaatgatgattacactcatgagcagaccgaaggaggctctcatgacaacatggctttctcgcgccgaagccgcgtcagaactcgtggcggcgagcgcactgctgttcgaggcggaggtgatgtcgcgctccggtcacggcaatctctcctgccgcatcggcgacgacacgatcctcatgacctcgtcgggatcgatccgcaacctcgatccttcgacgctggccgtcgtcggactcgacggcaccgttcgcgaaggggcgatcgcgccggagaacgccgagatcatcgagatgcacacacaggtctaccggcttcgccccgagctcggtgcgatcatccacacccattcaccgaacctcacggccttcgcctatgcccatgagccgctgcccattcgctccgagcccatgcttcggttcggccaggcggtcgcggttcccgtagcgccctgggcgcctcgcggatcacacgagtcggtgggcgggatcgtcgaagcactgcggaacgccccagagagtcaggcggtgctcctcgccaatcacgggttgctggctctcggtgccgcaccaacggcggtggctcgcctcatcgtcgccctcgaggaagcggcgacggaggagcgcttcgcggcagccctcggtggcgccaaggactttcccgccgatgcgctcgccaaggtccaagcctcgatggcgagggtacggtgagcacgtccgaccgcttctcgtcgattcgtgacgggtatctgcggttcttcggctcggtccccgcgtcgttcgaggagcgggcgcgggtggcgcgtctcgttggtcgagaggcgaccctggaggccgcagaggccctccgagccgccgcgatctacgacaatccgctcgggccgcgcctgcagcagctcgtccacttcggccagctcctcgtgctcggcgaggagggccctgcggcgctgcacgcccgcaccgcggttcgccacggcgcaacgatggccgatctcgtgggcgtcgtcgagactgcgctcatcacggccggcgtccccgcctatgcgctcgggatgcgcgtgctcgcagcactcgatcatgtcgacgagtccgacacaccctgaactcggcgcgggctggctgctcggagcagtccaccgacacatccgttcgcgctgggcggagcggattcgtgcctacgacgtcacgccaccgcaggctgcggcgcttcgtgccctcgcgagcgccccaggactgtcgctgcgggagctcgcgcgacagatcgaagcagagccgatcaacctgtcgcgcacgctcgaacctctcgaggaacgtggcctcgtgtgtcgcgagccgagacccaacgatcggcgcgctcacgcgctcgtgctcaccccacgaggcctggacctggccgcctcgctgaccgcggccgcggccgagttcgagcacgagctggccacgctcctcgacccaggcttcgaccagacggtggcgtggctccatcgcgccctcgccaccttgcgcacgtccgagccgtcgcagccaggctgacccgcacggcctggcgtacccgaggcgcacacgacacgtctaccatctcgacgacggcacccgacgggaggcacccatggcacgactcgagatcgacgcagggtgcgctcgctgcgctcgggccggcacgcacgcccaacatctcgctggcccgatggacgtcgtcgagcgacccggactcgacgccgtgcgctacgtcgacgatgagggccgagccttcgcaggcttcgacgccatcgtcgccgtgctcgccggtcgctggccacggttcgctcgggtcggcacgatccgctgggtgcgggccaccgggacggtggcctaccgagcggtggcgcacgtccaccgcgtgggagatcgacccgacagctcccagcacgagggctccgagcgcccgccgcgaggctaggtcatccgcgagaaccgacggatcgcgatcggcgccgccacgatgacgaaccccacggcgaccgcgagcgatccgaggagcgaggcgccgaggctcacaccgaccagggcgcgggctcccgagccgacgatctcgaggcgagccgcgtccatgaccagcgagaccggctggtagcgcgcgaacccctggagccaacccggcagggtctggatcgggacgaacgcactcgagacgaacgtgaggggaaagagcacgggaaagctcatgagctgggccgcctccgcactcggagcgtagagacccacgatggcgaacaaccaggacagggcgtagctgaacgccaacacgacgaccaatccgaccacgaggccgacgagatgatgcggacggaatcccacggcaagtccgacgacgacgacgatgacggcggtcgcgaggttgcgtacgaggtcggcggccgtacggcccagcaggaccgcagcacgcgagatcggcagggcgcgaaagcgctccatgatgcccgacgcgaggtcttcggcgagcccgacgctggtggccgctgcgccgaagatgatcgtctggaccaagatccccggcatcaaaaagtcgacgtaggggaccccgagtcgagccgtgatcaccccgagcgacccgccgaagacgtagcgaaacagcaggacgaacatgaccggctggatgaacgagaagaacagcgactgtgggacgcgcaggtagccacggagcacccggcctgcgagtacccatgcgtcggcgatcacgctcccgccacgttcgtgtgcgatcacggcgctgctcatgccgccccctcggtactcagctgcccgttggtgatcgcgagaaacacgtcgtcgagcgttggttcgcgtatcaccatgccctcgatcgcgaccccggcgccgtcgagcgcacgcagcgcgatcatcgctgcctgcgcaccgttctcgacgccgagctcgaccacgcggccatcgacgcgcggatcgggaaacccggccgcccgcagcgcctcgacgaccatgggcggcggctccgcggcgagccgcacctcgaccaccgtcgccccgaggcgagccttcagggaggctggcgttccctcggccacgatgcggccgtggtcgacgatgacgagtcgctccgccagtcgatcggcctcctccaggtactgcgtggtgagcagcacggtggtcccgctcgctgcgagatccgccacgatcgcccagagcgcgaggcgactctccgggtcgaggccggtcgtgggctcgtcgaggaacagcaccggcggctcagcgaccagtgctgcggcaaggtcgagccgacggcgcatgccgcccgagtaggtccgcagggggcggtctgcggcccctgcgagaccgaaggcctcgagcagcgaccccgcacgctccctggctcgacgccgaccgaggtggcagagccgaccgaccatctcgagattctcacgagcgctcaggcgtgggtcgaccgcagcgaactggccagcaagcccgatgcggcgacgaacgacgtccggctcgccaatgagatcggcgcccgcgacgatggcacgtccgccgtcggggacgagcaccgtcgtgaggatgcgtaccagcgtcgtcttgcccgcaccgttgggtccgaggagaccgaacacctcgccgtgggcgacgctcaagctgacgccggcgagcgcgacgagatcgccgaagcgcttcgtgaggtcgtgcgcctcgatggcgagtggttccatcccggtcaacctactcgctgtcgagatctggcgcgtcgctcagtgtgacggcagcagatcgccgatctcggctcgctcggcgatcagctcgtcgcgcgtcacggcgatccgagccgcgagcggttctggcacatcgagtccctccacgacgtgtacccgctcaccgtcggagcggaccgggaaaccgaagaagagcccctcggggatgccgtactcaccggcggacaccacaccgagcgcttcccagtcgtcggctgcgctcggatggatcaccgagcgaaccgagtcgatcacggcgttggctgcgctcgcggcgctcgaggcaccacgcgccttgatgatggccgccccccgctgctggaccgtcgggatgaagtgctcgtcgaaccatgccgcgtcgtcgatcacttcggtggccggcttgcccccgatacgcgcgtgccagtagtcgggcacctgggttgcggagtggttgccccagatcgcgaccgtgcgcacctcgtcgagcgcaacgcctgctcgctgcgcgagttgggtacgagctcggttctgatcgagcctcgtcatcgagaaccaccgctccgcggggatctctcgggcgttctcgcgtgcgatcagcgcgttcgtgttgcacgggttgcccaccacgagcacccggacatcagaggccgcgtgctcggcgagcgctcgaccctgaggacgaaagatcgcaccgttgacgccgaggaggtcgcggcgctccatgccagccttgcgcggcaccgagccgatgagcagggcccagttcacgccgtcgaaaccacgtgcgagatcggtggtgagttccatccgacggagcaacgggaacgcacagtcgtcgagctccatcgcaacgccctcgagagctgccatcgccggctcgatctcgatgagcgacagctcgatgggcgtttcgggcccgaagacgtcgcccgcagccagccggaacagcagcgaataggcgatctgaccagcggcgccggtgacggcgacacgaacgggtgtggtcatggtgctccttccatcatccccccgtcttctcgtccccccgacgaatgcgctccgcgacggcgtggccgaactcgctggtcgagaccttggtcgcgccatcgcgcaaccgtgcgaagtcgtaggtcacgatgccctcggcgatggtccgctcgagcgcatcgacgatggcgtcggcgacgtcattccagcccaggtactcgaacatcagcacgccggacaggatgaccgaacccggattcaccatgtccttgccggcatacttcggggccgtaccatgggtcgcctcgaagatcccgtgaccggtgacgtagttgatgttgccgcccggtgcgatgccgatgcctccgacctgggcggccagcgcgtccgagaggtaatcgccgttcaggttcgtcgtcgcgatgacgtcgtagtcccgaggccgcgtgagcacctgctggaaggcgttgtcggcgatcgcatccttgacgagcagcttgtcgccgggatcaccaccacagtcgtcccagccaacggcgacgtccgcgaactcctcacgcacgagctcgtacccccacgcacggaacgcaccctcggtgaacttctggatgttgcccttgtggacgagcgtcaccgagcggcggtggtgatcgagggcgtagcgaatggcagctcggatgagccgcttggacccatgggccgacacgggcttgatcccgatccctgcatcggcgccgagctcccacccgaagcgctcggcgaggaactcgcgcagcgcacgggcctcctccgaaccagcctggacctcgaggccagcgtagacgtcctcggtgttctcgcgaaagatcaccatgtccacccactccggatggcgcaccggcgacggcacgccctcgaaccagcgcacgggccgcaggcagacgtagagatcgagcagctgacgcagggcgacgttcagcgaacggatgccgccaccgaccggggtcgtgagcgggcccttgatcccgacgagatactcacgaaacaccgacagcgtctcgtccggcagccacgacccggtctcgcggaaggccttctcgccagcgagcacctcgcgccactcgacgcgacgcccatgggccgcgagtgccgcatcgaagaccgtcctcgcggcgggccagatgtccaccccggttccatcgccctcgatgtaggggatgatgacctcatcgccgacgatcagccgaccgtcggctcccatgcgcaccggagttgccacgggctcatcctatcccaccgtctcaaagcgccccagtcaggcctccggatcctgcctcgagccgccacgtgcaagacgatccgcccagcgctccacgtcggcaagctcgtcggcgttcgggaaggcgtcggggtccgccagcgcggcgccgacgagctcggctcgatcctcccgcaccaacagctggccggcgaagcgctgactcgcggcctccaccgccgcgaggtccatgccgaacaggttcgcgagcgccagcgtcgccggctcctgctcgcgccgatccgccaggctctcgatccagcccgcacgcccaaagaggcggggccgtagctcctccagcgccgctcgcgcgacgcccagcacgaagctggcggtcgtcgcgagttcgcgaaggttggcttggcgtgccgggctctcctcggcctcgaagaggccctcgagcccgaagcctccgagctcaccgagtcctgcgatgcccccgcgctcgaggagcctacgacccatcgcctcggcatcagcacgcaggtcgaggaggaacaaccgcagctcgacgtcgagacggtcggcgacgttcggcgaggcgatgagcggtccgcggaccgcatcctcgagcaccacccagaggccgacctccgcggcgggtgccccgagttcggcggcgactcgtccgatcgccgctggcgcgaccgtcgcgccagcgtggagggatcgtggcagtacgagctccgtccccgacagcgacgccatcgcgaagtgcccaaggaccgagccgagctgtgcattgaccatcatcggaccagcttgggctgcgagggtcgcgaacaagcgccccatctcgggatccatcgcgtcggtgaactggggctcggtgacgaccgtgccaccgagagcacgctcgaacaacacgaggtactcgcgcagctcaccgacgagctcggtgtacaggtcgcgtgggtggagggtgcgcacgccgatctcgacctcgcccacgacacgcaccgcgagcgccgactcgggaaggtaacgagacgcgatcggaccgagctcctcgaacggcgcgcgttccgtggcgccgagcgcgtcggctccggagagcgcgagctgggcaaactcgtcgcgcacccgtgacggatccgacccctgggcgctcatggcacgcgcgaggtcccgcagtaggaactcgaacgggttctggggctcctcatcgctcgccatcgctcctcctcgacgtgcctgccgcacccaatgtcgtggcacccacgcagcaccccaccctattcgccccgggaagcggacgaggagtcctacgatggaccaggtgagccacctcgaggctacggtgcgcgtcggccacgacgcccggctggtcacctggtaccgctggagcccgacggcgacgtgggtggtgatcgtcgagcccggcgcgacccatgactacctcgtcccggtgatcgaccagctgggtgcagccacctacgacccgatcggcaacgggcgctcgcgtcaccttccgcccgatgcgatcggccgcatcgggcgcaacctcgccgcggacgaactcgcagcgatcctcgaggcgctcccgggccccaggcgactcgtcagccaccacagtgcgtgcatcgccgcactcgacatcctcgccctcgtgccggagctcctgagtgagatggtgctcgtcgctccacgtctcgggcctccgcccgcacggctcgaccccttcgcgacggagcatgcctcgtcgccgtggcacgacgcgacccgcgcctggatctcggccgacccgcgaccgctcgagcactggcgcaccgaggtggcaccctcggttcgcgacgcgctccgggtcccggcgtcgacgagcaccgtcgcggtgcgcgcgctcgtcgacgccgacgacacggaggcccgtaccctcgccgagaccctcggagttcccacggaggtcttccccggacgcgatctcgcgctcgccgactcgtctcggttggtagccgcccttgctcgctgagtgttcgcgcagaatccggcgctgctcgcaagctgtgcagcctcgggcatctagcctggaagcacacctcggtcgagtcgtcgcgcgacaacccgcgagtcgacgacgaggtgcgtcatccaccgggcaatggggccagaggtgcgaggaggcatggtggtaagcgggtcgtgggagtcgacgacagccaccacgtggcttcgccttgagggcgctcccatcgatgaagccgcggtcgcgacgttctgccggcggccctccgtgggcgcggtggtcaccttcgctggcacggtgcgcgatcagggcgagggcctcagcggtatcatcgccctgcactacgaggtcgccctcgaactcgccgccgcacgcctcgatgcgatcgcagcacgtgccttcagcgacgctcccgagctccaagcgctcgcggtccaccatcgtctcggacgcgtgccgctcggcgagcccgccgtcgtcgtcgccgcagccgccgcccatcgcgacctcgccttcgacgcggcacgcttcgtcatcgacgccgtgaaggtggcggttcccctcgtcaagcaggaactcaccgaggtcggcgcacgatgggccccgagcgccacgcccctcgaagacttccccacacagaaggatgtgacgtcatgatcgagctgctctacatcgccatccccatcgcgctcgtggtcatcgtcgcggtcgtctccagcatgcgcgagcaccgtccccatgacgtgcgctcgagcgtctccacgttcgagcacgcccgtcaggcgctcgagcgccgcaccaccctcgacgcgagggagcgccccctccgtgagcgtggatctcggggtgcacccgagtgagccgtatcgccctcgatctcggtacggcgacgacgcgcctcgcgatcggtgccgagccgccgcacgcgctggagagccttgcggccatcgacgtcgagcgaggcgacgtcatcgccgttggcagcgcagcacgcgccgtggtattgcgtgagggcggtcgcacgtcgctggtgcacgtcgtcgacgctggcgtcccggtcggcccgcaggtgctcgccggcttcctcaagcgcacgctacgcgaggtcggcctccgctccctcgggcacggcgaagtcgtcatgtcgatgagcgaactcgccacgagcgtcgagcgccgcatggctgcgcgcctcatcgaccgcctcggtgcgtccgccgtgacgctcgtaccgccgtcactgagcgtactgcgcgccgtcggcgccgatccagagttcggctcgttcgccatggtggtcggggaagcctacaccgaagcaggcatcgcggcgatgggcagcctttgcgcgagtgctgcgagcaaggacggtgttcgcgatctgcgaagggccatcagagagtacctctggagcaatcacgagctcgccatcagcgacgagaccgcctccgaggtgctcacccaactgtgcgatgtgtctcgccccacccagagcgcccgtgcccgcatctggggacgacgccgaaccgacgcagagagtaccaacgtcatcgtcgatgcgagtgcgctggtcgccgcgatgactccgacgctgcgctcgatcgaacagctcgccaacaccgcgctcgcgcgggcgcatgcccagctcgtcgccgacatcgccgaacggggcctcgtcctcgctgggggcggcagctacgtaccgggcctcgccgcacgtctggcgaacgcgctcaagatccccgtgacggtcgctgacgagccactggacgccgtgcttcggggtctacgcaccagcgcgcgactccctcggcgtcgttcgcccgcgccctcctaaggggcgcacctgacgcacgcacctcggcacgctgccaagtgccctgcttgcaagaccccgtcgcacggtgctgacgccgctgcaccgctctcgcgccgagtccccgcggtccaaggtccggcgcaccgacgagccccgcgtgctcgcgtcggtgagcccatctgcgcaatgctcggcagcgacgagtcgcacgacacgccgacccggtggattcgacccgaagggccgagccgcccagcgacccaccggagccgacggctcgcccggcatgcaccacgtcgccctcgccagaggtgacaggtcgctcggtcggtaagtccacgccgatggcccggcggatcgatcgtacgttctcactctccgtgaagtttcttctctcagtggtcgatactcctcctgtacgcaccgatgacgggtcgcacgggccctggaaccggcgatcaaggaggagctatgcgtcgccacggatgggtagcaacagtcgtcgccagcgccgcgctcgcgctcggcatcgtggccactccggaagtcgcctaccgcacgccagctgcaccccggccgcagacccgagcagcgctcgcagcccccatcgtcggggtggccgccgacccaagcggccaaggctactgggaggtcggcgccgacggcggcatcttcaacttcggcggcgcgcccttcgatggcaacacctacaccttgggactcacgggtctcggtgggtcacgtccgctcgcagctcccatcgtcgggatggccgcaacccccgacggcaagggctattggctggtggcggccgacggcggggtgttcagcttcggagatgctggcttctacggcaacacctacaccttggggctcacgggactcggtgggtctcgtccgctcgctgctcccatcgtcgggatcgtgcccacccccgacggcaagggctattggctggtggccaaggacgggggcgtcttcagcttcggagacgccggcttctacggcaacacctacaccttggggctcaccggtctcggtggctctcgtccgctcgcagccccggtcgtcgggatggccacaacccccgacggcaagggctattggctggtggcggccgacggcggggtgttcagcttcggagatgctggcttctacggcaacacctacaccttggggctcacgggactcggtgggtctcgtccgctcgcagctcccgtcgtcgggatcgacccgagccctaccggtgccggctacaccttggtcgcggccgacggcggggtgttcaccttcggggacgcgagcttcgacggcaccacctactcgatgggctacacgggacttggggggtcacacccgctccctggcgccatcgtgggggcggccgaggcccccggggacaccgggtactggatgaccagcgcgagcggctccatcttcgccttcggatcggcaccgttcgacggggacacctcgactatcggcctgacaccgaccgtccagaacgccctcgccaaccccagcacgaacctggccccaaccttcgacgcggcctgcttcgagcagttcctcgcgagcggaacggttgggtcgaccgcctgtgatcaagacgccatcgccgccatcgatcaagcccacagcgacgagggcctcccgccgctgtcgctcccgtccaacttctacgcgctcacgaacgccgagcagctcttcgtgctcgtgaacgaggaacggatccagcgaggcctcccggcgctctatgggctggcaggcaccttgaacgccgacgcgaccgccggtgcccagtccaacagcgaccccggctttgcgttcacgcagtcgtggccatggcttccggacgcggggagcaactgggcaggcgactatgcgccagcggcgagcatgttcgattggatgtacaacgacggttggggcggatcccaggccgcgacctcgaacatcgactgcacatccgcaacggcacccgggtgctgggggcaccgtgccaacatcttgatcaccgttccccaaggcgccgtcggcgtgatgggagccgcgagcatccccgagagcacactgggtgcgagtggctcccccttcgaatcggacaccatggtggtcggattcgtcccagcagcgtccgtctcgggcctaacctacacctacacctggtccgaggccgtccaagccggagccgatccgcagccgtaggccaagcccagctttcgaactcaaaggcgacggcgactcgctggccgccgtcaatcgcaggacctccagcaagtccggattaccagagacatgacgagtatcattcggataccaggaatggtacatcacgaaccgaatggtacatcacgaaccgaaacgagctgacctagtgcaaacaccgagcccgggcatcgatcccttaggagccctcacggcatcgatatacgactcgcctcggctctacgccttcctcatcggaagcggggtgtcgaccggagccagacagccaagcgcgtgggaaatcctagaccagctaatagcgcagtatgcgtcagcaaccagtaccgatgtgcgcgcgcttggtctaacaccaaccgaatggtggcagcgcactttcgaatctgacgcggaatacagctcagtcctggagcgactcgaacccacaagaggaggccgccagcaacgcctcgagaaactcttcatctcaagctcgccttccgacgcccacaggcacttggccaagctatgttcgattggacacgtgcaggtgatcatgactaccaacttcgatcgcctgatcgaggacgcactaactgagcaggccgtccgattccatgtggtcgatcacaacaatgtcaagggaatgcaaccccttgtgcgcggtgccgtcacagtaattaaactcaatggcgactatgccgatctttacatgaaaaatacgagaatggcactgtctcactacacgcgaccatttacgaccctaataaagcgagttttgcaagaatatgggctcgtggttgttgggtggtcgggtcggtgggatgaagggttgcgaaagctgattgagagcaacagcgcacgcctctaccctatgtactgggtcgcacatcatggtcagctacatgacgaggcacagcggttgcttgatcagcgtggtgcttacaggattgactcacacggagctgacgacttcttcggccggctagccacaggactggagcgtctcagtcaactagcatacacacgtgccaggcctataagagccttacgaggcggccgagtattcaccattagtagtaattggagtccagtttcatcgccaagcacccaaagcggcaagttgtggattcgcactgccgtcacactcatgccagcctcgcagcagggagtcggttatgtcgatgccgccgaaatgtggggatacattgacactccagaaagaagagcgatccggaccgaacttgccgccgcgcgggccgcgtatgacattgccagtcttgttactgtcggccagctaaattctgggcttccggtcgacatgctgaatcaacaaatggaatggcacctttcgaagactgaccagctagatcgagattctgtttacttcgaacttgacgctccgaagagtgactactgtacttgttcggcgcggtgtcgcgtttatcttgggcccgggcgccctgagcaacagggcagcgcaatcatagacatcggcataggcgatctcaaggaccgctccaatcgacagcgaaagcttgctttaggagagctcgcgatcatttggttggaccagctcgacgctgcgattcgaattctaaccgatgcacttagcagtgctacaggtgggatggcaatgattgatacagtggaattccacctagaatatctgggcaagcctgacgaaccgagtatgggtctcgctcaccacgtcgacttctctcttctgggagttggaggtcgcgacgctcgagcagtgtcctctaagtttaggccagctgaacccctaacaggcgcagcaaagctggatatcgtcattgatgcagtaagggatatagcaatgaacactgggtttcacgacccagacattgggattggccgcttaaggagcgaactcgatagcctgcctcgacaagcttaattaccgatcccaaacaaatccataacggctcaatgacggcgcctttatatcgctgctgacgcatgtgaccgacccccgaagccgagtcaaggagccgtaacgtggcgacttcgggctcactggcctcccccctccaggttgagacctgctataggaggaagggatgagccagacaccgagcccaccaccgggcgacggaccagctcgacgacgacggggccgttacccgagccagttccgtagggacgccgcagcgttggtcctcgaccagcaccgaaccatcgctgaggtcgctcgcgaactcggcgtgaacgagcagacccctggtaactcacgtgcgcctagaacgcatccaccgaggtgagcgagagggcctaacaagcgcggagcgcgaggagttgacactgctgagtcggcaggtcacacagctcaccatggaatgcgagccggcgaagcgagcgatgtctcactcggtgaatgagggggacagtgggccgttaccactcagatctcccgctaggagaccaatggcttctccgtggcggcgccagcacgagtcatcggggtctcccccctggttgaaccgccccgggtttcgtgcacacttcgttacgtgtgaacggtctcggactcggccgctaggcggccatagtactcctgctcgacctcaatgggtggaccgcgccccagccggtgcatgagcctgcgcgtgttgtaccagttcaccgaggctctggtctcctcctcaaggtccgtgaggctggtaagaggcccgcgcgcaaagggtgggccaggccgcacgcacacggttgtggagagaccgatcgtggtctcggcgagcgcagtgtcgtaggcgtccccgacggagccgatcgaggccaccatgcctgccaacaggagcgattcaccaacatgcacggccgtcgcggcagagcctgcatccgagtgatggatcgtgctcccggtgagggggtgcccctcgcgtgcttgtcggccctcggccatgcgcagggcacgctcgacgagtcgggtgtcgtggcgacaggagcaggcccaccccacgatggtgccggcgaaggcgtcgatcacgaaggccgtggtggcacgccgcccgtgagccggacgtcggtgaagtccgccacgcacagctcgtcgggtcgctcccgtcggaagtcccggttgacgaggtccggggcgatctcggccttggggtctcgcatgtcgtgcgttgccgtgcacctgtcgcaccccgcaccagccatcagcgcgcgcgagccgttgcagcgtgcagcgggcaaccgggatcccctggcggcgcagagaggcccacaccttggtcgcccctaagagcgactccggcggacggcgacctttagcgtcgggctcatagatgccggcaaggatctcgctgatggcgctctctcagaggcaacggcgcgacggggctcggccaaggtgggcgtcgtaggtcctgggagcgatcgcactgtgcgtgcgctctcgagcgctcggacaatcggagcgaccccgtaggcccgtcggtgctgcgtgatgaagtcgcagatcaccgctggtgcggatcctcgcccgcgcgaagaacgttgtcgctgccttcaagatctcgatccgagcgctcgagttcagcgcgttcgtgcgcttcgagcgctcggatctcggctgtggtcggtggtgatgcccggccgctcgcctgcgttgactcggtactggtagagctacgtgcgcagcgtctctggtgccatggggagccgtccggacactgcctcgatcgctgcccattgactcggatactcgctgcggtgctcgagcacgaggcggatcgcctgttccttcgtctgctggtcccatctgctggccatgatctatccttcccttctctccaatggaagtgtgcatcaaagccggggtgattcaggttgtactacccctggcgacaccgtcgggacgaggcgaggatcccgagcacctggtgctcgcgagcgagccccacgccatctggcacgagagcgacggcacctacgccaagtccccgcatcacccacgagctgcgacacgcggttactgcgtcaaccacaagcgggtggagcgcatgatgcgcgagctcgagatagcagcgtgtctactccgccgcttcgtgcgtaccacgacgcggcaagaggacgcacccctcccagacctcgtctgtcaggacttcgctcctggtgagccagcgcgtcgctctgtgagcgacatcacctacgtccgcaccgacgagggcttctgctacctcgccacggaggtggatctcggatcaggcggatcgtgggctggtcactcgagcgtcgcatgcccgatgggctggtgatccaggcgatccgcggagccctcgggactcggggcagcctgaggtgccccagatttcgtagacacccaggttacttcacgcgagcctcctccgcgacgaggtgctcgaagacgactggggcaaggtagccgatcttcgagcagctgcgctggtggttgtagaactggatgtagctctgtatgccgcggcgcagctcggcgaggtcgccaaaggcgtggcggtagaagaactcgtgtttgaagatcgaccagaaggactccgcgctcgcgtggtcgtagcaggtgccggttcgccccatggagcgcgtgatcccgtgtcgggcacagaaggccacaactcgatggtcgctgaactgactccctcggtcggtgtgccagatgaccccctgcgcgtgggacccacgcaccgcgacggcctggccgagggcctcgagcacgagcgtggtctccatgcgctccgcgacgctccatccgagcacccgccgcgagtgctcgtcgcgcaccacacacaggtatgccatcgcgccggcgagagcgaggtaggtgatgtccgaggtccagagggcgtgcaggcgccccgggtcgaacttcctggcaacgaggtctggtgggtagatcgccttcggatcggcgtgggtggtcgctgggcggaacctcctggggctgataccggcgatgccgcgcctggccatcgctgctgccaccgtgttgtggctcgtcaccacgccagcggctcagagtgccgccgtgatccgtcgtgcgccgtaggtgccagaggatgcctggtggaccgcgaccactcggtcctcgaggtcgcgtctcgcacatgcccgacgcgacggtgctacctgggtgcgtcgccatcggtcgtagccagcccgggagacctcgaggaagcgtgccatccgcttgatcttgaagcgagcgtactccgcctccatcagcgcgaatctctcttgcgtggtggcttcgcggcgaagtacgcggctgcttttcccaggaactcgttgtccttgcgcagctcctcgagctccctgcgcaacctgatgagctcggtgcgctcctgcgccgtgaggggcgggctgccagtggcgtttgctgcttcgatccgcctgcgctcctcccgcacccatcgatagaggttgtgctccccgatcgcgagctcacgggccacctctgggacgctccggccgctgtcgatgacccggtgggccgcctcggtccggtactccagggtgaacttccttctcgacgtccccatcgacctccccttccctctgccatggtacgtgtgacttacgacgtgtcaacggaatctggggcggctcagcctggctggggcgatcttccacagcgatcgcgagtggcgtcccaccaagtggtgtaatttctgggcggcctgcactccaggagggcgggccaccgggcgatctctggcgtgtcagtcaacagctcgccagaggaggtatccagtggccctgacccgttccgactttacccacttgctctggcgccatcagagcgggcggtgacatcgacgtcatccgggagggggtggagctcgtgctccaggccctcatcgagcgagaggctgcggcggtcattggcgctggccgctacgaacgaggcgagggacgccagacgcaagcgcaacggctaccgcgaccgtctgctcgtcaccaaggccggcgacgtggagctacacatcccgaagctccgccgggggagcttcttcccgagcatcctcgagcgccgccgtctgagtcgatcgtgccctctacgcggtcgtcatggaggcctacgtctgagggagtcagtacccgcaaggtcgacgacctcgtcacggccctcggtgggacggggatctcgaggagcgaggtctcccggatcgtcgcctccctcgacgaggagctggcagggttccgtacccgcaggctggaccatctcgagttcccctacctcttcgccgatgccacctacgtcaagggccgcctcgagcaccaggtggtctcccgtgccgtcgtgaccatcacgggcgtgaatgccactggggaccgcgaggtccttggcgtcgccgtcggggatgggcagactgagagcttctcgcccgagtgcgcgagggagctcagggatcgtggcctcagtggtgtgcgcctcgtcagctccgatgcccatcgggggctcaccaacgccattgccaggtgcttcatcggggcgagctggcagcggtgccgagtgcagcgtgcgcgatgtgctcagccgcattccgaaggggagctgaggagatggtcctggccccagatccgcacgatcttcgctcagccgtccccgggagcggtacgtacccagtacgaccaggtcattgactcccttgccgcgaagctcccagcggttgctgccatgctcgccgaggccaaggaggaggtctgcaccttcacgcacttcccggaggcccactggcgaaaaatctggtcgacgaacccgctcgagcgggtgaaccatgagatcaagcggcgcaccaacgtcgtcggggtcttcccgaacgacgccgctctcctgcgcctcgtcaccgcggtcgtgctcgagcagcacgaggagtgggccgttgccgagcggcactacctgtcacaggagtccatggccgagctcgggactgccacgagcgacgacgacacggcgggcacctccgagacgcctcggccccctggcgctcctccggtgctgccgtcgcccgccgaggaagagcctgcagtggtaggctgaggccagccagggagtgaatttacaccactcggtgggacgtgatccgatcgcgccatccagtacctctcccggaaggtccggagcctacttgcgaccctcggcattcgccagtcagtgggcagagttgcgacctgctacgacaacgccgtggccgaggcctgctttgggagcttgaagcgcgagcttgtggctcgctaccgcttcgcgaacctggccgaggcccgctcggccatcgcgacctggatccagcgctacaacaccgtccgcttgcactcgacgcttgggtacctaccgcccgtggagtacgagctctcctgggcctgcagggaggtggccgtggcccaaattcagcctgtcaagcaaatgaggggaagcccacacaggtgaaggcggactcgtttgttggggactgtcaacatcgaggaattcgagggtgccttggtcaattccaacacccagcacatcgccagcgcagccccggcaacgccctcagaccatgcggcatcatgcaccgtctcgagaccagaccctctcgccgcgacgatcaagcgcgatccgaagcgtcgggcgacgggtcggcaccggatggagtcccactcgtgtcctcgtcatcgacgacgccgagcccaccccgatcgcgaagcaggtccgccgccaccgaccgcacctggcggtctcgatcggtggcggcagcgcggagcgcgcggtcggcacgtgggtcatcgaaggcgcacagcgcaaccaccgcccgccgtcgaaccgccggcttgtcgttgcgagctgcgtcgatgacgacgtcgagaccctcgggcgcaccgatggatccgagcgcggcgatcgccgcttcgcgaaccctgaggtcctcgtggacacgagcgctggtcacgagcactgcgacgtcgtcccgatcgccgacctcgccgaggatccaacaggccgcctcgacgacgagcgggtcagggtctccgagcaggccccgcgcacgctgatgcccgatcgcagagggacccgccccccacagcgccccgacgcggacgtcggcgtcgtcgtgagcgagcagccaggcgagatcctgctcatcaccgcggcgtgccagcgcgatcgccgccgtccgagcactgcgtcctcctgctgccaccagggcgcgcagcgtcgataccggtgcatcgaggacatccaatgggttcgcgctactcacgtatcgaccctagcgtcagccgcaggaccgcacgagcggatcggctatccctcgggcgctacctcaccgagcgccgtcccagatgacgaaagaccagcagggcctgcgtcggatgcctcgatggtgtcgagccaggcgtcacttgcggcaactcgtgcggcctcgtcggggatcggcaccaaccgcgcgagcacgagataggcgacggccgtcgcaacgaggcccacgatccaagaaatgtcgaccccaccgagtgcgcgcgcgacgggtccggtgtagctcacggggccgagttggcccagcaccatgaacggaacctccgacgcaaagccaatggcgtacgcgatcaagccccgagcactccaggcaccgtagatcccagttggggtaaacagatcacgaatggcgtagtgaccacgtcggacgacgaagaagtcgacgaggttcgtcgccgtccacggcacgagcaggtagagcatcagcgtcagcgcggtcgcgacggtgttgacggcgttctgggtgatgaactctgcgatcgcgaaccagaccaccgtgagcacgaccgtcacgccaaggcgccaacgccgactcggcgtgatgctccgcacgctgtcgatggcggtgagcagcgtgagcgagccaccgtaggcgttcatccccatcgtggccacgagtgccgccgcggagaggatcgccgtcaccgatccgagtcccccgacgacaccgttgccggcggcacggagtgccgtgaggccgtcttgggcgttgagatgcacggccaaccaagcacccagcgcaatgagccacaccgcgctcgcggaggcaccgaagaagaccgaggcgatcacccgacgcgtcggcgtggacaccgggagatagcgcgagtagtcggagacgtagggcgcgtaggtgatgttgtaggccgcggacgcggagaactccgccatgaacccgacggtcgtgaagccgaggtgggaactcgccacgtggctgccgtgcacggagccaagcagcaccgcgacggacacgatggccatgaaggggaacgacgcgatgagcagagcccgaaaggcacggtggacccagtcatggcccaagatggcgagggtggcggcgatcagcgtcgagcccacggcgacgacctcggcattccagccgtacgcgctcgagagtccatcggccaagagcacctggtcggtcacgttgaaggcaacgtaggtgaacagtgccgcaaacagcacgacgatcacgccgcgatagccgaactgtgctcgcgactggatcatctgcggcagacccaagcgcgggccctgggagccgtggaacgccatgaagaacgtccccacgacgatgcccaacgtgccagcgaggatcgtccaaccgaccgacaatccgagtcctggcccgatgaagccgatcgggatcgtgaagtactggaagttaccgaggaaccacagcggcgcctgatgccacagcttgccatggcgctcccgagtcggcacccagtcgatggagcgggcctcgatgatgggctgcgctcgcgaggcgtcggaatccatggatcgatcctatcaagggcagcatccacgtgaaggcaaaccgagcatcattcgttatctctcacgcaacgatggcccgcgcgtcacggcggcgcgggccgtcatcgcccgccgatacagcgcaggccgacgacgacgccaggcaggccgtgcatcgagggcgtcggtgagcgcctggtcgacgacgagggtggcgacgccaccaaggggcgctaccgccaccgtgccgagcccgtctcggccgccaggagcgacgacgccggcgatcgtggggcccgccccaccgggctcgacagcagccaccgcgacgacgagatccgactcgatcgcccgtgcgagcgagagtcgaaacggcgcacgcggatcgccgtcgcgaggcgcgagttcgctcgtggtgagcgggcgaagcactggggcaagctccgggtcgacccggacgatactgacgaggaggagccacgcgcccgcctcggctgcccttcgggcgatgcgccaatcgaggagaccctcggccccggcgacggcaaccccacccggaaggacgacgggagcatcgttcggggcagctcgcaggtcgctcgccgtatcgagcactcgtcgctcaccaccgggcatgtgcacgagcgcaacgacacgacagccagccacgcgcgaccacggctcgagccacccaagctcgtcgtcgtgctcgacggtgagcgccgggagcaccagcagctcggcggcgttcggctggccttcgaggatcgcacggaggtcctcgacagcgacggggcgcgcaagacgcatcgccccgacacgacgaccgaccgggatggccgaccatcgagcaccggctcgctccgccagcgccgctcgcgaccactcgccagcgctcgagaggagctcgcgaggcacgcccagcgacggtgcggcacggggccgcctcgcctccacgtcggccaggaccacccctgggccatcgcgtgaggcgacgatcgtcccgtcgggtgcgatgatgcagccacctccgccgaagcgcacgccgcgttcggtgcccacacgattggcgacgaccatcgtcgcaccgacatcacgagcgcgcacccaccacgccagcgcgggcgtgcgctcctcgggccacgccgtcggcacggcaaccactgccggatcgcgcccgagtaccgcgagtggctcgggaagatcgagatcggcgcagatgacgaggccgacgatggcgtcacccacctccatggtgacgcccggctcgtcgcctggtaccgcccacaccgtgtcgtcaacccacagatgtgcctttcggtaggtcgcctcgagaccctgggccgagacgacgacagcgctgttgtacagggagccatccggagcctgctcgacgatccccgcgaccaccgtggtcgcttcgcccgcgagcgcctcgacgatcgcagcaaccgtggggccgtcggcaacctctgcgaccgcgcgcgcctcctcgcgagtgagcagatagccggtcacggagagttccggcgccacgacgagagatgcgccacgagcaacggcggccgcgacgcgcgcttggagtcgctcccttccgtgcgctgggtcgagcgctcctgcagcctcgatgatcgcagcgacacgcacgcggacctcactcaggcgcgagtgcgcgcgtcgacgatggccgcgagcgcgatcgacgccgcgaccgaggcgttcagcgaggcgacggtcgccgccaacgggatcgccgccgtgacgtccaccccgcggcggaccaacggcgcgagtccgcgcccttcggcgccgacgacgagcgcgaggcgctccgtggcgagggtgagcgagaagacgctcgtcgcggcgtcggcgtcgagcccaacgctccacaccccgcgcgctcggagtcgacgaagcgcggccgggatcgacgacaccagagcgaagcgcagccactcgaccccaccggctgcgaccttggtgacggtcggtgtgagcggaacgctccggtagcgcggcaacaccacgccgtcggcgccgaacgcggcggcactgcggagcaccgccccgaggttgtgcggatcctcgagatgatcgaccacgacgagcagcgaaccgtcggcgagaccgtcgaggcccacatcgaccaccgggtcgcagtcggcgaggaccccctggtgcacctcggtgcgcgcgacgcgctcgaaacgttctggcggcaggagctccacggggacgccagcgcgcgccgcggcctcgatgatcgcctccggctcacgcccggcctcgacgatcacgcgcctgacgcgacggcgcccagcccggaagcactcgaggaccgcgcgcctcccctcgactcgttcaccgccgagcccacggccaccacgagggtgcacatcagtcctcggcatcgaccacgccttcgagcagcacgaccgcgagcgcagcgacgccctcgccacgaccgagcgcaccgatgccttccggatgcttggccttgacgagcgctggcgccgcgacgacaccctcgatcgtgcgggccatccgggcgagatacggcgagagcttcggtgtctcgcacacgatggtcgcgtcgacctgcacgacccgaagacctcgaccccgcacgagccgaacacagcccgcgagcagctccaaggagtcggctccgcgaaaggccgggtcggtgtcggcatagaggtcgccgatgccaccgatcccagcggcgccgagcatcgcatctgccaccgcgtgacagagtgcgtccccgtcggagtgtgcccgcaggccaggcccaggcaccgtcaccccgccgagcaccaacggccgtccgggttcgtcggagcgcggatgctggtcgagccccaacccgacgcgcacaccgatgagatctcgcaggtcgcgtcgcgtcgtgaccttgcgcgcagacggggacccgtcgaccacctccacggtccagcccagctgctcggcgacgaccgcgtcgtcggtgccctccagccctgagccgatcaccccagccagcacgccgtagtggaagccctgcggtgtctggatcgcgcggaggtgggctcgctcgagcgtgcgggtcacccgaccgtcgcgcacctccttgatcgtgtccgcaacgggaagggccgggacgacgaccgctgcaccgttcgcaagacgggcgatgaccctctcgaacagcgacaccggtgccaacgggcgtgccgcgtcgtgcaccaggacgaactccggcgcgccctcgagggccgcaaaggcccggcggaccgactcagacctcgtcctcccgccgacaaccgtcgtcgccccttcgacgacccgatcgacctccggcgggagcgccacgatcacctgcgacgacaccgcgcgcgcggcctcgaccgcatgctcgaccagcgatcgattgccgagcgcctcgaactgcttcgggccaccgaaacgactcccttgccccgccgcgacgacgagggtggcgaccgccaccgcgccctacgcgagggccttgtcgagtcgagcctccgcttcctcgggcgcgacgtcgagggcgaaggtcagctcggagaccaacacctggcgcgccttggcgagcatgcggcgctccccggccgagagccccttgtcgtgatcgcgcagcgtcaggttgcgcaccacctcggcgacctggtagatgtcgccggacttgaccttctcgaggtggttcttgtagcgccgcgaccagttcgcgggcatgcgcacgtccttcttccccagaacggcgaagacctcttcgacctcttcgtcgttgatcacctcgcgcaggccgacctcgtcgacggcgtcgacgggcaagcgtacggtgagatcgccataggccaccgtgacgacgaagtactccttggcctcaccgaaggcctcgacgacctcccgtccggtgatcacagcggcaccatgctgcgggtagacgaccttgtcaccgacgtcgaatggcacagcttcctcactttcccgacgccctcgtgcgcgtcgggctcactcgtagcgcttccagtataccaggtcgatcagggtgaaagtccaggtcacctggctattcgtaggacctgaggtgagccacgaccgccttggcccagtcgggatccacgccagccacggtcgccagctcgtcgggttccatgctcgccaacgcatgcagcgaaccgactcgctcctcgatacgcgcggcgatcgatcgcggcagccgcggcacgtggtgcagcagcctggagcccttcgacggcaggttcacgccgaggagctcaccgtcgtagagatcctcgtgcgcgagcgagacgcagcgcgcgcgctcggcgacgtgacgcgccagctggacgacgttcatgagctcgtcgagatccagcgacgccaagagctccttgatgtcgcgcacctcgccctcgtcgcacacccccagaaagtcccggaggacatcggtgtagtcgcggtcgaagtcgagggtgatctcggccgcctgcagtgcgacgaggcgtccgtccgcaccgagttcgaccagatagccgtcgatctcctcccgaatccgacgcaccatctcggctcgctgcagcacgaagaccacgtcgcgcaagctgacctgctcgcgcaactcgagcccgttcagttgctcgagcacctggtcgaggcgcccccgatagcgctcgagcgtcgagagcgcctggttcgcgcgcgagagcagctgggggatgggctgcagcgtgcgcttctcgcggcgtcgatacacggagatcaccgacagctcctccgagaccgccacgaccgtagcgtccacgctctctgccacacgctcggcggtacggtggcgcgtgcccgtctcactggtcggaaggcgtggatcgggcacgaggtgcacgttcgctcgcacgatctgcgacccgtgcgaggacaggatgatcgcgccatccatcttggcgagctcgaacagccgctgtggggtataggcggcctcgatgaggaagccgccggtacagagctcgaggacctcgggcgaatcgcccagcacgacgagcgctcccatgcgcgccagcaagatgcggtcgagcccttggcgcaggggcgtccctggagcgacgctccgcagtgcctcctcgatgcccgcgccttccacgctgctccctccgtcagacgcaggaaccggcaccccggtcgcgctctcgaagcctcgtggagcgcgccgtgcgacagcgcgctccaccgactactcctgtgggttcgagccggccagctccatcgggggcggctcgagtccctccatcacccggaagacgatctcctcgccctccacatcgacgaccaccatgtcgcccgccttgaactcttggtgcaagaggcgctcggcgaggggatcctcgacgagtcgctggatggtacgccgcagcggtcgagctccgagttctcgatcgtaaccacgatctgccaggaagcccttggcggcttcggtcagctcgatgccgatccccttcgcctggagctgatcttgcacccggcggaacaagaggctcacgatcgccatgacctcgtcgcgacgaagctcgtggaacacgatcacctcgtcgatacggttcaagaactccggcttgaagtgcgtcttcagcgcctcgttcagccgcatcttcatccgctcgtggttgacgtcctccgaggacttcgcgaaaccgacctgggcgcggtgcaggtcctgcgtcccgaggttcgacgtcatgatgaggatggtgttcttgaagtcgaccgtgcgaccctgcgcatccgtcaggcgaccgtcctcgagaatctggagcaaggtgttgaagatgtcgggatgcgccttctcgatctcgtcgaagagcacgacggagaacggccgacgccgaaccgcctcggtcagctgaccaccttcgtcgtagccgacgtagcccggcggcgcaccgacgaggcgagcgaccgtgtgcttctccatgtactcgctcatatcgagctggatcagcgcgtcctggtcgccgaagaggaactcggccagcgtcttggcgagctccgtcttgcccacgcccgtcgggccgaggaagatgaacgagcccgatggacgacgggggtccttcaacccagcgcgcgtacgacggatggctcgagacaaagcgctgatggcttcttcctgccccacgatccgatggtgcagctcgtcctccatgcgcagcagcttggaggtctcttcctcggtcagctggttgaccgggatgcccgtccacatcgcgaggacctcggcgatgacctcctcgtccacgacgccgaaacgctcatcgccctcgcgcttccacgccgcctcgagctcggccttgcgcgagacgagctcgctctcgcgcgccgccagccgcttggcttcgtcgaagttctgacgggcgatcgcgccttccttgtcacgacgcgtgcgggtgaggtcgttctcgacctgtcgcaactcgggcgggctggtgacgcgcttgatgcgcagccggctccccgcctcgtcgatgaggtcgatggccttgtcgggcaagaagcgatccgagatgtagcggtccgccatgttggcggcggccaccagcgcttcgtcggtgatggtgacgttgtggtgggcctcgtagcgctcacggagacccttcaagatctcgaacgtgtcctcgatcgagggctcgccgaccttgatcggttggaagcgccgctcgagcgcagcgtccttctcgagatgcttgcggtactcgtcgatggtggtcgccccgatggtctggagctcaccgcgggcgagcatcggcttcaggatcgacgcggcgtcgatggctccctcggccgcaccggcaccgacgagcgtgtggatctcgtcgatgaagaggatgatgttctccttggtgcggacctccttgaggaccttcttcaggcgttcctcgaagtcgccccggtaacggctgcccgccaccagcgcaccgaggtccaaggtgtagatctgcttgccgcgcaaggtgtcgggcacctcgccagcgacgatgcgctgcgcgaggccctcgacgatcgccgacttgccgaccccaggctccccgatcagcaccgggttgttcttctgacgacgcgagagaacctgcatcatgcgctcgatctcgttgtcgcgaccgaccacggggtcgagcttgcggtccctcgccatctgcgtcaggttccgaccgaactgatcaagaatgggcgaaccaccgggtgcgtcttgcccctgggacggtccggccccttgaccgaccgtggggcgaccctcggtcgacgacaggatctgcatcacctgctggcgcaccctggtgaggtcgacgccaagcgcgagcagcaccttggccccggtcccctcaccttcgcgcacgaggccgagcagcatgtgctcggtgccgatgtagttgtgaccgagctggagcgcctcgcggagcgagtactcgaggaccttcttcgctcgaacggtgaatgcgggggagttcggcgtcggccctggcgacggctcggactggcgcgtcacctcctcgcgcagctggtcgagtgagacacccagcgattcgagcgccttggctgcgatcccttctccctcatgcacgagacccagcaagatgtgctcggtcccgatgtagttgtggtggaggagcttggcctcctcctgcgcgagcacgagcactcgacgtgcccgatcagtgaatcgctcgaacaagtctctcgcctcctcgatcggcacctccgggttgaggacccttcgactccgatctggtacctggttccttcattctacccgcaacgctcaacatcgctcgaacatgccttgacgtcggcatcggcagcgccaggctgaaccaccgagttgctccagtctgccacggacagctgggctgtgtctgtgggcaggctcgacagttcgctcacggagtactcacgagaccgccctcgatgtcgccgagcggcagccatcgccgggcgcgtgcacgaggaccaaccaggtcgcattgaccgcgaacacgtgccagatcgcaccgaggtgcgcctccaaccacccgaccgcggcctgcggctgggcaagcaggctgcgatcgaccacgatggagcacacgtcgtggcgggcaaggtaccccggcagctcgtgggccgcccgcgatgccagcgacgcgtcgggttgggtcggttgggccacgctccagagatagccgaggacggcggagtcgttcaaccgagcgatcgtctgcgcgggcaggcgtgacacatagccctcgggcgtcggggtcccgatcacggcggcctcgtagggatagagcgcgatcccagctgcccaggcactctgggtcgggatgaccaccggcacgtagaacgtggtgccaccgaccgctgcgatcccgcggggacgagggaccagcgggagcgcagtgtcggggaacggcgtcggcgccgaaccgacccagagcgccaccgcaacggccgcgacgagccccgcacgcaacagccggcggtggcgacggcgcccgagcgcaacccagacccactcgagcaccgctgcgccgagcagtgccccgaacagcgccgtgagcaccgcgagacgctccggcagggtgtcggacacgaacgggatcgcatcgaagggcaggtacggaagcgggatcggcgtcagcaccccatcgacgtggaggtaagggcccatggacgccagagcgaagatcagcatggcgagcccgagtggcaggatcaaccgctcgagccgaggcgcgagcggaccgtgacggcgctggcgtacgacgatcgcgacgccaccgacgaggccgatccagggaccagcgccagggaagcccgagccgtccgcgaggttcggggcaaggtgccacacgggggcgaggaagtggaaggcgccccacggatcaggcacaaagaaggacagcgcgtcgaccacccacggggtcgagaagggcgtctgcgccccaccgtgaaccgcgagcggactcagcaggagtgcgtcgaggagcggcgcgacggcgacgacggcgacaacaccgaggacgagccagccccgccaccacgccacgagggtcgcgagacgcctcgacgcgagctgcggatgcacgaaccagagcaccacgatggcagcgatcgcgtagatgccgtagtcgtagacgctccagaccacgagcgccaggagcgcgccgagcacaccgaagcgccagagagcgggatcggcacgatcgaagaggtcgaaggcccaacccaccaccaacgcgagccctgccccgtcgaccaggttgagatgcccgagcatctggcccatgaagaacgggctcgcgaggtagatcgcaccggcgacgagggccgcgccgcggccgagcccgacgcgacgcgcgcaccacgccgcagcaccaccgtcggcgacgagggacccgaggagcgcgaggttgtaggcgaggaccggcgtcgcaccgaggtgctcgagcacgcccgcgacgatggcggcaggcagcgcgagggtggcccacgcgaggtccgcacccctcggatagagcacctggtgcgtgaggaagagcccgtgggcaccgaccagccagcccgcgacccagtggatgtaccacagaaactgcggcgagtcaccaccatcgccgatcaccctcgacgtcaggtgagcgccaccgggccagctgagcaggagcgcctcggcaccatagatcacgacgcacgccgcagcgaaggcgagctgtgcccacgttgagccgcgctcgcgcgcttgccgtgtcccgatccgtgccgccgtcgacgacgcagacacggtgtcgtaggctgacattcgcgagatactaccgaacaccacggccgctggcacgtggcgcggggaccaaggacccggggccacacggacccgacgggctctagggtggacgaggtggagcatccgttgccgctcggtgagccgtgggcgggtccgtacctccaggcggtcgaggaagggctgcgtcgagcagcgaccacgaccgatccggacatcacggcggccgccctgcacctcatcatggccggcggcaagcgcgttcgaccgctgattgcgctggcgacggcccttgcactcggcgaggtcgcaccgtctcccgacgaccctgtcgtccgcggcgccgtcgcggtcgagctcgtgcacctcgcctcgctctatcacgacgacgtcatggacgaggcttcggagcgtcgtggggtctccagtgccaacgcccggttcggcaacctcatcgcggtggtcaccggcgacttcttgttggcccgcgcggcgggcatcgcagctcgcctcggtgaagaggtagccgcggcgctcgcggacacgctggccgccatgtgcgaggggcagatcctcgaggttgccgacgcgcaccaactcacgcgcacgaccgagcgctacctcgcgaccatcgcgggcaagaccgcgtcgttgatggggaccgcggcccgcatcccggccatcgtcctcggacgcgaccaagcgatgctcgatgccctctcggctgctgggaccgcgctcggcatgctgttccagctccgtgacgacgtgctggacctcgtcgcgacccgcgagcaactcggcaaggagccggcacaggatctggtggaggggatctacaccttgccggtgatcctggcgctccacgaccccaccgtgcgcgaggccctgctggacgtgctcccacgagccgcagaccccgaaccacgagccgtcgcactcagcctggtccgtcgcagcgacggcatccctggcacgctcggccagatgcgcaggatcgaggccgatctcgatgccgtgctcgccgacacgctcggcatgtccgattcgtggttcggtcggctcgctcgcgcgctcgtcagctcagccgagcacctcgcagccgcggtaccggcacccagcgcactcgcctgagcacccccggcccagtttccaccggtcccaccaagagcatccgcgcatcagctcgcggcgccagagctccgacgtcgccgaactcacggccgggcatacccccgtcggaacgccccgtcctcgggcgcccagctcagtcgagccgacgagcgagcgagccgaccgacgcccggggtgcgccggcgacgagagcagccccgtcacgcggtccatgcgccgattcgctccgcgaccagcgccgctcgtctcctcacgccgtctcgtcggatgcgccatcctcgtcgacatcgctctccgaggatcccgcctccggtcgcagggtcgggaagagaatgacctccttgatgtggcgctgccctgtgagcagcatggcgagccgatccacaccgaggccgagaccacccgtcggtggcaggccatactcgagtgcccgcacgtagtccgcgtcgtaggccatcgcctcgtcgtcaccggcacggcgctgacgagcctgctcctcgaagcgagcacgctgctcgtccggatcgttgagctcgctgaaggcgttgacgagctcgcggcccccgacgaccagctcgaagcgctcgactcgccccggtcgcgaccggtgacgacgagcgagcggcgagacggactcagggaagtccagtacgaacgtcggttcgatgagtcgcggttccacgagctcctcgtagagcgcgaccaacgcccgccccgcctccggctcgagcacggcaagatcgaaccgtcgagcgaggtcgagcagtcgtgcgggctcgtcgaggctgacccgctcgccgaccgcctccgagacgagatcctccatcgtcgccgcgcgaaacggcggggtcagatcgatcacaccgagctcgttctcgccgcgggtcgacccgaagacagcgcgcgctgcgctcgcgagcagcccttccgtgagctcgcgcatcgcgtcgatgtcgccgtaggcctggtaggcctcgagcatcgtgaactcggggttgtggcgaggcgagataccctcgttccggaagtcccggccgagttcgaacacacgctcgatcccgccgaccacaagtcgcttgaggtagagctcaggggcgatcctgaggtacaggtccatgtcgagcgcgttgtggtgggtcacgaagggtcgagcggccgcgcccgaggcaatgggctgcaagatcggcgtctcgacctcgacgaagccccgtgcgtcgagttcgtcgcgaagggctcgcacgagtcggctgcgggcgaggaagcgctcgcgcaccccggggttggcccacagatccacgtagcgctggcggtaacgcacgtcgggatcgcgcacaccccgccacttgtcgccgaacgatcggcgcgcatgcgcaagaagctggatccgatcaacgaggacggagcgctcgccggtcctcgtggtcgcgatcacaccgtcgacgccgacccagtcgccgagcaccagggaatcggccagcgtcgagaacgcctgggtgcgatcggcgcgcagccagagctggatcgctccgctcgcgtctcgaagctccccgaacgccatcctcccttgccgcctgaggcgcaagatccgtccggccacccggacctgctgatcggtgacggtgtcgggcgcgagaccctcgctccgccgtcgcacgacatcgacgggctccaccccgccaaaggcgtacggaggcacgaagagcgctgcggtctcagcgtcgggcgctcgacgttcatctgcgctcatcgtccgtcctctccaccacgccccagagacgcaaggagtctaggctcgagcccgccgtccctggttgcgcgcccagacgagccgcagcccgtggagcgtcagccacggctcgatatgcccgacgacgggcacctcgcagccgatgacctcgcacagcccgcccgtcgcgacgaccggagcctcggctccgatctcggcacgcatgagctccacgaggtgggtgacctgcccgacgacaccgttgatcaccccggactggatcgactccaccgtcgaacgaccgatcgccgccttcggccgccgtagctcgaccttgcgcagcgccgcagcacgcgccaccaacgcatcgagcgcgacgaccacccccggcgcgatcgcaccgccgaggtaggcaccgctcgcatcgatcgcatcgacggtggtcgcggtgccgaagtcgaccaccagcaccggcgcgccatagagctcgaccgcggccaccgcatcgaccacgcgatcgggaccgacctctcgtggatcgtcgtagcggatcgggatcccgacccgcgtccccggtccgaccacgagcggacgaagcccgagatgcccctcgaccatgtccacgacgcttcgggtcacgttcgccgccgaggatgcaacgatcgcgccgacgagcccaccgacgaggtggtggcgatcgagaaaggtctcgacgaggatggcggtctcgtctgccgtgcgatcggcgcgcgtcgccagccgaaggtgcgcgacgagtccctcctcggccgtcgtcgccgcagcctcggtgtcgtagacgccgatcacggtctcggtgttgccgacgtcgatcgtgaccacgtgctcagccatcggcgcctccgatcgcacggttgtcgatgagccggacaccctcgacgcgccaggcagcgagcacgcgagacgcgggcgtgagggcccgcgtcggctcgagcaggggcggttctgcgacctcgacgtagtcgagatcgacccccccgagatcggcgagcaggcgagtccggaaggcggcggcggcgtctcccacacgagcactcgcgcagtgacgcgcgaggatctgggcgacacgtcgcgcctcgcggagcccgaccggcgagagccgccggttccgcgacgacagcgcgaggccacccggatcgcgaacggtctcgaccgcgacgacctcgacagggaggtggagctcggccaccagccggcggaccacgagcagctgctgaaaatccttctcgccgaagtaggcacgagtgggagccgtcaccgtgaacagcttcgtcacaacggtcgcgacaccgtcgaagtggccaggacgcacggcaccctccagccgctcggtgacgcccccgacgcgcaccgagacgaggatcggactggggtgcaactcctcgacgacgggtgcgaacacccagtccgcaccggcgtccacggcggcacgcacgtccgcctccagggtccgcggataggccgcaaggtcggtggggtcgtcgaactgcagcggattgacgaagacggagacgaccacgacgtcgtcgcgctcccgcgctcgccgaatcagcgcctcgtgcccctcgtggagcgcacccatcgtcggcacgaggccgatggcagccccggcgtcccgggcaggtgcgagcgcctcgcggagcccggcgacggtcctgatcagcgggtccacgcgcaccccgcggcatgagcgacgacgggcggtcgctcgaggtgggccaacgatccccccgccaacgaccgcgcgagggcggcgtcgaggtccgcgagcggccacagcacgaacgaccgaccgaacgcgcgcggatgggggacgacgaggcgcggaggcgagctcacgacgacgccgtccatccacaccacgtcgagatcgagcgtccgaggagcgttcgggacgctgcgttggcgaccgtggcgcgcttcgagcgcgagcaagtcgtcgagcaggcgaaacggcgaacggtccgtgcgcagctcgcacaccgcgttcaggtaccgcggttgcgcccccggcccgccgaccggctcggtctcgtagaggttcgacaccgcgacgacctcgccgatggcgccgagcgccgcatcgagggtccgcgctcggtcgccgaggttggcgccgagggcaacgaaagcgcggcgcctcacgagcgctcaccgccatctcggacccgcgtcacgaccacgtgcaccgtggccccggccagtgccagtgggggggcgagcttggtcgcacgaacggtgacgcgctcgagctgcgcccagccgagcgtcgcaacgatggcgtcggcgagccgcgccgcgaccgtctcgaccaaggcacacggcgtcgcaaggacctcgggcacgaggcgatcgagcacgctgtagtcgacggtggtggcgaggtcgtcgccgatcggctcctcggcgacgacgagttcgaccgcaagctcgaccggctgcggcagggaccgctcggcctcggtcacgccgaggtgcgccggttgcaccatgccctcgaccgcgatggtcaggcccactcgcgcgccgcctcctccatggccgcagcgagacgcaggtactcacggatcggccgtactcggtgcacccgcaccacgtccgcaccgtgctcgatcgcccagatggccgcggcgaggctctgctcctcgcgctcgagcgggggcaacgcgggctcggcacgactgagctcggccagcatgctcttgcgcgagaggccgacgacgaccggtgcgccgagggacgcgatttgacgaaggtgcgcgatcagcgccaggttgtgcgcgaccgtcttgccgaagccgatcccgggatcgaaccagacctccttcacgcccagcgcacgcgcctcgtcacgtcgctccctgagccacgccgacacctcgcccaccacgtcggtataggtcgggttgacctgcatcgtctgcgggtcaccctgggcatgcatcgcgatccacaccgcaccgacctcagccgcgaccggtccgagtcgaccgctcacgtcgttgacgatcgtcgcgcctgcctcgaccgccgcccgagcgacggcgggcttgaccgtgtcgatggagacgaccccgtagggagcgagcgccgccacgaccggcaggacccgacggagctcctcggtctcgggcaccggcaccgcgcccggccgcgtggactcgccacccacgtcgacgatgtcggccccctcggcgaagagttcgagaccgtgctcgatcgctctggccgcatcgaagtagcgaccgccgtcactgaaggagtcgggcgtgacgttgacgatccccatgatccgagcgtcgcgacgctcgctcatcggggcggccgtcctcgctcgagctccgcgagcgcgttggggctgcccacctccctgcccgccagcgcctgggtcgtcacgatcacgccctcgcgtcgcaccccccggatggcgatgcaggcgtgctcggcccgaacggtgacacggacgagacgcgcccgggccgccttggcgatcgcatcggcgatctcctgcgtcagccgttcttggagctggaggcgacgagcgtgccgctcgatctctcgcaccacggccgacaggccgaggaccccagctcccgggagatactccaccgagaccgtgcccgtaaacggcaggaggtgatgctcacacagcgaggcaaacctgatctcgtcgaggacgacgggagcccgctgctcgggcgcgaaccgcaccggatcgtcgggctcggcccgatacccgccgagcagttcggccagtgcctcgaccacccgctccggggtgcgcgtgcgcacgtcgtcggcgagcgtcgcaccgagggtggcctcggcccacgcgagcagcgtgtccacggccgcgcgagcgtcgtcgttcgtcggtgcgctcatacgtcctcccgataggtcgcgatgaacgggaggttccggtagcgctcggcgacgtcgagtccatagccgatgacgaaggcgggcgggatgtcgaagccgacgtaggcgatgggcagatcgcctcgaccgtcgtcaggcttgcgcaacagggcgcacacggcgagcgacgccgggttgcgcgaggcgaggttcgtcaagaggtagcggagcgtgaggccgctctcgacgatgtcttcgaccacgatgacgtcgcgcccttcgagctcgacgtcgaggtccttgatgatccgcacgacacccgaggtccgcgtggcactgccataggaggacaccgccatgaagtccaccgcgaccggcagctcgatcgctcgtgccaggtctcccatgaacacgaacgcacccttgagcacccccacgaggaacggtgcgcggcccgcgtagtccttggtgatcgccgctccgagctcgccgacgcgcgcacggaggtctgcctcactgatcaggacatcgccgatgtgcgggtcatccagcgaccacgtcacgggcgcctcccttcggactcgagcccgagacgggcgatctctcgcccacctgagcttaggacgagcgacgagcccacgcgtcgcacgtcgaggtcgctcgggagtgcatgcgctcggcgagtaccatcggcgacctggacgagcgcacgccgatgcgccgccgacagtcgaaggcctgtctggtgtcggacccacgtcgcgagctgggtcgtcgccggcgcgagctccgggtagcgcgcctgcaggcgcacggcctcgcgggcgtgcgccgccgcgcgcgccagcagcgggacgacgtcacgctctgcgatcgcggcggcgagcgggagcagctcggtacgcacgcgcacgcgccgaaagcgtacgtcctgattcatgggatcgacgagcggcacgagtccggcggcctcgcagacgcgcgcgagctctgagcgccgaaggccgagtgccgggtggagggggccgggctccatggcgccgataccgacgagcccgctcccccgcaggagattcagcagcaccgtctcggcttgatcatccatcgtgtgtgcccgggcggcgtccccgagggcgccgaggcgggccgagcgcgcgcgcgcctcgaggttggggccagggatcacgcgcacacggcgctcgagcaccgagatcccgagcggagcgagctggcgggcgacgtcggctccttctcgggccgagcccgggcgcaggccgtggtcgacgtggatcgcgaggacccgcttgccaccgaacgccagcagcgcagcgagacccagcgagtcggcgccacccgagacgccgacgcggaccgggtcgtcatcgagaggccacagccgctcaccgagcgaggcgagatcgatgccgagctcacgagctcggcgctgggcagcctcgacccacgacgggctaggccgcaccgaccctcgccagccacgtctctggcgcgtcgagctcggcaagcgttgggagcgactcggcgcgttcgaacacgtcgagcgcgctgccaggccgttctgcctcgatgcgctcaaagaaccgacgaccgcgctcgtactggcgagccttcgcgtcgagtccgaggagtcgcgcgacgatgcgcgcgagaccccgcgcactgcgacgctggtcgacgacacgagccagctcgtcgtcacccggcacggtccccgaggggagggtccgcatgacccagtccgcgtggccctcgatgacgctcatgatggcgctgacacgagccaacgaggcagcagcacgttctgggaggaccagctcgagtggcccgagctccccgaggcggcggtcgccacccaaccagctgagcagcgaactcaccgcatcgaccggggtcgccggtcgcgcagcgatgacctcggcgagcgatgcgtagagcgtctcgagcagccaggggcgcgcgaagaactgcgcccgatgggcgagttcgtgcgagagcacccacctcgccaccgtggcgagatccgtcccagcccctgacgcgagatgctgggcgttctggcctaccagcacgagcaggggctcttcgtcgccgccccccggcacgtactgccccagaacgcgaggcgagagggccgcgagcaccgcgccgagcatggctccgctcacctcggccgcaccagcgggtaccccctgcgggtacaagcgaccgatcaaggctgcgtaggaacgcgcattgtggatcgcccacgcgcgccgtgacaggttcgcgaccgcgagggtctccgttccgatctcgagcccacaacgagcctcgacgatgggggcgagctctgccaccaggccaatcagatcgagaggcggcggcgctgtgtccgggacgagcgctcggatcgacagcgtcgccacctggtgcgacacggggctcaccatgagctgagccccgaggaaactacccggccttgcgctgaccgcgggttcgcgacgccccgatgggctgatgcgcgtagcagtacttggacttgttgtaaatggagagcgtcgtcgtacaacccggctccttgcacacgcgtcctcgctggtaggtgcggggtgcgtgcccagtcgccagaggttccgcgacgatcgtctcttcccctcggctcaccatgtccagagcaacccacgatgccccccgccctattcctgtcgcgcgtcggagacgtggcggtccttggccgattcctcaaggaggaccatcgcgagacgctcacgcagcgaggtcggaacccgatcgcgtgctcgctccgcgatgaccatgcgcagctcggcttcgaactcgaacgcctcgagacaggacccacagtggtccagatgggcttggagcttgtgccggcgttcgtcggtcagctcgccatcgaggaagaagtacagctggctgatcgcttcccgacactcgggcgtggacggaccccgagggtcgggctcgatctcatgacccttgtgctccggaccagtctcgctcgtcaccatctacgcctcggtctccgctgcccgctccgcacgagccagtcgcttctcgatcaacgcgcgctggagcgcgcgccttccccgatgcagccgactcatcacggttccgagcgggacgtccatgatgtcggcgatctcacggtagctaaaaccttcgacgtccgccaggatcacggccaagcggaactgctctggcagggcctcgagcgccgccttgacgtcggcatcggtgaaggtgtcgaggacctcctcctcggcgctccggcccgcgagggctgcctcgagaccgcccaggcggcgatagaggtagagctgctcgacctcgtcgaggtccgtctcgtccgggcgacggcgacgagctcggtaggcattgatgtaggtgttggtgaggatgcgatagagccacgccttgaggttggtgccctcctcgaaggtaccgaaggcacgataagccttcaggaacgtctcttgcaccaagtcctcggcgtcggccgcgttgtgggtcatacgcatcgccgcggagtagaggttgtcggcgtacggcagggcaagctcttcgaagcgcgcctgatccgccacgtcgcctcccgtcaccagccgagcccgggaggggactcgaacccctgacctgctcattacgagggagctgctctgccgactgagctacccgggcgccgagcgaccagtgtagccatgtgccggggtgggacgctcgagcacgagctcggcgagcaccagaccgatggagagcctcctcgcgagcgagccgctcgcgcgccgcaccgcctgaccccaggaagcatccatcgggttggctcgaatcgcgaccgcgagtccgagccgtaccaacgcctcttgcgtcggagccggcaacgagctcggcgggcgaagcgacgctgcgatctgggccggatgggcatgggccgcaccggtcgcgagcgcggcccaacgctcgagccacgtccccggctcgggaaccgacccgagcgtgtggacgagctcgagatcacgcggcacgagcgcgaggagacgcggcgagagctcgatgcccgcgtcggcgacggcagcctcgatctcggctgcgctcggaggatcgacctggacgcggacgcagcgcgacgccatcgccgtgagctcgggagggatggcgctcgccgcgagcaaccaccgcgtccgcggccccggctcctcgagcgccttgagcaccactggcgctaccgacgccatgcgttcgataccgacgaggccggcgatgcgccagcgatcggcactctggcgtgcgtgcgcaacgagggcacgaacgtcggcgatcgacggggtgtcactgaggatgcgcacgtcggggtggcgtccctcggcgaccgcactgcacaccgagcactccccacagccgccgcgcggacaggtgaggtactgggcggcgaccaccaccaggtcggcgaggccactcccccgcgcgcccaccagcagcacaccggctcgcgatgcatcgagcgcacgctcgatgcgctccgtggtgtgcggacgccagcgtcgaatgccctcagcgacgcgcgtcgtcatcgagcccgagctccgccatgatcatcgcctgcacccgagccgctaccgcgtctcgcgagccgttcgcgtcgacgagccgccatccccacgatcgcgcacgatcggcgtagcgcgcccggatctgctcccacgcggagcggccacccgcctcgaaccggtcgccggcgtcgaggccgagcggctcggcacgatcgaggacgaggacgagatcggcgaccggatcgccggtcaacgcctcgagggcccagatcgcatcctctcccaccttcgggccctggtagacgatggtcgaagggaagtagcgatcgaggatcacgtgcgtgcccgcctcgacggcggggcgcaccaccgttgcgacgagctgtgcacgggcggcagcgaacgtgagcagctcggcccatggtgcgagcgaccgcgtcttgaccacctcgcggagcgcctcggcagcggggtcgccacctggatctctcgccgtgaccacgtcgacaccgcgggcacgcacggccgcgaccgcgaggtggacctgcgtcgacttgccgaccttgtcgggtccgtcgaggaccacgagtttcccccgcgtcacgagccagatcccaagcgcgcacgccgctcggccaagagctccaccgccgtgtcgagatccaagctggccggatcgacgcctcgcggcaaggaggcgttcacctcgccgtcggagacgtaggggccgtagcgacccgaacggaccacgacgcgcgcgccggtgtccggatgggtgcccaactcgagcacgctggccgagcgaccgcgccgcttgggctcgcgaaagcgcgcgagcgcttcggtgagatcgatggtgaagagctgctcgggcttgtcgagcgagcgggtgtcgcgacccttggcgagatacggaccgaagcggccgttgtgcgcccagatctcctgctgggactcggggtcgaccccgaccaaccgcggcaaggacaagagcgcgaccgcgtcctcgtagctcagggtctcgacccgctgccctggcagcagcgatgcacgccgcagcgagcgatcgtcgccctcgccgagctgcacatagggaccgaaccggccggtacgcaggagcacgggttgcccgtcgagttcgccgagcacacgatcgccgagcctgccccgctcgagcagctcctcggcccgctcgagggtgagctcgtcgggagggaggtcctctgggatggaggcggtctcctcgcctgcctggaggaacggtccgtagcggccgacacgcaccacgaccggcgttccatccgcgcgctggccgatcgggatcgagttcacgtcgcgtgcgtcgatctcccccagtcgctcggtgacgagctgatggagaccgggggcaccgttgccccagtagaaatgcgcgaggtagggcgtgggctcctcctcgccgatcgcgatgcggtcgaggtcgtcctcgagacgcgccgtgaaggagtagtccaccagctcggcgaagtggcgctcgagcagctgcaccaccgcgaagccgagaaaggtcggaatcagcgcttgcgagcgtcgccatgcatacgagcgctcgacgagcgtgctgatgatctgcgcataggtcgacggccgtccgatgccacgctcctcgagcgcgcgcacgagcgatgcctccgtatagcgcgccggaggctgcgtctcgtgcccctggggctgggcacccgtcgtggtgagcgcgacaccagcggccagaggcggcaggtcgacctcgtcgtcctcgctgagttgctccgggtagaccgcgaggaaccctggatcggtgagcgtgcggccacgagcgacgaacgtcgcccgctcgatctcgcgaccgtcgatgcgaacctcgggcccgagcgcgacgtcgatcgtcgcgacggcggacatcccgcgggcgtcggtcatctgggaggccagcgtgcgacgccagatcagctcgtagaggcgcgcctcgtcgccgggagcctcccttgccacctcgtccggcgagcgccaacgggtacccgctgggcggatggcttcgtgggcctcctgcgcgttcttcacacgcgagcgatactgacgcggcgcgtcggggagtgctcccgggaagcgctcggcgatgagtcgacgggcttctgcgagcgcctctccggcaagctggacggagtcggttcgcatgtaggtgatgaagccctgctcataaagccgctgggccacggccatggtgcgctgcgcggagaagcgcagttttcgcgaggcctcctgctgcagcgtcgaggtcatgaacggcgcgtccggtcgtcgcgtgaacggccgctcggtgagctcgcgtaccacgccacctcgaccctcgaccgcttctgcgaccgcgagcgcgtgcgcgccgtcgaggaccacgacgcccgtggcgacgcgaccggtcgcgtcgaagtcgcggccggtggcgatacgcgcctcgtcgagggcgaccaggcgcgcggcgaagggcgcgggggcctcggcacgcgagaactcggcgacgacgtcgaagtagctcgctcgacgaaacgccatccgctcgcgctcgcgctcgacgaggagccgacaggccaccgactggacgcgaccggccgacagtcgcggcatcaccttcttccacagcaccggcgagacctcgtagccgaagagccggtcgagcacgcgccgtgtctcctgggcatcgacgaggccgcggtcgatcccccgtgtcgccccgacggcctcgcggatcgctcgctccgtgatctcgtggaacaccatgcgacgaacaggaacgcgaggggcgagcacctcgagcaggtgccaggcgatggattctccttcgcgatcctcatcggtcgcgaggaagagctcgctggcgtcggcgagcagggccttgaggcgcttgacctgctcgcgcttctccggagggatcacgtagagcggccggaacccgtgctcggtatcgacaccgagacgcgcccacggctccttcttcaccgcttgcgggatctccttcgccgagcgcggcagatctcgcacgtggccgacggacgcctcgacgacccactcgtcgccgaggtagcgccggatcgtccgagccttggtgggcgactccacgatcacgagtggctttggcacgaaccgatttgctcctcgctaggactcctggtgggccggctcgaggaactcgtagctcgggttcatcatcgcgagccgaccctggaactcccctaccgtacccgctgcgcggatcgtcgcaccggcggcgatccccggtacctggcgacggccggggaagacgaggaggataccaccggtggcgtcctcgagccgcgccacgctcatcggcatcccatcgagcgtgcgggtgcgcaccgccgcgatacgccccacgaccgtggcctggcgccgcggcgtgcaggccgagacaggcgtggtgccgtcggtgagctcgggcgccttcgtccccaacgtggtgcggcgggccttcgccgtgaccgtcgtacgggcactgcgcgtgcggactcgatagggtacgaggatggccgtggcgtgtggcagctccccgacgacttgggagatctgcaccgccgactggtcgtggagcagcgggccgaggatccgcccgtagacacggtgcgggatgatcgctgagacctcgacgtcgctgcctgatgcgaccgcatcgagcacgacctcggccgcgcctcgccgaaggcggcgatccgggcactcgacgagctcgagctcgaggttcgccaagcctgcctgctcccactcggctcggagcgtcgtcgcctcctgtgcatcgacgacgaggtgcacggcacgcagcgcgtcgggcaggagcagcttggcgtactggaccgcccgcgccgtggcgagatcgacgcgatcgacgaacagcaacaccacgtgcgtccgagcggccggagcctcacaggccgccgccaccccctcctccagggcggcggcctcgcgctcgaagcgacgacggaaccgcgtgaacatgaagaccagcagtgggacgacgacgacgaccagccaggcgcccgaggtgaacttcgtcacgatgaagacgatgtccacgatcgccgacaagatggccgacgatccgttgacgatcgcccgccggcgccagtggtcctccttgtggatgaggtggtagcgaaccatgccgctaccggcgatggtaaagccggtgaagacaccgatggcatagagggagatcaacgaattgatgttggagttcgttgcgacgaggagcacgatcgcgatcgccgcgacgatcacgatcgcggtcgagtagaccaaccggtggccacgctcacggaagcgccggggcaggaggccgtccgtcgccgcaaacgacgcgagcaacgggaatcccgtgaacgacgtgttcgcagccaaggtcaagatcgccgtcgtcgagatgtcgaggatcaccgtgaggacgtgaccgaccgaactttggccaaaggccgcctgcgccacctgcgagagcacggtcggcgctcccgagagatacggcacggcgtgggtcgtcgcagccaggccagacaccccgagaaagagcgtgccgaggatgacgctcatccagatcagcgtcacgcgagcgttgtgcacctggggatcgcgaaagaccgagaccccgttcgagatggcttccgtgccggtgagggctgtgccgccggaggcgaacgacttgagcacgatgaagacgctggcgccgacgagaaggccaccgcctggcttgccggccgggaacgcaccgggggcgatgatggcgtagtgatggatgtggccaaccagcgcgcgaaccgtgcccaccgcgatcatgagcagcatcgagccgatgaagaggaacgtcggcagcgcgaaggtgcgcccggcttcgcgcagcccacgcagattgccgaaggccatgccgatgacgaagacgacgccgatcggcgtgatgaaggggacgagcgccgggatggcggaggcgatcgcgtcgacaccggccgccacggagaccgcaacggtgagggtgtagtcgatgaagagcgatgcggccgcgatctgcgcgagccacaggccgaaggtctcgcgcgcgacgatgtaggcgcctcccgccttcgggaaggcccggatcacctcgagatacgaagccgccacgaagatcagcaccacgatgacgaggagcgacaccggcacgatgaggtggtaggcggcgatcccgaccgccgggaccaagacaccgaggctcgcctcggtggcataggccgacgaggacatgacgtcggacgagaggatcgcgagcgcggtcggtttgccgaggcgctccgaactcagctcctcgttgatcagtggtcgcccgagcagccagttcttcagccgatagctgagcttctcggggacctcgtagctctcgagggcagcgagcggtgtgggctgcgagggggtgaaggagcgcgcgaagcgctcggacggttcctcggacatggtcacttcctcaggcgacggttcgccgctagagcctaggtgacctgcgcccgcgggcagcttcgaaccacgagggctctggaccgcgagcctgctcggtcgcacgcgcccgcggactgtagacttcggccgagcggcctgggcgccgaacacagcgaggggttggggcagtggagtcggtgcacgtcatcgtcgtcgggtgcggtcgtgtgggtgcagagctcacccgtcgactgagcgctgaaggacactccgtcaccgtgatcgaccgcaacccagacgcctttcgacgcctcgggtcggcacgagcgacgaccatcgtcgggtcagggttcgatcgagacgttctcgaggccgccggcatcggcgaggctgctgccttggcagcggtcacgagcggtgacaactcgaacatcctggcggctcggatcgccagagacgtcttcgaggtgcccaacgtcgtcgcacgcatctacgacccccgtcgagcggtcgtctacgagcgcctcggcatccagaccgtcgcgaccgtgacctggacgacggatcaggccctcgcccgcctcttcccgctgcgcatcgagcgtccgtggatggactcatccggggagctcacggtggcggagatcacactgccccccagccggatcggcaaacccatcggcgcgctcgaacgagagggcgagctccgtgtggtcgccgtcgtccgacccggcggagcccgcctggccacggcagggctcatcggtcaagagggagaccgcatcgtcgtcgccgcgagccaacgcgccctggccgaactcggcgcctggtccaacgaagtggggagctagcaccatgcggatcgcgatcgtcggcggcggcaacgtcgggcgcttcctcgctgcggacctccagcaccaccacgacgtcgtcctgttcgaacgagatcacgagctggcggcacaccttgcttcccagcttcgctgcaccgtcgtcttcggagacggctgcgagctgtccacgctggcggacgcgggcgttggcacctgcgacgtcgtcgtggcctcgaccggcgacgacgaggacaacctcgtcgtctccctgctcgccaagcaggaatttgctgttccgcgggtcatcgcacgcgtgaaccacccgaagaaccattggctgttcaaccgatcctggggcgtcgacgtggccgtctcgaccccgcatctcatcagcgcgctcgtcgaagaagcggtcagcgtcggttcgctcgtccagctgctcgcgttcgacaactcgggcgcgcgcctcgtggaggtcacgctcacggcaacgtctccagcggtccaacggacgatcgcgaccctcgggctccctcgagacgcctcggtggtcgccgtggtgcggggagagaacgtgatcgtccctcggggtgaggtgaccctcaagcccgaggatcacgtgctctgcctcgtcgtcggcgagactgaggcggcggtgcgcagcgttctcatcggcgacgaggacacgatcgccgaggccgacgcggccacgccctgagctcgccctcggctcccctacggcaccggcgacaccggtaggctccacgtcatggaggcagcgttcttcgacctcgacaagacggtcatctctcgcgcctcgctgctggccttcggagctcgcttcttccaggagggcctgatcaatcgacgcaccgtcgcgcggagcgtctgggcacagctcgtctaccgctacctaggggcgaacgaacgtcggctgcgccggttggagcgttcggtcctcgacctcacgcagggatggcaccagagcgtggtgcgacgcgtcgtcgccgaggcgctcaccgagatcgtcacgccgctcgtctaccgcgaggcggtcgagctcatcaagctgcaccagctcgctgggcgcaaggtcttcctcgtctcggcctcgcccgaagagatcgtcgagccgatggcagccttccttggcgtcgatggccagatcgcgaccaagccgagggtcgacgaggagggcacctacacgggagagatggcgttctacaactacggcccctacaaggcagaggcgatggccgaggttgcgcaacgagagggcatcgatctcgctgcctcgtatgcctactccgactcctacaccgacctcccgatgctcgaggccgtcggccacccggtcgcggtgaatccagatcgggtgttggcacgcgtcgcgcgcgagcacggctgggagatcctcgagtttcgccaccacaccaaggtgggacgccaccgagtccttcgaaccgtcggtgcggtgggacttgggatcgccatcaccgcgataccggcgacacccttcctgcgccgagcgacgcggcgtcggcgaggagtcgagcctacggacctactcccgccacccctgaggcaatgaggccgtgcacgagacgcccaccactcatcggcctccacgaattcgtatcgtcgctgacaacccgggctcgacgagcgcgcgcgagctccaggccgtcgatgtgagcgcagtgtttccgcgcctccggagcagcgtcgctgcgcgatccctcggcgcggcatcgtgtttgccccacacacctgccgccaggtcgcaaccacgtcgagattgcgtcatgcgtgctctccccgacgctatccgaacccaccaccccgcgaccgctcgtccgacctcctgagtcgaattcctctgtcgccaccgcgagcatctccgtgctcgcaaggatcggccgttcacgaccgctcacgtcgctccctcagcgcgggtgcgaccacggatgacgaccatgagttgtacatgagagcggcaggcctcgctactagcatcgtcgcgcatgaaagccgaggagcgcgttcccccctcatcgctgcagaaggcgctggcgtggatcctcgagccacggcaattgctggcactgaatctcatcggctctctcgccgctttcgtcctcctcggcacctacgagtacttgagatggcgggacttcgacctcggcattgattatgccatccagaaccagggaacattcctcattgcgcatggacatcttgcccctcgtgacaccatctacggtggcggcttcgacaacaatgcgctgacctatctcttcatcgtcatcggccttgtacggacgctcgtaccgacaggcgtgatgctgctcgtactccaagctctcgctgtcgccgccacgtacctgttcatcatgcagatcgtcatccgagtgactcggagacttccactcggttggcgtggtgctgtcgtcatcggttccgccctgctcaccttcctcaatccctgggcgctcgaggctgtgtcctttgacgtgcatggggagcccttcggagcactcggactcgtcgtgctcctgtacggcatgctccgaagccagcgcacatacttctatgcaggcctcgcactcgcgctcctctcaggggccggcacgctgatcgtccttgctggtttgagcgtgggcttgctggcgacgaagtcgacccgccgatgggggatacgtacgacgatcggcgtggtgatcatcggcatcatcgcgctcctcaccggtgactccggctcctcattctcgtcgctttatggctatctcgcgtcctcttcaggcgccacacctggcgcgacggccatcctcagatcgatcgtcgagcaccccacgcgccccgtctcggtcctggtcagtcgctggcccgagatccgcgaactgatcggctacgcggggatcattggcttggcatggccgccgacgctcgtcgctgcggtggcagcggtcgtagcgaacggactgccacagaactcggcgttcctgtccctgacgcaggggttccagaattggcccgtcgaagcagtgctcgtcgccggtggggcgatcgtggtcagccgactggccggagcgcaccatgccaaccacgatgccctctcggagggcgatcgtgcgaacggccggtctcgatggcggctcctcggcggacgagccattgtggccctctggactgcggtgagcgtcgccatcggcatcggggccctcagcacagacctcgggatcccccgcagctggttcaaccaaccctacgcgagtgtctcggccctccgagtggcgcaacgctccatccctcgagacgccgaggtcgtcgccacgatcaatgcaatcgcgcgagtgtctgctcgcgctcagctctttcagcagatcgcccccactcaggcgcagccggtctgcgcagcggtcgtcgacgtcttgatcgaagtgccagggccctatgcggtgctgacgagccaagaggcgagccacgatgtgcgtaccctccttcgtgctccgggtcacacggtgctccaacaatcgggcgtggtgcttgtccagttcgggggtctgcatcccggtcgagaggcgctgatcgtcccgacggggcaggtggtcaccggaccgcaagcggcgagcctcgacgcgtcacagtgtcagtaggtcggccttccgacccatggagcgtccgactccggcaggagcaactccagccgtttggttcgccgcgactctcgccagcgaccgcaccggcgtcccccatctgctcgacggcaccaacgcgcagcgatccatacgcggtgcaggcacgagggggctcggcgttgccggacgactgctgagcgtgggccgctagggccacgtacggcacgcgatcccagcggcactcgatcccagcgaccttgccatcagtgtccgtcgcgtgctcgattgaccctcgcaggatgtcaacgccgccggcgcgaggcgtcgctcgacctgcgccggcgggttccgtcaaccctgcctcgagccctcaccgagtgaccatcgttcgcgtgcaatcgtcgacgcgcatgcaggttcgaaggggcacccaaggcgcgatacgcgctccggtgtcggggatcgagcctcctgacgcggctcgttggcccaggtctgtctccagagcaagcgtggctcgaccaaggcgctccctgctgatgcagcgacccgtctgttccaacgcactcacgccaactgcagtgcctggctcgattggatcgagggcatccgtgcccgggctccgcagggcatctcagcaggcacctcgcgacctgcgtcagcttgcagtcgatcgagaacgagcgaagccaccggacctccagccagcagcgactgcgtccgcacggctgatcacctctcggtattgctgtggcgtgcggccacggtcgcacacgggcccgaggcgcgaatcatcggcgacgacaacctcgagggagctcgcgctcgtgtcgggaggggctctcccagaccccgacgctcgcctcgcgcgaactcccgagggttgctgaaggacgagctcgccgcccgcgcaaggagtccgagggctgctggctccacgaacacgctccaccaccagtcaacaccaagcgccagctgtcacgcgcgccagcttcagctggacactgtcctgctcgaggtcataggaacgccgcgcgtcgccgcgcactcggtcggccgtggcggaccgcgccagcgggagccgatggtcccgccacaaggccgccggtcaccctcgcgacggtctcgcctcgtgccacgggcttcactaggtcaccgacgggcaggcagatctcctcaggcctgcgacgaccatgcgttgacgtagcgtcagccctcatcaccgttgggtcgcgtcagccccggggtaccgaccggagcgaccccgttgaggagaggcgaggggttcggtgacgccgacgacggacgagagtcgagatcaggcccgtcagcgaggcgccaggacgatcacggcgactcctgccgcgacgatcgctgcggcgacgactcgcgagcgaccgcgagcctcacccatgatcgcaccggccagcgcggcgatgaccacgctggtctcgcgcagtgccgacaccaccgcgagtggagcgcgctgctgcgcccacagcaccgcggcgtaggtggcgtaggagagcacaccagcagctgcccccaggccgagggagcggacctcgggccgagtatgcgcacgtcgcgctgcgagggccgacacggatgcgaccacgctcccttcgagcgcaaagagcagaccggcgtaggcgaagggatcggggctgtggcgcacgccgagtccgtcggtcagcgaatagccagcgatcgtgacgccggtcgcgagcgcgagcagcactgcccgcagaccatggtcgcgctgcggcctcgcaaggagcgcgatcccaccggcgaccacgaccacgcccgccagctcgaaggtggtcagtggctcgtggccgatggcgagggcgccgatggcgaccagcaacggcgcgctgccgcgcgcgagcggatacacctgcccgagctcgccagcggccaacgaggacccgagcaagaggttgtaggcgacgtgaatggccgaggagccaaccgcgaaggcgatcgccgccgctggtggtgggccgacgaccacgagcgaggcgatcccgatcgcggcaaccacggcgttgatggtcgcgacggcatcacgaggtgacggtgcaagcttggccagtgcgttccaggcggcgtgcccaacagcggccccgagcaccaccgcgataacgacgagcatcacaccagccacacggatacgtgcacatgcaaccagtttgccgctacactgagggcgtgaccatgccaacgctgtatctgggacatggagccccaccgctcctcgatgacgcgcgctgggttgccgagctgcgcgagctggcgagccgcatcgatcgtccgcagagcattctcgtggtctcggcccactgggaagctcgaccagtcgcgctgtcgtcggtcgtgggcgccccactcgtgtacgacttctgggggtttccggagcgctactaccgcctcacctatccggcaccggggtcgccagacctggctgcactggtcgaggggcacctcggggctgcgggccactccgtggctcgcgacgaaggtcgaggcctcgatcacggggcatgggtcccgctgctcgccatgtacccggaggccgatatcccggtgctgcagctgtccctcccgagtctcgatccagaggaactctacgccgtcggacaggccctcgcgccgctgcgcgacgctggggtcctcctcatcggcagcggcttcttcacgcacaacctccgtgcgctcggacaggttgggcaccctgacggccccccgcccgcctggtccgtagagttcgacgcctggggcgccgaagcgctcgccgacggcgagatcgatgccttgctcgacttcgaacatcgagcgccggctgctcggctcgcccaccctcgcaccgaacacttcgctccgctgttcgtgaccctcggcgcgggcgaagggacgcccgtcgataccgccatcaccgggttctggttcggcctctcgaagcgcacgatcgtccttgcggaggcaccgatcggcgaggtgacacagcacgtctgagcccacgcgcctcgcgtcgagccccgcgcaacgagcaacctccgccagcaagcccgctcgaaacctcgtgtccaacgggacgtcaccagctggctgatggacctctaaggtacctgtgtgcccggcggattcgtcgctgccctcggtctcgctgcgctcgccgcgagcgcacccacctggatcggctcgatcccagtgggtcgtggcgcggcactgccaccagaaggcatcccgtcaccggtccagccgctcggaggcatgctcgcccatgctcccgcgtgccggtggcgcatcgccgccggagagcaaggcgccacgacagccctcaatgcgctgatcgcacgcgtcgagaaccgactgacccggcctgcagcactctgtgtgtcagggacgttccgccagccgatcgtcgtcgagggcaagtggcgtccggctgcgctctggatcgaacctgcgcccggcaccacagcactggtggcgccgggccgtcttcgcgccgccgacgttgcccacggcgttcccgacggcacggtagcggcggtctcgatcgtcggctcgacgggcgtcgtggtgcgagggctcgtgatcgaccacgtcaccgccgcgagcggcgtgacgccagccggcatcgcggtggaggtcgcaggacccaaggagggggtccgagtctccggctgcctcgagcgggggagccgacgatgcggcgacgttgcgctcgtcgacgacaccgtctcgggagtccgtgcacccggtgacgtctggcccccgacgctggccgcgtgtggctccggatccgtcgatgcctacggcatcgaagtcttcgacgcggcgacgacaccgcgggccgccctgaccaacgtggtcctcgccggcgatcgcgtcgccgacgcgcgcctcggacagagcgaggccatcgcgatctccggtgacgtcgccgacgcactcgtcgagcacacgagcgtcctcggcgtcgacaacatcggcatcgacgtcgagggctactacggcacgacggcccaccccaacgacgtcgcgctcgtcgacgacaccgtcgcagcggtcgactcgtggacgaacgcgggctacggcgttcgcgctcatggccgatgcctccccacgccaccggcggcggccgggatctacgacgacggtgcgacctcgctcgtgatcgcccacgaccgcgtactcgacaccaaccaaggcgtcagcctcgacacggagacgaaggatcacgcgaccagcaggatcgtcgttgccgacacgacggtggtggacgctccgtcgctcgcgctgcccgccggaacgacatccgcagctgaaggggccgacgtggccgggtccatcagcgacgccggtcgggccttcgatgccttctacgtggacgccttcggaccgcggacctcgatcgaggacgtcgtcgccagccacgacacgttcgtcaatctcagcacgttctggatgcgtcgcctcacgagccaggccgcggtcatcgtccttgggggtcgctatcggtcgatcgagcttcgatcgcttcgcgcacgatcaggaactggcccggcggcacccataccgctccagttcgatcgcctgccgatcgagtggtcggggatgcggctctgcgacctcgcgttcacgggtggtcctgccggtaccacggtggagacgccgacgaccgcggcgacgtcgatcgccggagccttcaaggggctccctgtccccatccgatccgcgataacgtgcggcggccaagcgcgcccgtgacgtggcgctcgaggcgcgcgtcaaggcaccgagtgcctcaacgagcaggtgcgacgaccctgagcaccggccctccgtcgcacgcgtcgcacacgccaaggccgcggcccagcggctagtgaatcagcgcgacgatgtcctgcacgactaggtacgtcacgagcgcgatcacggcgaggtagatcgccgtcatcgaccagcgccaacggtgacgcgcgacgtggaagcgccgaatcccccgaacgtcgaagatcaacgccagcaccccgaccgggatcccgatctcggggccgaaccccgccaccgcgccgaggcccagtgcgggcagcacgaaggggatgatgacgtagctcaacgtgcaacggagcccagacaggatcatcgcgaccgaaaagagacgctcagcggcctcctcgcggtccgatgtcgacgtcggctccgggatccgcagcagccggcgcaccactcggtccgcgcgactgtcgctccgcgccccgaccggacacgccgtggcccgaagcgccgcgtgatcaaccgggcacgcacgctgctcggccgacgagagagccccccgagccgaggcggtgtcgatcgccggctctcgagcagtatccatgctcccagtgtacgcgagccgcgcacgtcaccagaaaccggcctcgtcgggctctcagggatcgaccaccgaaccgaggtcgtcgatgccccgatagcccggcagcgctgcgagttcgcgatgcagttcgtcgctcgcaagggcggcatcgagcgctcgacgcacctcctcatcgctcggtgccacctcgcggctcacggcgaggaagaagcgctcgtctgcgagcggcgcaaagtagagtccgaactcccgcgccgcgggctcgaggacgacgcccgtggtcgcgactccggtcgcgaccgcttcggccaccatgaggtgagaatcgacctcggtgtcccaaccagggacgcgctcgggcacgatgccctcggatgcaagccagtcagcgaggagggcgcgcgcctcagaaccaggctggcggttcgcgagccgtccctgcacgagttcgaggggacgagtcgcgtctcgagcgcgcgacaccagcccctcgcgccaggccgcaaacgatcgcacctcgataccgggcggcaggggcggcaaggagacccgacccgatggatcggtcgccacgtggaagcccgctgcgtgcacgagaccgtccgcgagcgctcgcagcgcggcttcggagggcgccggccaccagacgagctcgaccggccgagggcggtgcgcgagaggacctgcgagcagcaacagcgccggatcgcaccccgcaaccacgaccgcaggcgcagggcgcctcgtcaccgtggcccgacgagggccgagcagccgagctccagcgggatgaaatcccggcacgatgccgtgctcacccccgcgcggaaccccgacgagtcgatcggcgacccgcgcgacctcgatccgctctccgaccgcggctgggccgacgagctcgatcgcctcctcgcgcccagcaccgctcgtgtcgaagagttcctccacgctcacgccgaagaagcgtgcgagcgccatcgccaccgggagcgacggttcgaaggctcctgactcgattcccgcgaccgcctggcgggagatgccgagtgcgtcggccacctgctgctgcgaaagcccccgcacgcgacgcagccgccgtgcgatctcgctcacgtccggaccttctgatcgaagaccaccgcgtccgtaagtgccacccatccctgcccgagcggccggtcccatgacgtctcggcgcgcagcgaccccacgccgtcgaccgaaacgagctgctcgaggcgtcctcccaccacccgcgcaggctcgaggacccgcgctggggccccgatcggaccatcaggaccgtcggcgaggtgcagtgctgacggccaggcccacgcctcgccccaccgacccacgaacggccccaccataccgagtaagcgcgcgacacgagcgctcgcaggctgtcgctgcacctgggaggcgggcccgatctggagctgcgccccgtcgtcgagcaccagcagcgtgtcggcaacgcgcgcgatgctcgcgaggtcgtgatcgacgacgacgaccgcacaacgcgtcgcactgtcgcggatcgcctcggcaacgtcgtcgacgagctcgtggtcgagaccggccatgggctcgtcgaagaccagcacgctcggacgcgcggcgagcgcacgcgcgatggcgacccgacgagcctgcccaccggagagggtgccgaccgagcgatctcgaagggtggcgaggccaaagtatcggagcaactcctcgacgtcctcagccgacgcacgacgagagaaggccacgttcccgaccacgtcgaggtgtcgaaacagcgcggtgcgctgggggacgaggccgaccccacgccgctcgagcgcgacgcgcacacccggactcgacacgatcgtctcgccgacacgaatccacccttcggcaagaccgacgagcccggcgatcgcgtcgaggagggtcgtcttccccgcgcccgagggtccgaccaccccgagcaccgacccctgagggacctcgaaacgacagcgcagcgtgaacgagccccgtcggacagtgcagtcagcggcgagcatgtcgccctcgagcgtacgcgaggagcgggaacggcaacgccacgacgagcaggaccacggcgtagggcaacgcggtggggagcccagtctcgttgagtgtggtccagatctgcatgggcaggccgtaggggtgatacgccacgatgatgaccgccccgaacgcaccgatggctcgcgcccaggcgatcgagagggcagtcgcgagctcgcccgcgacctcgggcaccatcgcgcgccagaaggcgcgccacggcgaatcgccgaggagccgggcttgcacgacgacgtcgtggtcggcggccgcgaacgctgcagctgcagcaagcacgaagtacggggcagcctcgtagacctcggcgatgacgagcgcagtgaacgtgttcgtggcatcgagccccactcgcgcgagcagccccccgatcggggtcagcggacccaccatgaacacgaggagcaggccgatgacgagcggcggcatcaagagcacgaccagcaaactcgcctcgaggatacgagcgacggcgccaccgcgctcggcgatgacgagcgcgaccggcgtgcccaccgccacgacgatgacgagcgcgaccgcagaggccaaaagtgacgtcccagccggaccgagggcgtccggtgcactgagggcgaccaccagcgcgtgcgggcccaggtgccacagcagcgtcaggagtggcccgagcagcaccacccatgcgacgagccccccggcgaccgccagggcgctctgggcgatccgaagcggctctctagccgtcggcgcgcgcgacagcggtgcgaacgacatgcggaacaccggtccccgtcacggtgggccgcagcagggtgtagccacccgccgcgagcgcctccctcccagcaccatcgatcacgtagtcgacgaaggccatcgccgcgccctggtcgtggcgcccgagagtcgtcaccgcgagcgtgagcgcgtgaccgtggacgacactgccatcgggaagggtgagcgaggccgtcgcgtacgttgccgcgtccgccggatcaccgaagtcgatggcggcagggagcgcaatgtagggcaggtggagctggatcgcctgggagcggaaggcgctcgctgcatcgagctgaccgctctcgagccgagcctcgagcgacgtctccgaatacacctgcgacgggttctcgaggctaccgagcacggcgctcgtcgtggaagccggaaggtggtaccggacggtggcgagttcgaccatctcgtagaacgcttgtccctgggggtcggtggccgggttcgtccgtccgagcaggaagccaggcgttcgcagcagactgaacagctcagtgaagggagctcggcccgctgcgatcgcagccagacgaggagcaaacgacgtgtgggggttgtacgcgaggacgatcggactggaggccaccgtcacgtaccaacgagtgaagcgcggctcgagttcggcgatgggcgccccgccgatcgactcgaacacgttcgggctgatctcgccggcgatgatgtcatgggcaagaccgaaggatcctccgccgcgtccttcgtagacgtcaccggtcgctcgggcgaagtctggcccaatgacgtgctcgttgaggtactcgagcgagccggcgtaggcaacgctcgcggtttcgtgcgtgtgcgaggcactcgcgtgctgcgtcgagccacaggccccgagggcgacggcggcgagcgccatcacagtggcctgggcggttcgcgtcgttcgcatgccatcaaagctagcacaacgccagtcttactggcaacgcgcgtcacgcccgcgccgtccgcgacgctcggcgcgtagactcccgccgtgcaccccgcaagcgagcgacgacgcatgatgggcgagaccatcttcgcgaccatgtcgcgcctcgctaccgagcacaacgccatcaacctcgggcagggcttccccgatacgcccggccccgcactcgcgatcgaggccggcgtacggagcctccgcgcgggccacaaccagtacgcaccagccggaggcgtgccagagctccgcacgcgggtggcctcgatctggagccagcggctcgggcgaccgatcgacccgctgcgcgacgtcacgatcacggtgggcgcgaccgaagcgatcgctgccgcctgcctcgcctggctcgagccaggcgatgaggccatcgtgctggagcctgcctacgacgcctacctctgggccgtacgcatggcgggagctacgccggtcggggtcgatctcgggtccacgatgcgcctcgacgcggagcggctcgaacaggccatcacgccgaggacccgcatgctcatcgtcaactcgccgcacaacccgagcggtatggtcgtctccgacgaggaactcgcggcgatcagcgccgttgcgacccgacacgacctgcgcgtcctctccgacgaggtctatgagttcctggtctacgaaggcagccaccgctcgatcgcgaccttcgacgcgatggccgatcgcaccgtcgtcgtctcctcggcagcaaagaccttcggcctgacggggtggaaggtcgggtgggcgatcgggcctgccgacctggtgagcgaggtgcgatcgcaggcgcagtatctgacctatgccggcgccaccccactgcagcacgccgtggcggacgcgctcggcaatctcgatctcatcgtccccctggtgcgcgatccactcgcccggcaacgcgacgtgctcgtcgacggcctcgccaagctcggcttcacgccactcgcgacccaagcgggctacttcgtgctcaccgacctcggccccgtcgaggccgagaccgccaccgaagccgccctcatcctcgccgagcgtgccggcatcgtcaccattcccatcgagcccttctacgtcgagccggagcgagcgccactcgtgctccgctggagcttcgcacgccaggcgacgacgctgcgtgacgcactggcccagttgcgtcgagccgccgaccggggtctgctcgcacccaagacgcgctaagggagcacgcgacgcccgatcgagcgcgaggctcggccctcgtggtcgagccggctagcgctcggcgtcgcgtcggaccacggcgaccagcgacggggcgacgtggccatgatcggcacggtctcgaacgacctcgagcagttcgatcgaccgctccggaaactgcgagcggatctcgtcctcgctgaggagccgatccggatccggaggaccagcgatgccgaccccgtcgacgtggtggccgatgatgacgagccgccctccggggctggcgaggccgaaggcgagcgcgtgcagtcggcgtcgctcctcggcaggcggatggatgttcgcgagcagcacgaggtcgaactggaggccgagctgggcaaactcctcgatggtggcgtgttggatcgtgacagccagaccttgctcctcggcagcgcgggcaaggcgctcgagcgcgacgtcagccacgtccaccgcggtcgtctcgatcccacgagacgcgagccacagcgcgttgcgcccttcgcctgcgccgagatccactgccgatcgaggctgcactcgttcgacgatgcccacgatcgcaggatccggctcgccgatccagagtcgatcattctctcggtagcgagcgttccagacctgccgcatcgcttcgtccacggcgcctccttcgtccgagccccgggtcgaggctaccgctccctcgctccgagcacgtgtcgcccccatgacctaccatgagcccgtgctcatcatccacacctccgactggcagatcggcatgccagctcggaccatgaccgaggaggctcgccaccgcttccgccacgatcgtgtcgacgccgccgagcgtctcctcgccgaggcgagctcgcgtggcgcgtgttgcgtcatcgtggcgggcgacctcttcgacgacaacacgctgtcggaggaccagatccaacgcacgctcggcgtgatcgcgcgccagcagctccctatcgttgccctccctgggaaccatgacgccctcgagccgcacgccatcctcgcccgcgacgatctccccgaccagctgatcgtgctcgactcttgggagccgcgcaccgtcgttccaggactcgaggtggtcggcgccccgtggcgctcgcgcatcccggggcgcaaccccgcctgggacacggtccgcgccctcgagtcctacggtccgccacccgccgggacggttcgggtcctcgtcgcgcacggtcagtgggagcgctacgacagcgtgaccacccattcgacgctccccgccgatgagatcgtggccgccctcgacacggggctcatccactacgtcgccctcggcgatcatcactcctaccagatcttcgtcggtggacgcgtcgccttcagcggaacccatgaggtcaccgccgcagatgagcgcgacccaggctgggcacttgcggtgaccctggagccgtcgcacccgccagcgatcgagcgaatccgcgtggggagatggcgcatcctcacgctcgcggagacggtcaccagcgccgacgacgtcgcggcgatcgccggtcggcttcgcacgctggaggatccggcacgctgcgtcgtccgcctccacctcgacggcacgctccctctcgcggcccgtctcaccctggagcagaacctcgaggcagccgctgccgccctggccggcttcgagctcgacgtcgagcgggtcgcgagcctgtcggatgccagcatcccggccgactttcaccttcgaggggccgccgccacggccttcgaacgcctcctcgacgaccccgaccccgtctcacaggcagcgctgcggctgctcgcgcgactcgccctcgaggggaacgaacgatgatgcgtctcgtccgcctccgtatcggcgaggcccgccacctccggggcctcgagctcacgttgcgaagtccggggctcaccatcatccacggccccaacgaggcggggaagtcgaccatcgtcgcgtgcctgcggctgctgctcgcgaccccctccacgtcacgtcaccgcgaggtgcaagcgctggccggcccgtctggcggggtcgaggttggtgccgtctttgcgctcgacgacaccacggtcgagctcacgaagcgctggctcacccgacctctcacacagctcgtcatcgccggcgcaggacagctcgatggacgagaagccgagacgcgcttcgccgaattgctgacgactgcgggacttggcgagggtgctggcgatccgctcgtgagcaccctcatcgacaacggagcgggaactacgcacctcgccgcgagcaggatcgtggccgaagccctggagcgacgaagtggcgaggaggccttggtcgatcccgggctgcttgcccgggctcgcaccgagcttgcccgctacgagacgcccggacgctcccagccaaccggggacctccgccaagcccgcgacgaactcgaccgcaccgaggccgcctacctggttgccaccgcagacgtcaacgccgtggctgaggcgcgccgggacctcgagacgatcgccgagcagctggcgacactccccgacgacgaggctcgcctcaaggccgaacaggacgaacgtctccgacgccgcgcggagctcgagggcctcgacgtcgaggtcgagcgatcgtcgcgccgagtcgccgacctctccgatgcgatcgcgcgagagctcgaggccctcgaacgtcagcgtgaactcgcgagcgcgctcgcacgctcgcgagaacgcatcgaacagctcgatcgcgacctcgaggagcggcgcgagcagctcacgcgggtgcaggcgcaactcggtgcttcgcacgacggcctcgaccaagctcgacgtgagctcggtgagctccgcgagacccaggcgcgcgccagggagcgcgaagcgctggccagcgtcgctgcaggcgccgaacgtctgagcgcccaggttgcgagagcagtggagctccgcaatcgcgtcgccgccctcgagatcgctccaccgcgcaggctcgatgacgcactggtggcgagcctccaggaggccgaggccaggctcttggccacgcgaaccgtcttcgagaccgtcggacccagcctcaccatcaggagcgagcggtcggtcgaggtcgtcgtgaacggggacctccaacggctcgagccggcccacgcgatggtgcgaccgatcgacgagcgtatcatcgtgtcgctcggggacgtcaccatggagatctcgcccggctcggcggtcagcgaactcgaggagctcgccgccgaacgcacccgactcctcgcaagtctcggtgtcgcgagcctcgacgaggcgcgcgccctcctcgagaaggctgcccagtacgaccacgaactggaccagctgcgacgcgagctcgcgaacctcgctcccgacggcatcgagcccctcgacgacgaggcgactcgcgcccgtgctgcagcctcgagactcgacgacgcccccgagctcgcacccagcgacgagctcgagcgacgagtcagggccctgagcgatcacgtcgaggcgctcgaggccgctgcggaggaggcacaagtcgccgaacgccggtaccacgaggacctcgaacagctcgtcggcgcacgcgagcgtgaggccctgcaactcgaacaagcagagcgcgaccttgccgcagagccagccgagagcgatcgcgtcgcgcgcatcgaggacctcgagcgcgaactcgagacggagcgccatcggcaccgcgaactcaccgacgccatcgagacccggaaccatctcgacgaggagctggaagtcctcgccaccgagcttgggggcctctcgaaccgaagagccgagctcaccacccaacgacgcctcctcgaggagcgcctcgagcgcgccacaggactcgccgaccgcgtcgtcaacctcgaggagcgcctcgaagggcttcgtcgacgagtcgccgtgctcgagggccagcgcgcggccgcacgacggcttgtcgaggtcttggaggaagaacagcggcgtgcgcgggagcgaaccgaagctccgtatcgacagctcgtggaacgcatcctcaccgccacgctcggcgagcgcgtggaggtgatcctcgacgaacacctcggcgtcgagagtctgcgacggccgacgagctcgcggacggcgcttgcgacgacgccgatcgccgcgctgtcggcaggaacccgcgagcaagtggagctcgcctgtcggttcgcagcgacccagctcactggcgccgtgcccatcgtgctcgacgacgcgctcggctactcggataccacgaggacgcgcatgctcgtcgcacagctcaccgcactcgcgaccgacgcccaagccatcgtcctcacggcccaccccgaacgctacctcggtgcgagcgatgcggaacgcatcgatctcgcgcgtagcaccgagtcctcttcggacaccgcgcgtggcacgtcgccacctccgaccggagcggcctcagaggcgtcgctcgaggacgcggtgcgctcagttctcggcgacgccggtggaccgctcaaccggaacgacatcgcatcccggctggatgcagacccagatgccgtcgcacgggccatccggacgctccgcgatgccggtgtgatcgagcagatcggacaacggcgaggggcccgttaccgcttgtgcgagcgtgatcggacagacccgcacgccacctgatcctcgcaacgtggagccgcgccggagcgcgaacacgccaatggccctgatcgcatcggcggagctgcaacctcgcccacggtggctgaagcgctccagcgacccagcgcgaggtgagcgcgcttggcatgccaatgctgaagccggcgaggatctctccatgagcgaggcacgacgaccgctcctctccggatgacatgaagagaacggtgcccatcccgcctcgcgcgagcgccgtcgccaagggccgctgcccgtcgctgcggtggcgccagcgagccgaacgcgaacagcatgagtgcacgggagagcccaaagggagccgatcatcagcccggacacgcttctcctgcgagccaccagcctgctggtccgcgccatgcaacctcggcgacacagcccgcaagccgtcggccaacagcgccacgcccacgctcgggcgaatgacgaagcagtgcacggcaacgactcgaggacaggctccgcacgggcactcacgactccagatctactgggtcgccaccagcgagcttggttgagggctgcggggcggggggctcctcgtgtcctcacgacccgcctgcccctacgactcgagcgcctcccgaatggtgttcgtggcctcgcgtgctcggttctcggccgccacggtgaggtccgcgtggcgataccagacctcgttcgcaccctcgcgccaggtcaccgtcggggtctcgaggagctcggggtcgacgttggcggcgttcgcctggacgaagtccacgagggagtcgatgagggtgtcggcgaggtagtggggttgcagaccgaggtcgagcagggccgagtgacgggcgttgtagtagtgctcttccttctcgatgcgtgggttgtcgaggtggacgatggtgggctcgaggcctcggcgtcccaggacgcctgccacggtctcggcgagctcgttcagggtgaactgctcggtgaactggttgaagacacggaactcaccaggggcggccgggtgctcgagggccagggtgatgcaggccatggtgtcgcggatgtcgaggtagccacgggtctggccgccacggccgtagacggtgatggggtagccgagggacccttggatcacgaagcggttgagggcggtgccccagaccgagtcgtagtcgaagcgggtcgcaaggcgcgggtcgagcaccgtctcgtcggtggcgacgccgtagacgacgccctggttcaagtcggtggcgcggaagttccacacccgcgtcgtgaagtggatgttgtaggagtcggccaccttggagaggtggtagaagctgtgcggcagcttcgggtagggcaaggtgtcgctgcggccgttgtgggtgatggtgaggtaaccctcttcgatgtcgatgttcggggttccgtactcacccatggaaccgagcttgacgaggtggatctcggggttgacctcgcgcatggcaaagaggatgttgaggttgcccacgatgttgttgacctgagtgcgcaccgcgtggtcgcgcgagatcatcgagtagggggcgctgcgctgctcgccgaagtgcacgagggcctctgggtcgtgggcgcgcatggtctcgaggacgaagtcgtagtcgcagatgtcgccttcggcgatgcggatgggggcacccttgccgagggcgttccaggtctcgacgcgctcggtgaacgaggcgatctcgttcaggggacgggtaccgccttctgcgtcccaacggcgacgggcaccgttgtcgatggcgagcacgtcgtgaccttgggccgcgaggtgcagcgccatcggccacccgatgtagccgtccgcgccgtagacgatgatgcgcatggtggtggtcctcccttgagcgatcgtcattcgttcgtgtccaaggcccgaacgaatgcggaacatcagtttacgaagccaacgaggccgaggcgccgcgtagatgtgagcggttgatcagggccgcttcctcgtgcgaccgagtcgcacgaggaagcgtgtgagtgtcgacggtgttggtacgccatcatgacttctctcccacatggtgcacttgcgcttcttggatccggcgagctcgctccgtcgatggtcgcggtccatcgccagctcctcgccgagctcgacccaccacggccggtcttcctcgatgcaaccttcggcttccaggagaacgccgacgaactcgtcgccaaggcccaggagtacttcgacgtaagcctgcatctcccactcgaggtcgcgagcgcgcgtcgtgcgagcgcgctgagcgcactcgaacgcgggcggttcctcgagaccctcgcctggggcaactacctcttcgccggacctggcagtccgagctacggcttggctcagcttcgcaccgcgggtgcaggacccgtgctgcgtgagcggcttgtcgacggtgccaccgtcgtgctggcatcggcggccgcactcaccgcaggtcgctacacaatccccgtctacgagatctacaaggtcggcgaggatcctcgatggctcgacggtctcgacctcctcgatgccttcggcgtgacggcagcggtcgtccctcactacgacaacaaggagggggcgacccacgacacgcggttctgctacatcggcgaacgtcgccttcgtctgctcgaggaccagctccccccgggcgtcggcatcctcggcatcgacgagcacaccgctgtcgtcctcgatggctctggcaaagtgcgggtgctcgggaagggacgcctcgtgcttcgcgtgcgcggcaacgagcatgcgatcgcggccccggcaacgctggcgctcgacgaactgcgcgaccggctcggcgccacagatcacccacggccaggtgacaccgcctcggcatcggcggctggcgaccttgcggcactcgacgaggccatcgaccgaggcgagatcaccgacgcccttggccagatcgcagcactcgtcggcgtcgacgacgaccgcgtcgtcaccgggctcgcccggctcgcccgacgcctcaccgacgggctcgtcgaccgcgaagcggccatcgccccggttgtcgaagcgatcatcgcacgacgcgaagcggcgcgagctgcgcgcgacttcgcgctcggcgaccacctccgcgacgcactggccgccggaggtgtcatcgtggaggacacgccagagggtactcggtggcggctcgcagaggtcgtacactgatatagcgacaggcgtgcccccatcgtctagcggccaaggacgccgccctttcaaggcggtagcacgggttcgaatcccgttgggggtgccagttcgcgttccgagccgagacgaggggtgacgcaggcgatcgagcgagccgacaatgcggtgcaacagcagcacgtcccacgtaggtcgaatcgataggttccatcgaggcgatggtggcacgagtccacacggctccgccgacctcaccgcagccgcatacgacaggcccaacgtcgatcggagcagcagccagcacaaacagcttcggcctgccgtcatgcgcacctcgccgccaccctgtcgcagcgagacccagtcgatatcgatccaacgtcgtgtgcatggccaccgtgcattgcgctcggtcacggcttgcagggccaacctcgaagagcccccgcgagcgagcagatcgacggctcgatcagtcacacgagctggagcgaggaatcggcgggctcgcaccacgatcgcaggccgcggtgcacctgccacgccgagagccgcagatcacaacccgatcgccttggaacagaccacgcggcgccgaccacgcgcgtgcgccctcgccgcccgcgatggagcgtgcctcggcgaacgagcgctacagtgaccgcggcacggcatcgtgcgcgccgagttccgtcgcagaggactgggcgcccatgagtgcgaatcgcacgatgaacgaggtagtcgtgacgggatccctgacgaacgacacgcgcagtgatgatgctgtgttcaccccacgtccgtgtgaacacgcacgatgatcgatctccacctccactccaccgcctccgatggctcgaacgaccctgcggaactcgccgggatcgtcgccggtgccgagatcgtcgccctcaccgatcacgacaccgtcgagggcatcgccgcgtttcgcgaggcgctctctggcacgagcgccttcatcgtcggggcggagctctccctcgcgacgaccacgggctcgttgcacctgctgtgctacgggactggactcctcgggcccgctggcacgtcgctcctcggcacgctcgccgacgatcgcacccgtcgcaacgagcagctcctcgcacgtgccgcagcgaacggactcgacgttcctctcgaagcggtgctggctgctgcgggagcgacccggctcgacgagaagagcgtcgggcgcccgcacgtcgcagcggtactcgtcgaacgcggctacgcccgcgacatccctgatgcgttcgatcgctacctcgccaagggtcgccctctgtacgtgccgaaggcacgccttcgcttcgccgacgtgatcgagccgctcgctgcgatcggtgtggcgacggtcgtcgcccacccgctcagcctcgagctcgcgcccgatgcactcgaggaccacctgcgcacgctccgtgacctgggtctcgtcgggctcgaggcgcactacgccgcctacgcgccctcgacccgcaccgccttggccgagctcgccgaccgcctccacctcgtcgcgaccggcggctcggacgcccatggacgcttcaaggccggcctgtccccgctggtgggctacggcgacctcgatgtcccggtcgtaagtggcgaggcactcatcgacgccatcgcgcgcctcggcggccatgccgacctatactgatgacgcccagggcccgagggcccttcgccccaccggggacctgtggtgcagctcggagtgcacgccggcctgtcaagccggaggtcgcgggttcaaatcccgtcaggtccgctgagcacgtctcgcacgtgcatcgggtcggatagctcagttggtagagcgcacgcctgaaaagcgtgaggtcaccggatcgaaaccggttccgaccaccatcgtcagagcgtgcgacgaccccttcgtcgctgcctcgatctcccgctcgacgagtgagcgctcgagcgaaacgtgcggtctcgcggccccagcaacgctcgctcaccgccaagctcgctcactgccaacgtgtcaggtcgcggacacgacggccaccaggtcgcccgcttcgatcgtgcacgatccccgacacctccgcgcgcgcaggctaggctcggggtctgcgatggatgaccaccccacccacggctccgagcaaggctccgaagccgaccacccagaggaagcctgtggcgtcttcggtgtgctcgtcgcgtccgaggacgagcaagcctcgttcgccgtattcgacggcctctatgcgctgcagcaccgtggacaagagtcagcaggcatcgccgccgtcgacgacggtcgtatcacggtcgtgaaggacctcgggctcgtggcgtcggtcttcgacgaggcgaccctgcgtgcgctgcgcggtcggctcgcgatcgggcatacgcgctacgccacggctggcgaccgaggatgggagaacgcccagccgctcctccacgaccacgccggcgcccagatcgccgtcgcccacaacggcaacctcaccgacccgcctcagacgccagcccccaacggccggatcccttcggacaccgaacggatcgccgcggccgtcgccgaggccctcggatcggcgacgacgccagcggccgttgcggaagccgtcgcgcatgccctcgcgccccttcatggggccttctcgctcgtcatgaccgacggccagcacctcatcgccgctcgcgatcgccacggctttcgccccctgtgcgtcggccgcttccccgatggcggttgggtggtggcctccgagacgcccgcactcgacgtcgtgggcgcaagcttcgagcgcgaggtggaccccggtgaggtcctcgtcatcggcgacgacgcccaggcgagctcctcgctccccggaccccacttccagcatctgtgtgtcttcgaattcgtctacttcgcgcgtcccgatgccaagctgctgggccgagaggtgcacggtacgcgccgtcggatgggcgagcatctcgcgcgcgtcgcacccgtcgaggccgacatggtgatgggcgtgcccgactctggcatccctgccgccgagggctacgccctcgcctccggtatcccctatggccagggactcgtgaagaatcgctacatcgggcgcaccttcatcaaccccggggctgcgcagcgccgacaggcgatccgacggaagctgaacgccctcgaggacaacgtccgaggcaagcgcctcgtcgtggtcgacgactccatcgtgcgcggtgcgacgacacgtcagctcgtcgccctgctgcgccaggcgggggcggccgaagtccacctgcgcatctcgtcgcctccgtaccgctggccctgctactacgggatcgacacgccgagtcgccccgagctcatcgcctcccgcctgtccgtcgacgagatcgcccaagaactcggggcggactcgctcgcctatctcccgcttgcgcacctgcgagacgccgttggcgtgacccatggctgctgcgatgcctgcttgaccggggcataccccgagacggtcagcgaagcggcagccgcgggtgcgggctcgcggtgagccgagccgccgtcatcgctccagcgcccacctgacacctcgaacctgcgccacgtggccactagcctcggcgccgaggaggccactgtggagtaccgcgaggcgggagtcgacatcgaggcggcggatagcgcggttgcgcgcatcgctcagatcgtcgcccggacgtttacggaacgggtcgcgagcccgatcgggggcttcggcgcgctctacgagatcggcggcctcggtggtgcacgtccgaccctcgtcgcgacgaccgacggcgtcgggacgaagaccgaggtcgcccgggccggcgcccgctacgaaggactggggcgcgacctcgtcgccatgtgtgtcgacgatctcgtggtcaccggagcaaccccgctcttcttcctcgactacctcgccctcggtcgcgtcgagccctcgctggtggcattgctcgtcgatgccatggcagcggcactcggcgaggtcggggcgtcgctcatcggcggtgagatcgccgagcaccccggcgtgctcgagccgggtcaggtcgatctcgctggcttctgcgtcggcatcgtcgatggcgacgcgacgctcggatccgagcgcgttcgcgctggcgaccgcgtcctcggcctccgctcgccgaacctccgctcgaacggcttctcgctcgtgcgtcgcgtctacgcagacgtcctcgaggcggtggcacgcggtgagaccggaccgctcctcgccgacggccgacccctctacgacgccctcatcgagccatcggtgctctatgcccccctggttctcgagttcgcccgcgccggcttgctgcacgccgccgcgcacgtgacaggcggcggcctcgccggcaacctcgtacgggtgctgcctacgggcctcggcgtcgaggtcaagccctgggcctggcccgagatcttccgtcggctcgccgacgacggcgacgtctccctcgaggcgatgcgggccaccttcaacctcgggatcggcatggtgctgatcgcgccacccgatgcggcgagcgcgctccgcgagcgagtacctgacgccgtggacctcggcgtcgtcgaagcgagtgacgaaggagtgacatggtcgaccaccgtgccgtcctgatcgatgccctcgagacctacgggatcctccgaggtagcttcacgctcaagtccggtgccacctcgacctggttcatcgacaccaagcgtgcgatctgtcgaccgatggcactcgctgcgaccgcggaactcgcactcgaggcactcgatcccaccgtcaccgccatcggcggcctcaccatgggtgccgacccggttgccttcgcgaccgcgacgctcgcgcagctccggggccgcgcgctgaaggccttcagcgtgcgcaaggagcccaaagcctacggccagggaggggccattgcgggagcgctggaccccgacgacgtcgtctgtgtcgtcgaggacacgccgacgcgcggcgtctcgctgctcgcggcgatcgacgcggttcgcgaggtcggggccaccgtgtcccaagccctcgcggtcgtcgatcgcggaggcaccgccgccgacgtcatcgccccgactcccttcgtcgcgctggtccgcgccccggacctcggcctgccctacgaaggcagcgacagagcgtcttgacatctggcggcattgagcctagagtccgcttgggaggtgggtgtcgtgcgagtgagagcgtcgtcacggggaacatgggctgcgcggatcggtgtcgtcggcgccctcgccgtcgccgcagcggcctgcggctcctcgggcggggcaagctcgtcgtcgtcgtcgagcaccccgaccgcttcgttgccaccgtcgcagctgctctcggacgcctccgccaaactcgtctcgatgacctccttccgcttcaccggatcggggaacgtggcgaccccggcctcggcgagtgccccaagcgcgggatcgacgaccgtgaccccagccggctacgcgaccttcaccctgtcgggggcggcctcgatccctgagcacctcttcgaggtgacgacgagcgtccacggccttcgcatcaccgagatcgccacccagtcggatctctacctgcactatccgaccgtcgcgacaccgaacgcgaccgcaacgacctggctcgaaattccgtcgtcggtgctgcctatccccacgaacagctcggccttcgcgagcaaggttgcagcagcgctccgagccgccgtcaagccacagcccgacggcaccgcgacggtcgacggtcaaacgtgcacgctggtgaaggccaccatcagcgggtcggcgatgtcgcagctcctctccgcggccgatccgagcctggcaagtcaagcggcgtcgacgctcgacaccgtcagtgccgtcatcacggcggccatcaacagcgcacacgagctcgtccaggtgcacgaggccgtctcgaccagtgctggcgtccaggtgaacctgaccatcacctatgaagaccagaaccagccggtatcgatcaccatcccaccgtcgaacgaggtcgaactgatcacgagcgcgggcgagctgtcgggtgtcctcgggggctcggcatcgacatcggcgaaccaaggggcgtcacagggctagctctacgagctcctcgcaggcgggtacgtgccgtgcgtccgcacgagtatcggtagcggagcgttgctcctgggctgatggctcgagagacctccagagagcgcgaggagaccgcccggccccatgccagccggcatcaccgaagcatcccctatcgccacgtcccgcacgctctgtcgtccctggcgtcgacgctgcgagctggcagaggcatcctgtcccaccatccgcgccagctcgtgatgtcggcctaccaggggacgagcaccggtgatcaatcgctcgtgcggtcgccgcctgcgctcgcgccgccaacggcgtcgtgcgtgatcggacggtaccacgatggccaagcctcctggggtccctcgagtcgcgtcgtggcttcggggaccgcgacgcgccagtggtccgccgcggcgtggacaatggcacggctcagctcgcctgcgacgctcgccggcagcgcctgcaccatccaggcgacatcccaccacgcaccgagtcgcaaccacggaccgacggcctcgcaccaacggtcgagcgccgcgacgtcgtcgggagagccgagcgcaaaggtcacaggctctgcctgcctctgctccacggccacctcgaccacacgaccacgacgccgaacactgagccgagggtgcaggagttgcgcgctcgcatcgagaccgtcgtcgaggcgtgccgatggcccaagggccgcgcggtcgctcacttggcgcgcgaagacccagcgcgccaccgcggcttcgtcgccaggggagaggtggacgaagcgcaggcgccacacctcatcccccacaccgacgacctccgccaccgcccgcacgagccggccgctgacgtcgaacgacacggcccgcaccgtccccggcgcatcacgcaccccatcaggtgcttcgatcgcgacgcccccgaccgacacatcgacggtgaccatcgggacgccgagcgtgaatccgtggaggtagtacgtaccgcgactacgaaggacggcccgcggcccctcgcgcaggttccaggggcgcgcggcctccacccgaccacgaaggcgcccgtgctcggcgcgcacgagcgaggcgccgagccacgctcgcgcggcgacgcaccgggcagagatcgccatgacgctcgcggggtcgcacccgtccgccccgtcgaactcgaccgtcggtcccgcgagcgccgcgaccgtgacctcgatcccgaccggctcgaggcggacgaccttgccgggccagcagacgaggttcgcggggagcagcgccatggtcctcagtcgtcgatcgcgtggcgcacgacgccctcacggatggcctcgcgcatgaccgcttcggcaaccgcaggcgcgacgctccggttgaacaccgatgggatgatggtgctcggagagagctcgtcgtcggtgacctgtgcggcgatcgcctccgcggcaacgagcttcatgccctcggtgatcaccatggcgtgcgcgtccagtgcgccgcggaagatgcccgggaagcagagcacgttgttgatctgattcgggtaatcgctccggcccgtcgcaacgacggccgcgatgccttcgagcgactccgggctcacctctggatctgggttcgcgagcgcgaagacgatcggattcgtgcccatggtgcgcacgtcttcggcggtgatgacgcccggtcccgacacgccgatgaacacgtcggcgcccgcgagcgcctcgcccaccgaccccatgcgacgctctgggttcgtgtgctcggccaaccacgccttctcgccggtgaactcctcgcgcccgctgaagatggcacctcgacgatcggcgacgatgatgcgtccgacaccggcgtggtcgagaatcttggccgtcgcgacccccgctgcgccagcgccagcgatgacgacggtgagctcctcgagcttcttgtcgacgacccgacaggcgttgcgaagcgccgcgagcaccaccacagcggtgccgtgctggtcgtcgtggaagaccggaatgtcgagccgcgaggtgagcgcagcctcgacctcgaagcaacgcggcgccgcgatgtcctcgaggttgatccctccgaaggcaggctcgagcgccgcgatcgcctcgatcagcgcctcggtggtgggagccgtgatcgggaccgggaacgcatcgatccccgcgaactccttgaacagctgcgccttgccctccatcaccgggagcgacgcgtgcggcccgatcgccccgagaccgagcaccgcggtcccgtcggtgacgacggcgacgctgttcgacttgatcgtgtagcgatgcaccagactggggcgctgggcgatggcgagcgacacccgcgcgaccccgggcgtgtaggccatggagaggtcgtcgcggttctggatcggggtcttgccgcgaacctcgatcttgccgccggcgtgcagacggaacacgcgatcgaccagcgagcgcacgtgcacgcccgggacgccctcggcagcttctcggatgcgctcggcgtgctccggatcgcccgagagcaccgtgatgtcacggacgatggtcgcagcatccacctcgaccaagtcgacgccgagaatgttcccgcctgcctccccgatcgcggtggtcaagcggccgagggttcctggctggttggtgagctcgacgcgtagcgtcaccgaatgggagacattgggtgttgccatggcgataggctagcttgcccctcgtcggctaggttggccacgccatggcgaaccccctgcgcaccctcgatgagcgaacccgcgaggtcgccgagcgagcactcacctcgtggatcgcgaccacccctcgctccggctcgctggcggccctcggccttggcgtcgggctcgctgcgctgggtggcctcgcgaccagtgatcgagcgatcgccatcggtcatgcggcggcctcgggcgcacacggcgcgtcggtgtgggagacctcgacgctcgccgcgctcgccctcgccagcgctgaggtgccggtcgtctgctggctcgatgggaccatcgacgaccaggagttcgccgtcgcacgagagctggttcgtcaccgagctcgcgcgatcgccctcaccgactcgccagcgcgcgcggcgctggtccgtgccgccgggtggcaccgcgacgagctccgcggcgacgacctcgtcgcaggtatctcgctgggtcgagacctcgcccggcgtgaaggaccggccgcggtgatcgtgcacacgcccgagcacacggtcgaggcaccggaggaactcctgcgtcgccgagcgcgccgcgcgctccgagatgcccaaccgctcgaggtcgtcgccttcaaaccacccatcacggccgagacggcgctcgaggcggtcgacgaccgaggtcccgacgcccccgtgcgggcatttctcggcggcgcggggatcgttcgcatcacccgcacggggctcgcccgcgacctcgaggtgcgcctccgggccccggtcatcggggtccccgatcccgaggggctcgcgcgagaggtcgccagcgccggtgcgcgtgcggtgatcctcgacgtcgatggcgacacgctgatcgccgcctcccctgcgccaacgctggaactcgctccgatccgcacggaggacgtggcactcgccctcggtgcgctggtggcaggtgcgggcttgcgcgtcgtcgtatcgaccgtcgggcgggtcgcaggagtaggcgagcgcgtcgtgcaccatctcgctgccgacccgagcttcgtcatggtcacctgggcagcaggcgccctcgcaactgcccaggcgcgtgcactggtcgcaggcgagcgacgcacccccagcgtcgtcgagctcgtccagaccgatcccatcccagccgtgctcgacgagctcctcgctccggccgagcgcatcgtcgtcgtggggcccgcggcctcgggcgtggggcagcggctcgccggctggctctttgcccgcgacctccatcgccgcacccagtggtacgaaccaaccgtacccgcgagcgtgctcggcttcgccgcgcgcaccctcgcgagctcctgagcagccctgtctcaagccgccgtcacggcggccgatgacctggtgatcgctgatcaccgaggagggccagatggagagcccgcggcttcgcgagcgcgcagcttcgccaccgctcggcgccgcgctcgtggccgcgggcctgctcgacgagcacgacctcgccgtggcactcgagcagcagacccggagccgacgacgcctcggtgaggtgctcgtacgccgaggcatcgtcccacgcctcgatctcgcccgtgtgctcgcagaacgcgctcgcgtgcccttcgtgaccctcgtcgatcgcgagccacgacgggagctgctcgaggggctcgacctcgaggcgtgcgtccgcgagcggctggtcccgatcgaccgagacgacgatggcacgctcgtggttgcgagctcggaggtgccgaccgacaccgtgcgcgagagcgccgaacgtctcagcggcgctcctgtccggctcgtgctcaccaccgagtgggacctgctccgctacatcgtgcgcgcaggcgccgatcacatcggccgacgagcggcctacggtctcgcggagacggatctcgacctgtcggcagcccacgtgctcacgagggcccaagccatcggcctcgtcgtcgtcgcggtcgtggtcgtcctcgttggcatcgtcgacacccgagcactcctcggggccgcactcgctggcgctgccaccctcctcgcgctcgtcgtgctctttcgagcggtcgttgccttccggggcgccggcgtgccgtgggtcgtgccagagcgcctcctcgacgacgcagacctgccgacctacaccatcctcgtcccgttgtatcgagaggcggcggtggtcccggcgctcatgacctcgctcgccaacctcgactacccaccagagaagctcgaggcgctcgtactcgtcgaggccgacgacgacgccacccgggacgcgctcgtcgcggcgcgcccgccgagctgggtcaccgtcgtgaccgtgccgcccgaggggcccgcgacgaagccgaaggccttgaacgtcgggctcgcgctcgcctccggtgagctgctcgtgatctacgacgccgaggatcgacccgaacccgaccagctccggatcgtggcctcgatcttcgccgacgccgaccacgaccttgcgtgcgtccaggcagcgctgaactaccacaacgcccgccacaacctgctcacgcgcctgttcaccctcgagtactcccagtggttcgattacctcctccccggcctcgaggcgctcgagctgccgatcccactgggagggacctcgaatcacttccgcacgcagctgctgcgctcgttgggaggctgggatccgttcaacgtcaccgaggatgccgatctcggcattcgggccgcggtgaagggtgcccgggtcgccaccgccgcctccaccacgtgggaggaggcgaccgctcgccccggcgccttcatccgccaacggacgcgctggatcaagggctacgtccagacagccctcgtgcacgcccgccacccgatccggctggtccgagcggtcgggccgatccaggccctcgccttcgccgtcctcatcgccggcacgccgatcgccttctggacgatcgtgcccctcgacctgaccttcgtggcctctctcgtcctctcgccgcacgtcctcgtcgatctcgtaccgcgctgggcgctcgccgtcggattcgtcgacctcgtcatcggcaacgccgtggtgatctacctctccatcgtggccgtcttccgtcggcgtcaatggtcgctcgtgtgggccgccttgctcacgccggtctactggatcttgcactcgctcgcggcctatcgagccctcgcccagctcgtgacccggccgcactactgggacaagaccgaccacggagtcgcgctgtgaggggccggcgcattcgctggtggatcgtggccgcgagtgcactcccgctcgcgatcgccgagatcgtcggactccttcgcctgggcccgggcaccgtcgtcctcgaccacgtcgatcccctcggcatcggctcactccacgcggtcgtcgtcatcgccctcgcgaccatgacgccgctcgccgtaggtctcgccatcgcgagcgcgcatcgctggatcgcgactcggctcgaagcgacgccagcgatggtcacggctgcactggtcgcgttgtggtggctcctcgtgctcgcaggcacgacggcggccggggtgatcgacctcgcgctcctcgcactcctcgtcgtgtccgtcgccgaagccggcgccttcgtgctcggcgacacggtcacggctggggtcggcgcagggcttgccctctgcgcgctcgcgctcagcgacccgccccttgccctctgcgcgctcagcatcggcgcggtggtgctcgtgggactcggggctcgtggtagggacgaggccggcctcgcgttcttcgccgtccttgccttcccgagcgcggcgctcgtggtcggggtgcccttcgtcgactggcgcctcaccggcgacgcggccgcgacccgcgcctacgtcgccgccgtgggcatacaccatccgttcgccgcactcgtcgtcgcgtgcggcgcggttctcgcggccctcgccagaccacgggcactgctcgccgcggccatgctcgctgcagccgtcgcgggggccatcgtcgccggcatggacgcacgcgccatctcggcgctcgtcatcgtcggcctcgcggtcgtcgtggtgccattggtgggggggcgccacggcccgacgctccccatcgccgccgccggaacggtcggcgacgacggggcccagcgtcccaacgctgcctagcggcgccgacgcagctcgtcggtcgtgttcggcacgatcccagcccgctcgagcacctccgcactcacgccggcctcgcgccaggtctcgtagctgatccccttgcgttccccatagcgcgctgcatgctcgatgaacgcctcttcgagctccttgttgtcggcctgatgctccaggcgccacaactcactctcgaggtccttgcgctgctgcaacagctcgatccggtgcaccccggttgcgctctcgaggtctgccgtcacctgatccaagagcatacgaacacgctcgggagtgcggcggcgcccacgcctcggcttgttctcctcgagatagcgcaggtaggcgtccacggcctgggactccctacgcccgcgggcgatcgccgcgcgctgctcgccactcatctgacgaccgtcatcagccattgctgctccttctccttgtctccatcaccgcgagacagctgccacttccgaccgaggtccccggtcggcgacccagcgctccgaacgcgacggcgaggtgccgacaccacaaccaagagagccatcagcgcagctcatccacgctcccctcgacgttgcgtccaccggcccaaccacgccgatcgtcggcgcagtcgcgtcggagccggccagggggagtcacctgagccgtctcccacccacgcaaaaccgccgagacgaacccgccggaatgagcgagccggaacgccgcttcaggctctcgccaggcgaggcgaggcccacactctcctgatcgtcctcctgatcgtcaaacggtgtcgaggtcgccgctcttccctacttcccatgagctcgatgctcaccaacaaccatcatactggccggacgagttcatccaatgtatcgcaccgacacagcgaatcaggtcgtctttgcaatgcaattgcgatcgccaccgtgcgctcataattgctgcctcccagctcgagcgtgggcgtgacctccgatcgcacaatggcggcccggtaggctggcgccatggacgagccgcgccaccgatccctcgggctgaccgacgacgagtacgagagcattcacacgttgctcaggcgcgagccgaacgataccgagctcgcgatgttctccatcatgtggtcggagcacgcgtcctacaagtcctcacgggcactgctcggccgactcccgtcacgtggttcgcgtgtcatcatgggccctggcgagaacgccggcgtcgtcgcgctgacggactcggtggcggtcgcgatccgcatggagagccacaaccatccgagtgcgatcgaaccacaccagggtgctgcaaccggggtcggcggcatcctccgcgacatcttcaccgtcggagcacgacccatcgcgctgctcgattcgctgtggatggggccccaggacgacgcgaggagccgctggatcaccgacggagtcgtcggcggcatctctgcttacggcaacgcggtcggggtgccgacggtcgggggcgagctacgggtcgatgcgtgctacggcgccaatcccctcgtcaacgtcgtcgcggtgggtgtcgcgcccaccgaggcgctcgtgcgtgctcgcgccgagggtatcggcaactacgtcgtcctcctcggcgccccgaccggacgagacggcatcggcggggtctccgtgctggcctctgccggcttcgatgccaccgcggagcagaagcgcccgagcgtgcaggtcggcgatccgttcgaggagaagaagctgatcgaggcgtgcctcgcgctcatgcgcgccggcctcgtcaccggcgtccaggacctcggcggcgcgggactgacgtgcgcgacctcggagacggcggccgcagcgggcgtcgggatggacatcttcctcgacgccgtgccacgtcgtgagcccgggatgacgccgatggaggtcctgtgctcggagtcgcaagagcgcatgctcgccatcgtcgagcccgggctcctcgacgaggtcatcgcgacctgccgacgcttcgaggtgaccgcgtcggtcatcggggtggtgcgcccacccgatgcggagggcccgtacgccggtgaaggagttctgcgagccttcgagagcgacgggggaccgctcgccgccgtcatcccggcgcggctgctcgcccacgacgggccgcgctatcgacgccccatggcgccgccggccgacctcaccgagcgacgcgcacaggtcgtgaccctcgatgcgccgggagcgacgctcctcgccgaggtcgtcaacgacccgatcgaccccgccggggtgtggcgacgctacgaccacatgctgtttcgcacgagcctggtcgaaccaggcgccgacgcggcactcctgcgtgtgcgcacgcccgaggtcggcgacaccggacgcgccatcgccatcaccgtcgatggcaacaaccgctggacccgtgtcgacccgcgtcatggggctacgtggctggtcgccgaaggcgtcgcgaacctcgcgtgcgtgggggcaacgcccctggctctcgtcgactgcttgaacttcggcaaccccgagcaccccacggtgatgtggcagctcgccgagagcatcgacggcatcgccgaggcagcccgagcactgggggtccccgtcgtcggtggcaacgtcagtctctacaacgaggcagacgggatcgacatcgacccgacccccatcgtgtcgctgctcggcgagcgcgccacgccgaccgcgccggtacccgctccggagcgcgcccacggcagcctcgtcgtcctcgcgccacgaggggcagaaccccagctcgcgggctcgcgagcggcggccgtggcgggtgtcgatggcggcaccctggcgccgctcgactgggaagcgcaccgtcgtctgtgcgacgcggtggcggacctcgtcgtcggggacgaggtgagcgcggcaaccaacctgtccgccggcgggctcgcgcgatcagccgccaggttcgcccttcgcagtcggcaggaggctcggctcgagaccacggacacgctcgcgctcgtcggcgagcacccgtcgcgggtcctcgtcgccaccgacgacccggagaggctcgtggcctgggcgtcggcgaaggacctcgacgcgaccgtcgtcggctcgctggctccgtcgggcgagccagccctcgtggtcggcgcgcaccggatcgtgctcggtcgtacccaggacgtgccggcgctcgtgccgaccgacgcctaaccgagcagaccagcgagcaaccggccggcgggctcggcaagaccgtagcctccgccggctcgctccggatgcggcatgagaccgaccacgcgacccgacgcatccgcgatcccggcgatgtcgtgggccgagccgttcggattcgcgacgtagcggagcacgacgcgaccggactcctcgagcctgcgtagcgtgtcgtcgtcggcggtgaagttgccctcgaagtgattgatcggcagcgacagacgctcgtgtgccctcatcttctgggtcaagacgctctcgacgctcgcgacctcgacctcgacgtgctcacacaggaagctgaggcccgcgttcttctggagcgcgcccggcaggagccccgcctcgcacagcacctggaagccgttgcagatcccgaggatcgggaccccacgccgcgctgcatccatcaccgcgcccatggccggcgcaaaccgtgcgatcgctccgggtcgcaggtagtcaccgtaggagaacccaccagggatcacgacggcgtcgaccgctccgagctcgctctcgccatggtggacgaggcgggcggtgacgccgagttcggcgtaggcgccgaccacgtcgtgctcgcagttcgtgcctgggaagacgacgacggcgacactgctcacggggcaacgacctcgagttcggcgatgcgccacgtctggatcaccggattggcgaggaggcgctcggcgagcacgctggcctggtccagcgcatcacgctcgtcgacggcgcgaagctcgaggcgaaaggcgcgtcccgcactcacgttgacacccggcgcgagctcgaggtgccgagccgcgtccgtgatggcccgcccctcggggtccgcgatgcccggtctcggctcgaccacgaccaacgccacccaggtgtgcgcactcatgcccgctctcctccgtagggatcggcgctgcccggccactcgtcgaacgagcgtcccgtcagcgtctcgtagaccgtcacgtagcggccacgcagctcaccgacgagatcgctcggcaggggaggtggcggtccctcgccacggaaaccctcggccacgagccagtcccgaaggagctgcttgtcgagccactgggggttctggccgaggtccccggcgacgatgcgagccgcgtcgggcgtagcgatctcgtcggcgagcaccaacgcacgcccgtcgaggccgaactcgaacttcgcatccaccaaggtgagccccttcgcgtcgaaccaggacgcgagcagggagaacacctcgagggaccggtcggcgagctcgcgagcacgccgctcgccgacgagctcgccgagctcgtctggcccgagcggcaggtcgtggccgacgtgagccttggtcgtcggggtgaacaggggctcggggaatggagcaccgaagtcgaggtcccgtggcagctcgcgaccgaacgcggtgccgtcgcgctggtaggactcccaggcgctgcccaccagccgaccgcgcaccacgcactcgaccggcagcatcgcgagtcgccgcacccgaagcgtacgaccgagccacacatcggggacgtcggtcgcgacctcgaggaggtgggtggccacgtcgctcgcgacgcgctcgaaggccgcggccgcgatggccgtgagcagccgacccttgtcggggacgagctcaggaaggacgacgtcgaaagcgctcacgcggtcggtggcgacgaccagcagcgccgcctcgtccctcggatccacccaggtctcacggaccttgccgacaccaacgcgcgtgaggctcacgatgcctcctcgagacgagcgaacaggggggcaaggttcgcgaccaggcgctccgcggaggcgagctcggcgagctcgcccggggagagcggcacggcggggtcgtcggccagcgcatcgaggaagggcacgtcctcgtccagggtgcgagcggccgctgcctgaacgatgcggtaggcgtcgtcgcgagccatcccgcggcgcacgagtgcgagtagcacctgctgcgagtacacgagaccgcgtgtggcggcgaggttctgcgccatcgcctcggggtgtacggtgaggcccgccacgatccgcgtcgccagcgacgtgccgtagcaggccacgtggaaggcatcgggcagcatgacgcgctcgaccgacgaatgcgagatgtcgcgctcgtgccagagggcgacgtcctcgagcgcgggcacgacggccgagcgcgcgagacgggccatgcccgagaggcgctctgcgagcactgggttgcgcttgtgcggcatggccgatgagcccttctggccgacggcaaagggctcggccacctcgccgacctcgctgcgcgcgaggtgacgaacctcgagggcgatggtctcgagcacggctccgagcgcagcgagcgcccacacgacgtccgcgtggcggtcgcgggggatcacctgcgtcgccgacgtgggacgcaagccgagggcctcgagcgcgtgacgctcgatggccggcgagagcgcggagtaggtcccgaccgcgccggagagcttgccgacgctgatggtctcgcgggcagcgacgagacgagctcgcgcccgttcgagcgcgagccagaacagggcgagcttcgcgccgaacgtggtcggctcggcagccatgccgtgcgtgcgacccaggcagacgaggtcgcgcgtctcgagcgcacggaccctcagcgtgtcggcgagtccgtcgacgagctcgagcacccgatcggtcgcgtgcacgagcgccagtgacagcgcggtgtcgacgacgtcggaggaggtgagaccgaagtggatccaccgcgcagccggatcggcgatgcgggcttggagcacgtcgacgaaggccgcagtgtcatgatgggtgatgcgctcgcggtcgttgacggcctcgacgaaggcttcgtcgggcgtcggggcgagctggcgtaggcgcgcggcatcctcggcagggatctcgccgagggcccccagggcgtccgtcacggcaagctcgaccgcgatccagcgcccgaggcgcgcctcgtcggcgaagagtcgcgcgatcaccggatcctcgtagcgagggatcacgccaactcctttccgaccacgccgccgatgcaccatgccccaccgtccgccgcttcgcgcggcgatgagcgcgcgacgacgtcgtcggaccgtgggctcactcggcgcccaagcctagatcgctgcgccaggtcgcgccctcgatgcgaatcgcctgacgggcccgataggccacctcgcgcgccgtggccaggtcgtcgccccggcccacgacggtcaggatgcgcccaccggtcgtggcgagggcgccgtcggcctcggcacggaccccggcggtgtagacccgcgcgccgaggcgctccgcctcggcgatcccctcgatgcgatcgccaccgatcgacgcctccgggtagccacgggccgccatcacgatcccgagcgccgcgccggcctggacatcgagatcgccgatggtgcccccgcgggcagcggcgaccagggcgtcgacgaacccttcgccgaggagcggggcgatcgcctgtgcctcggggtcgccgaggcgcacgttgatctcgagcagcgacaggccgtcctcggtcgccatcaagccggcgtagagaaaccctcgatagacgatcccgacccgacgaagctcggcgaggagtggctcgagcacccgatcggtggcttcttcgatgagcgagtcgttggcccagggagccggtgcgtaggcacccatgccgcccgtgttcggaccgaggtcgccgtcgaggagccgcttatggtcctgggcgacgggcaacagccgcgcatcgcgctcgttcaccaaccagatcatcgagagttctcggccaccgagaccctcctcgatcacgaggcgccgacccgcatcgccgaacgcctcgcccgagagcttggcccgaacgtctgcctccgcggccaggcggtcgcgggtgacgagcacgcccttgcccgccgccaacccgtcggtcttgatgacgtaggggggcccgaagcgatcgaagagcgcagcggcctcctcgatcgtggtggcgacgccccagcgagccgtcgggaccccggccgcgtcgcagagccgcttcatcgcgatcttcgaaccctcgagcgccgcccctgctgcacctggtccgacgacgaggcgccccgcggcgcgaaggtcgtcggcgagtccggccacgagcggagcctccgggccgatgacgacgaggtctgcctcgatggctctggcctcgtcggcactgacctcgaagcgggtcgcgatcccggcgttgccaggggcgaccaccaccgaggctcccccacgcgagacggcgtcggcgagcgcgtgctcgcgagctccggagccgacgatgagcactcgcatgggctctacgagagctccacgatctggtcgcggctcgggccgaccccgacccagcgcaccggcacctcgatccgcgcctcgatgaactcgaggagccgacgagccgccgcgggaagcgcggatgcagtggtcacctgtccgatcggggtcttccagcccggcagcttctcggtgacgggatgggcgcggtgcagatccgactggtgatacgggagctcgtcgaccctctcaccagcgacctcgtaggcggtgcacacctggatctcgtcgaaggtgtcgaggacgtcgagcttggtgatggcgagttcgctcaccgaattgacgcgcaccgcgtgctggagcagcacgaggtccagccagcccgtgcggcggcgccggcccgtgttcgtcccgtactcgtgaccacgatcaaccagcgcatcggcgagcggcccctcgagctcggtcgggaaggggccggcaccgacgcgcgtggtgtaggccttggcgacgccgatgacctgatcgatctggcgaggcccgaggcccgagccggtgcaggcgccaccggcggtggggttcgacgacgtgacgaacggatacgtgccgtggtcgagatcgaggaaggtggcttgggccccttcgagcaggatcgtgcggccctcgcgccagagtcgctggacgagccccaccgaatcgacgatccgaggcgcgatcaggggtgcgtaggtaccgaggtagtcggcgacgacccgctcggggtcgatgggtagacggttgtagcccttcgcgagcacgaggttcttctcgcgcagcgccacgtcgagcttggcccggaagatcttctcgtcgagcagatcctggactctcaggccgatacgggccgccttgtccgcataggccggaccgataccgcgcttcgtggtgccgagctgtgccttgccgaggtagcgctcggtgagtcgatcgagctcgtggtggtagggcatgatgagatgtgcgttgcccgagacgacgagccggctcgtgtccacgccgcgctcttcgagcatgcggagctcctcgacgagcaccttcgggtcgacgaccacgccgttgccgatgatggggatcacgccgggatagagcacgccgctcgggacgagctggagcgcgaacgcatcgccgtcgacgacgatggtgtggcccgcgttgtgtccaccctggtagcgcacgacggcagcggctcgccctgcgagtaggtcggtgatcttgcccttgccttcgtcgccccactgcaggccaacgaccacgatggcgcccacgccacctccttcgactcgggtgccccgccaggctagggcacgcggaacacgaggggttcgccgttggcgatctcgagcgagaccacctcgtcatcgtcgaggtcgcgcagcaccttcacgaggccccggagcgagttgccgtgcgccgacacgagcacggtgtgcccgtcccacagcagcggcacgatgacgtcgtagtagtacggcagcacccgatcgatcacgtcgcacagcgcctcggtacgaggcacgagtgcgagcgggagcatgcggtagcgctcgtcggcatgcaggagacgctgggcctcgacgtcggtctcgggtgggcgcacgtcgaagctccgacgccacagcttgacctgctcgtcgccgtagcgagctgcggtctcggccttgttgagtccctggagcgccccgtagtggcgctcgttgagccgccagctgcgcagcaccggcagccaggggcgctcgagttcgtggagcatcagctcagcggtcgtgatcgcgcgctcgaggacggaggtcacgaggacgtccggccgaaggccgtcggcctcgatcgccttggcggcctccttcgcctccgcgacaccctggtcggtgagtggcacatccacccacccggtgaagcggttctccgcgttgtacgtactctggccgtgccggacgaggatcagcgtgcccacgtggctcgagcctagcccaccacgccaatggtcaagaaccggctggtcggtgaccgattgaaccgtgtgggaatgtttctgcggcgtgaagcgtcctaaaacttgatattctgtgactcaagcttcgcaggggctctcgcgtcaggagacgccgatccccacagcccagctcacagcagacacggacggacagcaagcacggtcgtaacaggcaagcacaacacaggaggagcagccatgcccaaggcagtcggcatcgatcttggcaccacgaactccgtggtcgccgtcctcgaaggtggcgacccggtcgtcattcccaacgcggagggtggacgcaccaccccgtccgtcgtggccttcgccaagaccggtgaggtgctcgtcggcgaggtcgccaagcgccaagccatcaccaaccccgatcggaccatccgctcggtgaagcggcacatggggaccgattggaccatcgacatcgatgggaagcactacacgccccaggagatctccgcgcggatcctcgccaagctgaagcgagatgccgaggcctacctgggcgacaccatcacccaggcggtgatcaccgtccctgcctacttcgacgacgcgcagcgcacggcaacgaaggaggccggacagatcgccggcctcgaggttctgcggatcatcaacgagccgacggctgcggccctcgcctacggcctcgacaaggaagccgaggaccagacggtgctcgtcttcgacctcggcggtggcaccttcgacgtctcgatcctcgagatcggcgagggcgtcttcgaggtcaagtcgaccgcaggtaacacccacctcggtggcgacgactgggaccagcgcatcatcgactggctggtcgcgagcttcaagaaccaagagggcgtcgacctctcgaccgacaagatggcgatgcagcgtctcaaggaggcggccgagaaggccaagatcgagctctccgcgtcgctggagaccatggtcaacctgccgttcatcacggcgacgaccgaggggccgaagcacctcgagatgaagctcacccgagcaaagttccaagagctcaccgccgatctcgtcgaggcgtgccgcgcaccgttcgagcaggccattcgtgatgcgaacctgtcggtcggcgacatcgaccacgtggtcctcgtcggtggctcgacccggatgcccgccatccaggagctcgtcaccaagctcaccggcaaggagccgcaccgcggcgtcaacccggacgaggtggtggccgtcggtgcggcgatccaggccggcgtgctcaagggcgaggtgaaggacgtcctgttgctcgacgtcaccccgctgtcgctcggcatcgagaccaagggcggcgtgatgaccaagctcatcgagcgcaacacgaccatccccaccaagcgcaccgaggtcttcaccacggccgacgacaaccagccctcggtcgagatccacgtgctccagggcgagcgcgagatggcggcctacaacaagacgctgggccggttccagctcgtcgggatcccgccagcgccgcgtggtgtgccgcagatcgaggtgaccttcgacatcgacgcgaacggcatcgtccacgtgtcggcgaaggaccgcgccaccggcaaggagcagtcgatcacgatctcgggcacgacgtcgctcggcaaggacgagatcgagcgcatggtgcgcgacgccgaggcccacgaggccgaggaccgtcgccggcgcgaggaggccgaggtccgcaacaacgccgacaccctcgtgtaccagaccgagaagctcctcgcggaacagggcgacaagctctcgggccccgagaaggatcgggtcaccgaggccttggggcagctgaagctcgcgctcgacggcacggacatcgccgcgatccgcagcgccaccgacgcggtggtctcggcgtcccagagcttcacccagcggctctacgaggaggcctcgcgcagcgcccagagcgccgatgccagcggccagtcgagcacctcgtcggaggatgaggtggtcgatgccgagatcgtcgacgagtctggagagcagaggtcctgagccatgggcaagccgtacggagacgacgccgacgagccggtgacgccgtccgaggacgccacgcccgtcggggggtccccccccgacgggacgaccggcgacgacgagccgaccgcggaggtgcagccgagccccgacgacgaggggcgagagagcgatccggtcctcgcggcgatcatggaggacctcgcagccgtcacacgggagcgcgacgagttcctcgagaccgcacagcggctccaggcggagttcaagaactaccgcgagcgtgtcgcgcgccaacaggccgaggccggtcaagctgcggtcgcgagcttcgtgacgaagctcctgccggcgctcgacaccttgaacctcgccctcgcccacgcccgtgcggagggctccgaggagacgacgagtgcgctcgcccaggtgcacggcgtcttccacgaggtgctgaccaaggaagggctcgaggtcgtcgagcccatcggcaagcgcttcgacccgaccgaggccgatgcggtggcccacgaggagggcgagggcgagcccacggtcacggaggtgttccgggcggggtaccgctggcgcggacaggtcatccgaccagcgatggtgcgtgtgagcggatcgtgaacgcgacgagcgagacgggctcgtcacgaggggcgagaagggaggtgagctgacgtggccccggcgagagagtggttcgagaaggactactacaagatcctcggcgttcccgagacggcgagcgagaaggacatccagcgtgcgtatcgcaagttggcccgccagtaccaccccgatgcgaaccccgggcacgaggagcgcttcaaggaggtctccgcggcctacgacgtcctcggcgatcccgccaagcgcaaggagtacgacgaggtgcggcgcctcggtccgctcggatccatgggcgcccccaccggcaacggcacccgtggcgccgggacgttccatgctgaggacctcggcgatctgatcggctcgctgttcaatcggggccgtcgcgaggccagcgggcctcgacgcggcgccgaccaagaggccgaggtcaccatctcgttcgaggacgcagctcgtggcgccgaggtgcagatccccgtcaccggtgaggcggcgtgctcggtgtgcaagggtacgggtgcagcccccggcaccgtgccgaagacctgcgcccgctgcaatgggaccgggacggtctcggacaaccaggggttcttctccttctcgcagccctgtcctgcgtgccacggccgcggcctcatcatcgagcagccctgtccctcgtgccacggcaccggcaccgagcaccgaacccgcatcgtgaaggcgaggatccccgcgggtgtcgagcccgactcgaccatccgcctgcgcggccgtggcgcgccggggcgcaacggggctcctgcgggcgacctcttcgtgcgggtgcacgtgctgccgcatccgatgttcggtcgacgcggagcggatctcacgttgcgtcgcacgatcagcttcgccgacgccgccctcggcaccgtcctcaccgtgcccaccctcgacggcacggtctcggtgaaggttccgcctggcacgagcgccggcacggtgctgcgggtccgcggcaaggggctccccaaccccaagcgcaagggagcccgcggcgaccttctggtcacgatcgacatcgacgtgccggacaagctcgatgccaagcagcggcgctacctcgaggacttcgctcgcgtcttcccccacgacgcagcctgaggtgctctgagccacgagaggaggtgagatggctgagcacgaccgatcgcactccccggagcgctcccgcggcctgtacgtgatctccgtcgccgcagagctcacggggctccatccgcagaccctgcgcgtctacgagcgccgtggcctcttggagccgaggcgcaccggcggcggctctcggcgctactccgaggccgacctcgctcgcctgcgccgcatcatcgagctcacggagcagggcctcaacctcgagggcgtgaagcgcgtcatcgagctcgaggaggaggtcgagcggctccgcgccgaactcgacgctgcgcgccagcgcgcccgcgagcgcgagcgcgagctccatcgccactaccggcgcgacctcgtgccgctcagccaggcggtcatcgtctggcagccacaacgccaacgcacgggcgacgcccgctgatccatcgagtccctcctcccccaaccccaacccccaaaccacgaacgaccacgccggcccgaggccggcccggaggcaaccatgagaaccgatcacttcacccacaagctccaagaggcgctgcaggatgcgaagcgcctcgccaccgagcgccagaaccccgaggtcaccccgcagcacctcgcgctcgccctgctcggccaacccgacgggatggcgctcgccgtcctctcgcgagccgggatcgctcccgccagcgtgcgcaaccagctcctcgaggccctcgagcgcctaccacgcgcctacggccaagcggccgaaccggcaggatcggcggcgctcgcacgggtgctcgagcgcgccgagcagctgcgcggtgagtacggcgacgactacctctccgtcgagcacgtcctgctcgccatggcggccgtgctcaaggtcgacgaggcgacgctgcgccaggcgatcgacgccgtgcgtggcggacgccgtgtgacctcggccgaccccgaggacaccctagaagcgctcaccaagtacgggcgcgacctcaccgaggctgcacgcgcaggctccatcgaccccgtgatcggccgtgacgaagagatccgtcgggtcatccagatcctctcgcgtcggcagaagaacaacccggtcctcatcggcgaacccggcgtcggcaagaccgcgatcgtcgaggggctcgcacgccggatcgtcgaaggtgacgtgcccgaaggcctgcgcggcaagcggatcatcgcgctcgatctcggctccatggtcgcaggagcgcagtaccgcggtcagttcgaggaacgcctcaagagcgtgctcgacgccattcgccagagcgaaggcgaggtcatcaccttcatcgacgagctccacaccgtggtcggtgcgggtgcggccgagggatcgctcgacgcctccaacatgctcaagcccatgctcgcgcgcggcgagctgcgcatgatcggcgcgaccaccctcgacgagtatcgcaagcacatcgagtccgacgccgcactcgagcgacgcttcgccaaggtcatggtcgaccagcccagcgtcgaggagacggtcgcgatcctgcgcggcttgaaggagcgctacgaggtgcaccacggcgtgcggatccaagacgccgccctggtcgctgccgcggtcctgtcggatcgctacatcaccgatcgcttcttgcccgacaaggcgatcgacctcgtggacgaggccatggcccgactgcgcatggagatcgactcgcgacccgaggagatcgactccgtcgagcgccgtctgcgccagctcgagatcgagcgcatctcactcgcgaccgagaccgaccgcgcctcacgcgagcgcctcacccgcctcgaccaggacatcgaggccacgaagctcgagctcagtgagctgacccgccagtggcaagccgaacgggaagcgatcgacgtcatccgccagcgcaaggagcacctcgaggagctgcgtgcccagtcggaagcctacgagcgccaaggcatgctggaccgcgccgccgagctgcgctatggcgagatccctcgcctcgagcgcgagatcgaggaggcgaccgaagaactctcgaagcgccagggtggccggcgcatgctcaaggaggaggtcgaccccgaggacatcgccgaggtggtcgcggccgcgaccggcatcccggtgaccaagctcctcgagagcgagaccgagaagctgctccacatcgaagacgcactgcgtgcgcgggtggtgggtcaagacgaggcgatcgacgcggtggcgaacgccatccggcgcagccgtgccggcatcgccgatcggaaccgccccatcggctccttcctcttcctcggcccgacgggcgtcggcaagaccgagaccgccaaggcgctcgcggagtacctcttcgacgacgagcgagccatgatccgcatcgacatgagcgagtaccaggagcgtcacagcgtctcgcgcctcgtcggtgcgccccctggctacgtcggctacgacgagggcggacagctcaccgaggcggtgcggcgccgtccctacgcggtggtcctcttcgacgagatcgagaaggcgcacgccgacgtgttcaacgtgttcctccagatcctcgacgacggccgcctcaccgacggtcaggggcgggtggtgaacttcacgaacaccatcctcatcatgacctcgaacctcgccgacgatccgcggcgcttcttcaagcccgagttcgtgaaccgcatcgacgagatcgtgcgcttccacgagctcacctcggaccagatccgcgccatcgtcgaccgccagatggcccaactcgccggtcggctcgccgagcgctcactcggtctcgaggtcaccgacgccgcggcggccctgctggccgagcgcggctgggatccggccttcggtgctcgacccctgcgtcgagccatccaacgcctcgtcggcgacccgctggccagagcgcttctcgaagggcgctacggcgagggagacacggtcgtggtcgacgcggccgacggcgccatcgtgctgcgctgagcacacggcacgaccgacgacgcacctcgggaagccccggggtgcgtcacgtcgtcgggagcggccacgggagttcgtagagcgcgagggcgttctcgtaggcgacgagcctggcgagtcgaaacgcctctcgttccgcaatccagccctcggcgagcaggggctcgaggtaggcggccatggcgcgccgatggccgagcgcaccgagcgcgtagagctcggggaggccgaacgcgtccgaggagtagcagagcttgccccacggggcgagctcgagcatctcggcgagcaccgccggggctgccgggcccacgaaggactccgcgaggccgagatccacgaagacgtgcggatagtcgtgggcgaggagtgccgcctcgcgatggaagggataggtgtgcagcagcacgaggcgcacgccatggggagcgatggcctcgatgaagggctggagctcaccagggtgaccgcgtgccaggcgaacgtccggatcgccgatgccgacgtggaactggagcggcaggggtgccacctcgagtgcggcccacacgatcgccgcgacgaggtcccggtcgacgacgcgcaccccatgtccacggtcgcgttcgtcgaggatccgtgcgagtgccgtctcgagcgctcgcggcgcgggaggtcgatcgggaagatcgaggccactgcgataggcagccaccgacttgtaggcgaccgcccgccgcgcggcccgggcgacggccgcctcgagcgcagcccggaagtccgccgtcgcaccgaggtcggcgagcacacgttctgcgatcgcctcgagtcggaccacctcgagcgcgggtaccccgctcgccgcctcgagttcggcgggctcgagcacgagttcggaacgaaagccggtgtcgacgagcagcccacggacgccgcccgtggcgagcgagcgtgcaaacaggtcctccggtgcgtacgcggcgcgcgccgtgaggtagtcctcacttcgaaccggggcctcgagcccgagcacgaggccgagcgctgcgcgcacgccgatgccgagcgaggactcgagcggggtggtacgagccgcgaggcgatcgggggcttcggtgaggtggtcgagcaccgtgtcggtatcgggggcttcgcgtacgatcccatgacagtgatggtcgaggagggggacgtctgccaagcgttccgcgagcacactggcgggcgcgagcgggttcctcaccgctccacctcgacgagggctcgggtcagctcctcgtagcgagccagtcgacgacgcgccggctcgccgatgcgctgcaccacggcggcgatgatcgcctcgacgagcgcgagggccggcgtgagcgcatcgaagatcccgggtccgtcgacctgggtggtgagcaccaccgagctgcctggcgcggccgggctgagtccagggtcggtcacgagcacgacggtcgcgcccgcctgactggcggccgtgacgaaccgggcggtctcgagctggtagcggacgaagtcgaaggcgaccaccgtcgtcgaggcatccacgtcgagcagggcattcacacgagcgccggcctcgggcggcacgtggcgcaccgacggtcgcaggacctcgagcgtccaggcgaggtgacgcgcgacgacgtcactcacgcgcccaccggacaccaccaccggacggcggacgtcggcgagcagggtgacgacggtgtcgagcgactggggcgcgagcccgacgaacgagcggcggatctggtcgatgaggtcggcttcggccgagccaacgtcacccggcccggtgacctcgaggcgctcgagcggcgaggcgagccgctcgccgatctcttcgcgcgccgccgaccggaactcctcgaccgagctgaagccgagcttggcgacgaagcgcaggaccgtcgggggcgagacgtcagcgagcgctgcgatgtccgcgagtcgctcgagggcgacgaccgggtactcccgtaacaccgcttcggccacacggcgctgggcggggccgagctcgggtgcgactcgacgcacccgctcggcgagcgacgtcatgaccagctccaacgcatcgccgcgaccagctcctcgggcgtcgcgtcggcaaagcgagcgagctcggcctcacggacagcgccgatggccgtgaggaaggacctgcccaggacatcttggagtagctccgaggagcgcagtgcgccgagggtggcggcgagatcaccaggcagtcgctcgaggcccccgtggtgcgcgggatcgccctcgacgggaggcggcggcgtcctcgggtccgcgagcgcatggcgcgcgatgccgaggagggaggtggcgagcagatacgggttggcaccgagatcggcgcccttgagctcgacgtttgccgcgcggccatcgaccagcgtggccgcaggcacgaggcgtagggccgcctcacgattctcgatcccccagacgcgatacgcacctgcccagtggctgggcacgagccggaggtacgagaccggatggggggctgcgatcgcgaggatcgcggggagctcctcgagcagccacgcgatcaccgactcaccctcgggacgcacgccgccaggcccgtcgccgccggcaaagatcggctcgccgtcacggtagagaccgaggtggatgtgtccgccgttgccgaccccaccgacgtccaccaccggcgcgaacgacgttcgcagcccgtagcgctctccgacggcccggatcacggagcgggcaagcacggaggcatcggcggctcccacgggatcgctcggggcgagcgagagctcgaactgcgccggtgcgtactccggatggagctgtgccaccgcgaggcccgccgtctcgagggcgtcgtacaacgaccggagatagtcggcgagctcgatcacgcgcgacagtccataggccggccccgacgtcgcgggcacgaagtcgtcttgaccggcgaggccgacgacccactcgagttcgatccccatcgtcgcgctggcacccgcatcggcgagcagggcaacctcgcgctggagcgccgagcgagtgcagagctcgtagggagtgccgtcgcggcggaagcggtccaccggcgcaaaggcccatccatcgagcggcgcgagcggcctcaggaaccgggggtcgggacggagccggaggtcgtccatcgggccaccgctcacgctcgaggaggtgatggagtcgtcggtgagaaaggcgtcgaagaccgggctcatgccgacaccggcgtcgcacgccacggcgaagccctcggccggaatcgtcttcacccgtgcgatcccggcaaggtccacgtagaccagcgccacctggcgagcgtcaccgagcgccgaaacgtcgctccccgagcggtcctccagatcgcgctgtgctcgctgctgcgactcgtcgacgaccaccacgcctccttctggccgatgcggctccgaacgtagcgcacacaggtcgcccgggccagcgctgtgacacaatcgtaacaacaatcccttgcgctgaaacttcagtaacagctaccatacgtgcaccgtcgagagggggacgtatggccggtggttccaccaagctcaggggcaatctgtcgctctggcaggtcgtcggggtctccgttgcgctcatggctccgtcgatggccgccaatatcaatcctcaaggtgcgatcggaacggtgggacgcgcgatcccactcaccttcgtcctggcgttcgttgcggtgctcttcatcgcctatgtcttcgcccgactcacccagcgcttcaaccacgcagggagtgtgtacggcttcgtcggcgcgaccctcgggccacgctggggcgtggtggccggctggtcgctgatcggtacgtatgtgtcctacggtctgctcacgatcatggcgtcaggcatcttcctgacagccctcctccaggcgctgtcgatctggcactctcctcctgcctgggccccgttcctgctctcggggatcgaggtcgtcggcgtcgccatcctcgcagcacgaccagctcgcaacgcgacgcacgtgctgctcgtcacggagctcacgaccgtggcgctcatcatcgtgatctcggtggcgaccctgatcgaactcgcggtgggacatggcccgagcgggcagcacttcacctggagcgtcttcagcgttccccatggcatcagcgtctcggcactgttcctcggggtcgtcttcgggttcttgtcgttcgcaggcttcgaggcatcggcaacgctcggcgaggagtcgaagcgaccacggcgtgacatcccacgggccatcgtgggaacagcggtcttcggcggcgtgtacttcatcgtcgtgaccgcggccgaggtgatgggatttggcaccaccccacacgacctcgcccgcttcgccgcgacgggatcgctgctcggcgcgctcgggacgacgtatctcgcggcctggctcggcaacgtcgtgacgctcggcaccgtgatctcggcctttggctgctcgctcgcctcgacggtcggggccagccggctcaccttctccctctggcgcgacgctcgcggtgcgagtgggctcggggtggcctcggagcgctccggtgcgcccgttcgtgcaaccctggccgtcgtcgtcgcgatgctcggcatcacctggctgagcgcgatcgcgttcggcgcgaccgccttcgatgtcttcgcctggttcggcaccatcggcaccctcatcatcctcgtcgtctacctcctcgccaccgtcggtgcgatccggttgctgttcttcaaggagcacaccgtggcggcgtgggagatcgtcgtcccggtactcgcgggcgtcgtcatcgcctacacgctctatcgcaacatcctgcccttgccgacaggtgccgcgctttggttcccgatcgtggcagccgcctggatcgtggtcggtgcgatcggcgtcatcaccgcacggcgaagcgcggagcgcatcggagcggccatcgcgcgcgacgaaggcctcaccctcccgagcgcgccgacgcccagcagccaggggcagccggcgccggccgactaggcatctctcgaccaccatccagatggggccgttccccacggccccatcccccacgtcacgtcgtctgaacctgccaccacgaaggagttctctgtgtccacgtcctccgagcaccgcctctccgccaacgccatcggacggcgcgaggtcctcttccagagcgtcaccgcgatggcacccggcgccgccatcgcggcttcgatcccggccggtgcaggcttcgctgggggagcgcttgccctcgcggtcgtcgtggcgctgatcggaagcctgctcactgccctctcgatcggtgagctcgcctctcggttcccgtcagctgggtcgttcgccacctacgcatcgaaggcactccaccccatcgtcggcttcttcgttggctggtcctacgtgttcgtctacgccctggtgcccgcactcctgtttctgcagctcggcttcacggtcgcggggaccctccacagcgagttcggctacccggcatcgctctggtggccatggtcgctcgcgggtatcgcgctcgtgggaaccttggcgttgctcggtatctcgacatcggccaaggccgggaccatcctcggcgcgatcgagatctccgtgttcgtcgtcgcagcgatcctgttcatcatccacgccggctcgcacaactcgttgacgccgttcacgacccgagacaccccccatgcgttccccggcctgaccggcgtgttcgccggctccgtctacagcctcctcgccttcgcgggcttcgaggcagccgctccgctcgccgaggaggcgcgcgatccgaagcgcaccgtccgcttcgccattctcggctcgacccttatcatcggcctcatctacgtcttcaccacctacgccgccgaggtcgccgccggacccagccacttcgcgtcctttgccggggctggcgccgagtcgtggattggtctctcgaggagcttcttcggtatcttctgggtgctcgtgttcctcgccatcttgaactcgacgatcggcaacgccaatgcgggtacgtcggtgtcgacgaggatggcctttgcgctcggacgcattggggtgttccccaccctgctcggacgggttcacgagaagacgaaggttccccacgtcgccgtctactcccaaatcatcgtctccgccgtcgcaacactcatcctggggctcgccttcggaccggagaacggcttcgctctcgacggcacgatcatcaccatcgtcgtcgtcgcggtctacatcgtcatgaacctcgctgcactcgtctacttcgcacgtcgcgcaaatggagagcgcttcaacccactcctccacggcctcgcgccgatcgtcgccatcgccttcctcctccccgcgctcctcgccggggccggcatcgctgtcttctcgttcatctcaccgctgaccccaccggcgtcctacgctggtcccatcgtcgccgtgtggctggtcgtggggatcgtcgtgttcttgaacctgcgtgcacgtgcgccacaggccgtcggacggattgccgaggtctacctcgacgacgtcctcgatgtcgaggaggcatgagatggcagtaccggtcgtttccttcacgccaacccctgaccagctgtgttggaccttcgggggagcagaccccgtcgcagagatcgaacccggcaccattctcgaagtgttcaccgaggactgctttgctggacgggtacgccgcacgacggacctcgtctcggaggtctgcgagttccccttcctcaatccccagaccggcccgttcgcgatcaagggcgccgagcccggcgacaccctcatcgtgcacttcatctcgatcgagccggcacgagactgggcggtctcgacgaccgtgccgctcttcggcgcgctcacctcgacccacctcaccgcaacgttgcagccacctttaccggagatcgtgtggatctgggaactcgatcgcgagcgccgcacgtgccgcttccgagcgtcgaagggcgacaccacgatcgagctccccatggacccgatgcacggaacagtcggggttgctcccgcgaatctcgaagtacgctcggccctcgtgcctgatgcccacggcggcaacatggacacgcccgagatgcgcgcgggcgtgacggcgtactttggcgtgaacgtggagggagcgatgttctccctcggtgacggccacgcgcgccagggcgagggcgagagctgcggggttgccgtcgagtgtgcgatgaacacggtggtctacgtcgatctcctcaagcagaccgcaaccccgtggccgcggctcgagtccgatcagttcctcatgacgaccggctcggctcgaccactcgaagatgccttccgcatcgcccacaaggacatggtggagtgggtagcggatctgtgcgaactcgacatcatggacgcctaccagctcgtctcacaagccgcgacctcaccgctggccaacgtctgcgacacgaactacaccgcggtcgcgaaggtcgatcgaacattggtgccgctccgacacgacccctatgcgagcgcccatcgccgagcgcgcgctgtcgcggcagaccacgcatccagtggatcgctcgactgaaatctcggatcctacgactccggggcctagcacgataggtagctccgctcccgctcgacggcgaggagactctgagggttcgatcgagccaggaccgtacgcaccgctgctggaccctgggcttcccttcgacaagttcacgcgctgggtttggtcctgtcctatcggcgagacgagaacgaccctatgcagcacacttcgaccccacagcacgagcgacggtgcccgatggccacgggcgcctggatcagcgttccatccttcggacgctgctaaggtaccgaccaatgcctagtctcctgcgcttccccgtcggtcaggcggtttttcagcttccagaacggcttaccgaggtcaactcatggcacgggcacatccccttcgccttctggatcgtcgaagcactcgagccgtcggtcttcgtcgagctcggtgtccaccgcggggactcctacttcgccttctgccaggccgtcaagtctctcggacttgacaccaggtgctacggcgtggacacctggaagggcgacgctcacgccgggttctatggggaagagatctacgaagacttctctgcgtacaaccgcgagcactatcaagacttctcaaagccattacgcaccacatttgccgaggctatcgagcagttcgaggacggcagcatcgaccttctccacgtggacggctaccacacctacgaggctgtcaggtcggactttggatgctggctccccaaactgagtgagcgggccgtcgtgctcttccatgacatcgcagtcaccgaccgggggtttggcgtctggcgcttctgggaggagatcgctgcgcagtacccttccttcggcttcatgcattcctttggtctcggagtgctcggcgtcggcaaggagctgccagacagcctagctagcttcttcgaagacgccaaagcgaaccctgagatcctgcactccttctatgaggcgcttggaacgagatgccaactcttcggcgatctccagcgcgctcgagatgagcttgcgaataccactgcagccccagctatttccgaggaagtagccaccttgcgccaacaagtactcgacctcacctaccgctacgaacgagcgctcgagcgtaaggaggcggaggccgaacagttagaagccaaggtggtagacctcgaggcacgccttggccagtcgtcgcactcggccgcagccctcgcagaacaccttgcgtcagtcacggctcaacgcgacgagatcctccaatcggagacctggaaactcaccgctcccgctcgcggcttcctctggtggatgcgtcgagtggcgaactggagacgcttcacacagacgttccgtgtcacactgcagccccttcagggtgttggcgagtcactcttcgagaccgacagcttcgtggctctcggtggcagaatgcgctttgcaatcgaaggcgcacctcggcctcccgggtggtacgagctgacttgcacggtcaccaccacctccgacctctcgaaaatgcgcccctacatcatcaccgagacacaagaccaccaacgctacagccaacagattccaggcaaggtcgacccagagggccagatccgagtcctgttccacgtcaacaagcaagctgctcgccacgagctgctgctcgtgggcctcaacgggatcacctccatttccgcaccacgcgtcaagccagcgctgcaccttggcgagccgatggctcgcatacttgccgccgcgattgttcccacaatcgcgtacgcagacctgccacccatcgcagctcatcaagagctcctcccgcaggaggacgagttctcccgctggatcgaacgcaacgagcggatcaatcaagacgaccgagagcgcgtcgcccgagagctcgccacctgggaacacccaccactgatctccgtactcatgcccgtctacaacacgccaatacggcacctcgtaaccgcgatcgagtcggtacgggcgcagtggtatccccactgggaactgtgcatcgccgacgatgcttcaaccgatccagagattcggccgatccttacccgctatcaggaggcggatccccgcatcaaggtcgccttccgagacgagaatggcggtatctcggcaaactcgaatactgcactcacgctcgcgaacggcaagtttgttgcatatctggatgccgacgacgaaatctccgaagtcgcactcctccactacgctcgagagattcatgagtatcctggagtcgagttgctcttctgcgacgaagacaagatcactgaagatggtgatcgctccgacccctacttcaagccgagcctctcccccgcgctccttctcgggaagaactgcgtcactcacctcggcgtctatcggaccgacaccgtccgccgcctcggcggaatgcgctcagagtttgacggatcccaggactgggacctagcactacgctttcttccgatcgtcggtatagacttcacgcgcgcacgtcgcatcccgcggctgctctatcattggcggcggatccatggctcgacggcaaccacactccgatcgaagagctgggccgttctggcggggcggcatgccgtgcaagactacttggatacagcagtgccaggtgcgaaggctgagcccattccgcgcgcctccaatctcaaccgactcgttctcccgactccggatccagctccattagtttcgattcttctgcctaccgcgggaaactatcagctacttcgcggctgcctcagctcgctcctcgaacgcaccgactacccccgcttcgaagtgcttatcacgatcgactccgacaaccccgacgcggactcgctcgcataccttgacacccttgagcacaccggaaaggtccgggtgatccggcgtcggcgcccgcctggcgaaacctttaactactcccggatagtcaacaacctcgctcgctacgcagcagctgacctcctcctgctcctcaacgacgacaccgaggtcatcaacgctggttggctcaccgagatggtcgcggtactatcgctgcccgacgtgggcgtcgttggcgcgcacctctactacgccgacggcagtatccagcacgcgggggtgatgactggacaccacagggcgctacatctttacagcgggctgccgggcgcaagctggggatactatgcagacttactactcgcgcgcaacgtgagtgcggtcactggtgcttgtctcctgacctcgcgtcgagtctgggacgaggtcggtgggttggacgagcagcttgcggtcagtttcaacgacgtcgcctactgccgcgcagcgggcgcactgggatatcagatcatcgtcaccccgcatgccaggctcaagcatttcgagtcagtgacccgaggcttcgacgacttgacgttgccccgcaggtcacggctcgcatcagaatttcagcgactcgccacactgttccccgacattgccgcagctgacccgttctacaaccccaacctcgtccccgaagggcaatttcggcttcagtatgaatcgccgataccggtggtctaaactccttcccccgcttgttgtctctgccgactaagcaacgtggcacccaaagacgcaatcaatgtcacaaccatggtacctctaagctggaagcacggctgctttccgagaacaccacgaagcccaatgaagatatcccagccgagaccatccggtcagcgctaacttattgagcccgacattgaatgacacgccctcttgtgaaggataagcacactcttgttcgcttgatagtgtggatacaggccctgagcgtctctgaacagcaatagcatgcgggcttcgccgacattggagatgcgagagcaagcgccacaatcgcgcttcaccctcgccacgaaggctgggcttcgccgatttgcttggcagtcggattgaggccaacaccacctcctgaccggcccaagagagctcgtactcgccggccgttaatatccaagcgtcgagtggaggcggaccgtcttgtagcggtggatccgcgtagcgtgggcttccccccatgtgcttgacagtctgaattgaggccacggccgcctcctcccgggcccaggagagctcgtactcgatcggcggtcggtacccgaggctcgagtgcagccggaccgtgttgtagcgctgaatccagctagcgatggcagagcgggcctcgtcgaggttcgcgaagcggtagcgagccaccagctcccgctcgcaagctcccgaagaaggcctcggccacggcgttgtcgtagcaggttgcgaccccgcccaccgactggcgaagcccgagcgtcgcgcagagctggcaaaccttccgggagaggtactggttggcgcgatcgctgtgaaagatcgccccagcgaggctgccccgggtccgaagagctccgcagatcgcctcgaccaccaggtcatcgggaatgcgacgctggagcgaccagcccacgatccgcctcgagccacgatctgccaccgtggcgaggtagcagaacccttcgtcgtttcggccgtcggtgatgtcgctcgcgtagtgactcctggctcgccaggggcggagtcctggcagacgagatccgggaggggtgcgtcttctccccgcctcgtcgtgactacgaagcgccagcgtgggcagctgccatctcgagctcgcgcattaggcgttccactcgcttgtggttcacgcagtaacccacgtcgtcgcagctcgtgggtaactcaggggctcgacgtaggtgccgtcgttcgcctcccagacggcccggacttcgctgacgagccaggtgtgctggggtcctcggctcggtcccgacggtgtcgccaggcgtagtaggcctggcgggagaccctggctgctcggcatggcaccgctaccgggacgccattggcctcctggttggcaaccggagtggtagcgggtcactggttgccccccgcaggatccgcaaagaccaggcaacgtttcgccaggtctcgttccatagtgagctgcttgacctggcggcgcaggcgggtcatctcctcgcgctccgcgctggtcagcccctctcgcttacctcgatcgatgcgttcctggcgcacccagttgccaagggtctgctcgttgatgccgagctcacgggcgacgtcggcgatggtgcggtgctggtcgaggacgagagcggctgcgtccttgcggaactggctggggtaacggccgcgtcgtcgtcgagcggggccgtcgcccggtggtggtggcggtgtctggtgcatcccttcctcctgtagcaggtgtcaacctggaggggtaaggccaggggtgttgcaagaccgattgaaccgaaccaccaatcgtttggacgtgaccgctcgctggacctgtcgtggcgggtctggccgccccgagggggcactagcgtgtcgacctcggatccaccgtgaagttggtcccggctctgaggtctgctcagaccgaccttggctccccactcaacccgaggtgctcgtgtttcgaccaaatgcatggatgcgccgcagtcacctcatccttgaaacgaccaagacccgctctcgcacgagttggctcccgaccgttcacctcactctcacgctctccgccgccgaggtctcggggccactcgtcctgaagaacccctcccgctccgtgcttgccctccgcgccgttgcgcagagcgctggccagacccttcgcgtgagcgcgacgggccccgagagcgcaagccttccggagcccgatggccgttcgctgctgctcgttggcccaggcaagaccacgctcaccatcgaagacccgctcgacgccccagcgaccctcttgatagcaccatcccgggaactcggcgagtctgcgcgcgatcttctcgacgaccgatgcgccgcagcagagcgagctcgcaccctcgcgcggcgattgctcgccctcaacggtgagagcgagcgactccaggcagcccagcgacacacgaacgacccgtcgtccaccctgccagatccacttcgacccctccgcgaggtacgactcgacggccggcccctcagaccgaccgagctgcacaccttgcttgcacgggcgacagtcgaaccctctcctccgtacacgtcgatcgccgtcgttaccctcggtcaggcgcaaactgcagcagccacggtcgactcgctgcgcgtcaccgaccccggcccatggcgcctgctcgcgtcagaacacgaacccaccctcgtcgcaaccgataccggagtcccctcgcgtatgctcgcggacaccgcagccgacgacgccctctccgacatcgatcacgttctcttcctgcccgctggggcaacactcctgcctggatggcgagaagagctcgccagagcgagcgccgacctcacgcttctgggtgggatcgaggtgcgtcaggacgtgggagacgttgtcctgtacggagagctcgatcccgtcctcctattctcgacgccagcgttcggcctcggcgtcgctgtgagacgcgatgcactgcctgcagaggtaccgctgccacatggcatcgaggggatctgggggcttgttgccgagctcgtccagcagggctgcaccgctgcaggcaccgacgcactcgtgctcgtcacgccgccttggcccaggaatgcggacgaggcgactgcgctgcccgaccgcctcgctggactggtgaacgcagagctcgtcggcacctcgcagactgagcacagccagtggcccccgattgtgctccaccaccgccttcggccgccctcgtgggcgagtgtctccgtgatcatcccgacgcacgacgcgccccagcaccttgaagcggccctgcgatccgtacgcgaggcggactaccctggcccggtcgagctcattctggtcgcccatcgggttcgcaacccagacgtagagcatctcctcgccgacgcgatgacctggggggcgagcgtcgtccgcgacgacggagccttcaatttctcccgcctgatcaacaggggtgctgagcatgcgaccggagaactcctgttgttcatgaacgacgacatcgcgccgacgggcaccgactggctgcgcgagctcgtgagcgcccacgttgcccacggtgcacgcgtcacgggggcacgcctgctcagcgccgacggtacgcgcatccagcacctcggccaggttcgctctgcactgggcacgctccagcacctgcacgtgggtcgacctgcggaggatctcggctactgcggccgcggtgctgcgaccgcctccgtcacctcggtgaccggcgccctgatgctggtggacgcggctcgattccgcgccgtcggtggcttcgacgagcgctacgacgtcgccttcggcgacaccgatctcgtcctccgactgcgtgcaaacgggggcagagcgatcgtctgcaccagcgcgacggctctccatccagagctcacgacgcgcggctcggacgcacggccagcacggcacctcgggttcgcctccgagtcgatggcgtttcgccgcgagcacgggtggcagctcgccaccgatcgatgcctcgccccgcgtctccgagcacgcgacgacacccttgaggtcgtgcccgcaacggggcgccacgagtgcaatctcgtcgccgtgcagctcggcccagaggacgctgggggtggtttcgacgtcgtcctgctcgactccgagaccgcgcagatcaccctcgagatgccgagcgacctaccgaccaccgagatcgtcgggatcgaactgcgcctcacgctcctcgggggtgacccgcaggcactgaccgccacgctcgacgggaccccactctcgtggcacccaagggccggtcatctcgccgacctccggtgcgacgagggcgtaccaacggccggtcgacaggtccaccacctcgacctcgtccccggggcagagctcgcgagcctgcgcgtcgtacccgcgccgacggcccaggtgaccgctccaacgacccgaggactcgagctcgcctgcgccgcgaccgcctgggtacgcctgcctcgccaacaggtcccgatgagccagccgcacgtctgagccactacctgggctcgtcatgcgtggggcgccgaggagtacacagcactcaacggactcctcgcccactgggcggcagcgtcgccgcctcgcgccgcaagtccgacgatcgccgacccgagaacgtcgctcgctccccaggtcggtggagacctcggtcaaccttggcgcactccgatgcgactcgcaccagagcgaccgaacgtctgtgcaccctcgcgaggagccacggccttccggcagcccatagacgctcaacccggacgatgcccccgagtcgctccacgaacgcaacacgatgtctggcgcaagagcgggagggtctgatgcgaacgccgggccctcagggctccccgcagccgcgacaagacgggcatggcacagctcacgaggagccgaccgatgccctggccgccagtcgctcgtaggtcgcaagcagggtactccaccgcgcacgcacggcgtcgtagcgctcgtggacttgggaagcatcactcgccgcatgaggggcgtcgccgacgtcgcggggtgtgcggatggctgcgcacagcgcatcgacgagttcgccaacgagcaggggctgatcgctccggacgacgacacaacgacgatcgaggtctgcgtcgtcaacgaactcgacggtcggcccctcatcgtcgacgaccaccacgcacagcgatcgctgcgcaagctctctgaggacgcgggcatcgggcaggggccgcacccacaccctgcgaccagcgagggtcgtgacagcgcccggtgcccgaccacctcccaccagtcggagaaccccgtcgatgtccgtacacgcctgcgcggcaaggcgcgccacgagcgggccgcggtcagggcgagggttgggctcaacgagcaccacgagccgatcgagacgaggcgccggaccatcatcgaggtagagccacgccggatacggctcgctcaccacctcctgatcgcgaaggacggcccccgatgcagcgacccacctcgcaagagcaccatcgtgcacgagcacgtcgtcactcccagcgacgaccgtgagcagatccgtcgtcaggggcctcaagcgtgtcccgagccggagcacggcatcctggtccactggcccagcaacggcagccgccacctcggcgagtaaccgcgcgacgtcgacgtcctgagcgtggagctcgacgacccgtcggcctgaactcgtgagcaccgccgggacctcaccgtgcaaggcatcgggtgcgagcaccagctcgtggagcgtacagacaggatcggggtgacctgctcccagttcagtccgcagcagcgtcccgacgatgccgtccgactcccagcctggcgcctggagctcgaggtcaaagcgagcatccagcacgcacgcgagctcgccgaggtacgaccgcaacccatgggctcgatcggcaccccagcgtccgtcgggctcgagtcggggcaagcgcagtgccagcgtcggtcgtccggactcggtcacgctcggcgtcccgagcgccgcaccgatcgcgtccgcgctgcgtcgccccacctggtcccacgactgacgctgcacgtgctggcgctggcgctcgaagagctgctcgcgccaccccgacactgcggtcaattgtcgcagcagaccgaccaggtctccgacgtcacctggccgaaagagcgcctcgggagttcccagcgcctccgggagtccaccgacgtcgctcgcgagcaccggcgcaccacacatgacggattcaaccgccgggagcccatacccctcgtcgagcgaggggatgacggtgcaccaggcagacgcataggcgcgcaccagctcctggtcgctcaacccatgctcgacccgcaagcgatccgacgggatccccgccctttcgccataccggcggatgcgcggtgcttcctcctcgttggtcacaaggtgcactcggagccggtcgtcctcgcgcatcgcgatggcggcggcgtccaccaggacctcgggccgcttgcggtagtcctgatggtagacgtagagcagcgtcctcgacgcatcgtcaggggctcggtctccacgcacctcacccgtctcaacgccgccgaacggcgccgagccgacgacgtgcacgcgttcgggctccacaccgaggagggtcgtgacgtcgagcgccacggcgtgggagatgcacagcagggcgtcgctcgcccgcaggacgtcgagctggcgccgataccaggcatagaaagcagggtgcggcgcgagatacagcgccgggtgacgaagcgggatcaggtcgtagacgacgctgaccagcctgcgtgcccagtgaggacgctcgctcggggccatcgtcatcgaggtctggaagccctcgaacggactcgcgaccaccagcacatccacctcgccgggcgaggtacgcgtccacccgctcgcgtcgatcggcatcccctcgtggccacggcgcggctcgtgcgaaatcggcgtccaccgctgacgagctgcgcctgcttcctcgacgcttgcgcgcaacgaaagtggcaccggcacgttggggctcaccagccacacccactcggtgtcggggtcgaacgaacgaacgagcgctcgcgtgaactcacgcacccagcgtccaatccctcgattggcactccccccttgcgcgccctgaaggtcgacggcgacgcgcacgtcagcccctctctcgaagctcgggagccagggtacgacgttctggtgcctcgacggctccgagccgatgcttgacatcggcgacctcacgcacgagctgctcagacagcgcttcgagcgaggccaatgcctcgaggcgcccgtaggtgtcctcaagaagacgtccctgggccttcgtgctctccctcaccgcagactccaggtcgccgaggaggcgctcaagcctgtcgacgcgctgggcgacctcgaacacggctcgccgcgtcgcgggggcccgcacctgcgccgcaacggcccgagcaagggaaccggtgagtccgccccgcacgaggaccctcgcccgtgccacaagctgggtcacgagtgggggtgtgacatggcgagcggggccggggtggccatctgctcccggagcggtccgctcacgccacctcgcgcggatcgccgcgtccatcggcagtgcatcgaggatctccaggagctcacgcgcaccgtcatgccacgtgcgatcgacgatgagcgggtgtgtcggcggattggtgatcccgacctcctggatctctccgaggagcgcagcgagcgcggaggcgtcgcccggcccgacgaatctggcatagccgtcgaagagttcgcgatggaccggaatatcgctcaagatcagcggtacgccattgaccgccgcctccacgctcgggagatcgaaaccttcctcgaccgagagcgagaggagggcgcggcttcccatgatggtacgccacaacttctcgtcagaggcgtctgcaagccaggtcaacggccgcccggcctggacgagctcctcgatgcgagcgccgatatggttcgcacgccatcccaaccgaccgacgatgaccagggggaccgatccacctgcctgccagtgagcctcgaagccgtcgaggacggtcgtgtagttcttccggggctcaagggtcccgaccgcgacgaccggaccgctctgtacgtcgacgatccgctgtgcagagggctgccgagcatgcatgcccgagagccagcagacgcgcacacgctcagcggccagctcacgccacggcaccgtccgcgccagcatcgctctcgtcgcctctgccgtcgatcgcgagaccgcgacgaccccgtctgcgaacgtccctacctcgagcatccacagaccgaactggcgcacgagaccttcgtcggcggtccaggagtgggtgagagggacgacgtcgtgctgcaggaccgcgagtcgcatcccctcgagccaccacggggccaagcgatagctcaggcccaggtgccagctgctgtcggcgacgaagacgaggtcgtcacggctcagctcgagcggccgcctgggcacgccgagcggcttgtcctgcgggcgagggatgcgggcaagctcccagaccgtcgggccaacggcctcgccccccaagctgcccaccaccacgtctcggccacgacgacgaccctcgacgacgagcgcctctccgagttcgcggacgaccctctggatccctgtcgctcgccacggttcgcgatcgatgtaggagcagtcccagatgatccgacctcgagcttgcgcggacccctgcgacgcgttcgaccggcgagaggggctctgcatgctcccgcatgctagcgctcgcccacccgcgcgactagccagcctccgagagacgccgacacctgcggagacgagcagcgcgagggccgaagccagtgcgccagagggcgaggcccgacgacccagcgcgacgaccgacgacgacccaccggccccgggaagccgacaacgggcacggggacggcatctgcgccaccagagacgagcaacggggcgggggcaatccgtgcccccgccccgtcctgatgcctcatcgcatcgtgcgcacatgcaccgacctatgcgctgatcgaacccccggctgtgaacgggcccgtgtcgccaaacgccggacccgatcccatgtactcggcattaccgaaggcgaacacgccgccgtcagccgcgaggagccagtagcccatgccgtcgggggtgggcacgaggccgatcaccggttgggcgagcgggtgagctccgtgcaagccggtgagcccgtccgtgtaggtgttccccatgtagtgcgcatcaccgaaggcgaacacgccgccgtcagcgcccaccagccagtagcccatgccgtcgggggtggaggcgatgccgacgatgggggcggcgagcgggtgagctccaccgagccccgtcaggccgtccgtgtaggtgttccccatgtactcggcatcaccgaaggcgaacacgccgccgtcagcgcccaccagccagtagcccatgccgtcgggggtggaggcgatgccgacgatgggggcggcgagcgggtgagctccaccgagccccgtcaggccgtccgtgtaggtgttccccatgtagtgcgcatcaccgaaggcgaacacgccgccgtcagcgcccaccagccagtagcccatgccgtcgggggtggaggcgatgccgacgatgggggcggcgagatgcgtcacgccagccgtttgcaccgatccgtagctgggcgcgccacccaccgacatcaccatgccgctcgccgtaacctcccagcccgcaccggccatggcggggtcaggcgcatagcccacgacaccgctcgcgggtgccgccggctggccagtacccagcggaccgaagctcgacacgtgcccattgccccgcacgaacgcgtacgaaccgtacgcggtgttcggcgccatcagggcgttcagcgtcgaggagttcgagtcgtcgtagtagacctgcagctgacccatcgcgttcgtcgcggtggcgaggccgaagaggccgccggcagcgccggtgtcgagcactcgggtcgcgacgaccatcccgttcatcgggttgatctcgagcaggtcgttgttcgtcgcaccgttcacgacgagaagatcgccgttctgcggattgatcgcgatgttctgcggcgactgcaggagtgggctctgcgacacgaccatgggggtctgcggcgtcgtcgcggtcagcgcgttcggaatcgcatagatggtgttgttcacgtcgtcggcgacgtagagcatcccgttcgccgggtcatacaccatgccctgaggcccaccggcattggacgcggtttcaccaccggagacgttggagttggtcgggagccctgtcgcgagcgccgtgtaggtggcgttcagcggctggccgttggacgtgccggtcgggttggggttgagccgccacacctgtccgtcagcgccggtgttcgacacggcgacgttcgaccagaagaaggcacccggtgcgaccgcggccccccaaacgcccgcgaaggtcgagtttgtgctcgtgtagttcgcaatcagcgtgcccgaggagttgatcaccgcatacccagaacctgaaccgttcgctgtgctcccccagtagccgacccagacgatgtcgttcgaggggttgatggcgatccccaccggtccggtgatgtcggcgttctggtagaaggtggtcgattgaccggtcgtggggttgacctcgacgatgctcgtcccagcaccgaacgtgccggccgacgagttgaaatctgccacgagcacgtcgcctgcgacgagattgcccatcgtcttcggtacgacggcgacgccgtagggattcgtatcgttgttcgacgctgtcgcggacccgaccttcacgttggcgagctgggggaacagattgcccatcggactcgtctgcgcaacgagcgctgaactcgagacgcccgcgagggcgagcagcgcagaagcggcgaccacgccgccactcgcaacgccccagcggcgcttccacggactccttggcatgagggacctccttggcaccactcgtcagcggccgccagcagcacacgccccatggggtgtgtggtctgcggccacggcacgcttctacgtgccgagaggaggtacgtacgaggaccccagaacgttcacggatccacgccgacgggcctcatcaacccttcagcattggccttcagcattggaacgtgccggggcctcgtcgcgccggagtggctcacgccgccttgacggccgcgacgagggcggcgagcgacgccttcgcgtcgccgaagagcatcaccgtcttcgggttgtagaacaagggattgtcgaccccagcgaagccaggccgcatggagcgcttcaagaacaccaccgtcttcgcctcgtcgacgttgaggatcggcataccgtagatcggactcgacgactgcgtcctcgcggcagggttgacgacgtcgttcgcgcccacgacgaggaccacgtcggtggtccggaactcgtcgttcgcctgctcgagatcgtggagctgctcataggggatgtccgcctccgcgagcagcacgttcatgtgacctggcatgcggcccgccacgggatggatcccgaagctcacctcgaccccgcgcccctcgagagcgcgcacgagatctcgcaccgtgtgctgcgcctgggccaccgcgagaccgtagcccggaacgatgacgaccttcgacgcataggccagcatggttccgatgtcgtcggcggtccccgatcgaacggtcgcaccctcggggatgccctcggcgccgcccgcgcccttaggcgccgagcccaccgccgcgaagaggacgttggcgagggagcgacccatcgcgtccgacatgagcttcgtgagcagtgtcccggacgcaccgacgagggtgccgccgatgatcacgacggtcgagtggacgacgaaaccggtcgcggcgacggcgagaccggtgaaggcgttcaggagcgagatcacgaccggcatgtccgcgccaccgatcggcagcacgaacgccacgccgaggacgacggctgcggcgaccagcacaccaagggccacccgatcggtgggccccaccgcgaccgcgaccatccctccgatcaccgcgagcagcaagagcgcgttcacgacctgctgggcggtgtaggtgatggggcgcccggtcatgagttcttggagcttggcgaaggcgatcgccgaccccgcgaacgagatcgcgccgatcgcgaccgagagcaccgaggccaccgacgcgagcgtcgcacccccacctcgcgtggcgagcacgctcacgatcgcgacggtggaggccgcgccgccacccacgccgttgaacgccgccaccatctggggcatcgccgtcatgcgcacgcgacgcgccgagaccgcgccgatcaccgcacccacgacgacggccgcgaccgcgagctcgacgaccccggccgagggatgctcaccgacgaggctcgcggcgatggcgatcaccatgccgaccgcggccgtgaggttgccgcgtcgagcggagcggggtgaggcgaggccccgcagaccgaggatgaagagcgacgctgcgacgaggtaggcgatgtcgacggcgacctggcgagcggcgagggccgcgaggatcactgctggctccttcgccccttgaacatctcgagcatgcggtcggtgacgacgaagcccccgaccacgttgatggtggcgagcaccaccgcgaggacaccgagtgtgacctcgagcgccccgtgcgcaccgaagagaatgccgagcgctccggccaggatgatgccgtggatcgcgttcgatcccgacatcagcggggtgtgcaggatcgtcggcacgcgcgagatgacctcgaacccgatgaaggcaccgagcacgagcaccgtcaggtcgttcagctcaccagcggtcatcaaccccccgatcgtcgatcccactcagcctaggcggggcgcgaccagcggatctcgccgccgtcgacgaccagcgtcgcgcgaaccagctcgtcgtcgaggtggagctcgccgtccgtcaccatgagctcgacgaggttcgcgaggttgcgggcaaaggtctggctcgcgtgcgtcgggagctcggcggcgaggttcgacgcgccgacgatgcgtaccccgttcgtctcgacgatctcgccgggacgcgacccctcgacgttgccaccggtgtcggcggcgagatccacgacgaccgcgccgggccgcatcgcctcgaccatcgcgccgctcacgagcctcggcgcctggcggaacgggatctgggcggtcgtcacgacgaggtcggcctcggcgacgcgctcggcgagcagcgcccgctgtcgctcgaggtactcctcgctctgggcggctgcgtacccgccttcgccctcggccgcatcgagcggcacctcgaggaagcgagcgccgaggctctccacctcctctctcgccgcccgacggacgtcgaaggcctcgacgcgcgcaccgagccgccgcgccgtggcgatggcctgcagaccggccaccccggcgccgagcacgagcacctgcgcgggcgtgagcgtgcctgcggcggtcatctggagcggcatgatgcgcccgaggaggttcgcacccaccagcaccgccttgtaacccgcgagcgaggcctgcgaggagagcacgtccatcgactgcgcgcgactcgtgcgtgggaggagctcgagcgcgatggcgccgagtccgcgcttggcgacggcctcgaggatcgcatcgtctgtcgcgagcccgagcagtccgacgacgagacccccggggcgtacggtgtcgagcacctcgccgggcggcggcccgatggcgagcagcaggtcgggtgcgagcgccgcaaggtcggtgagcgtggccccctgttcggcataggccgcatcggaaaagcctgccgcagcgccggcaccgtgctcgagcactacctcgacaccgagccggctgaggcgtcccaccgtgtccggcacgatcgccaccctgcgctcgtcgtgcttgcgctctctcgccgctgcgatgcgcatcgccagccccctgcctccacccgtcccacgaccaaccccagtcccaccaggctaggggccacccgagccaaccgcgccgcgccccttggtgaagtactcgaggctgcgcgcgatcagaccgagttccatcgcgcgcagcaccgcagacgtgcgattggtcgcaccgaccttgtcgaagacgtgggcaaggtgcgtcttgaccgtcgcttccgagatggcgagcgcctctgcgatctcgacgttcgtgcggcctcgtgccacgagctcgagcacttgacgttcgcgatcggagagcacgacgtccgaaccgaggacgcccgccacatccccgacgccgacgaaggcgatgcctcctcgcgccacccggcgcaccgcgtcgtgcaggacggcctcggtggcgtccttgagcacgtagccacgcgctcccgcctcgaccgccgatcgcacgaggtacggatcctcgtaggcggtcacgaccagcggcgcgcccgtcccccgcaccgagagccacgcgatgagccgcaccccgtcaccgtcggcgagacgcaggtcgcacagcaccacgtcgggtgcgacccgatcgatgacggcgcgtgcctcgctcacgctcgctgcctccccgacgaccgcaacgtcaccggcacgctcgagggatgcggtgaggccacggcgcacgatcgggtggtcgtcgaccagcacgacccggatcacgcggtccacgcaggctcctcgatggctcgggccatccgatacggcagacgggcggcgagctcgaaaccaccgtgctctctcgggtgggcctcgaacagacccccgagacgctcgacacgttcggcgagcagcgcgaggccgaggtgcccctcgagctggcgcgggtcggccggagctgcgccgtcgtcgaccaccccgagcacgagctgcgctccctcgagtcgggcctcgaggcggacgcgggtcgcaccgatcgcgtggcgaaggacgttggtcgagccctccgcgagcaaccgtgcggcgaggtccagtaccatcggcggcaactcgagcccctcgaggtcccccaccacctcgacctcgagacccgccgcgcgaaggcgcgccgcctccaccaagaccacgtcggcaagcgcttcgggcgactcctcgcgccgtcgcagctcgcggatcaacgatcgagtcgcctcgagacccgcgagcgaggcctcctcgatgagccgtgccccttcggtgggcgcctcaccacgcaccaagaggaggatgcccacgaggtgttgggccacggtctcgtggatgcgcgcggcgagtcgctcgcgttcgtgcagctctcccatgcgataggcgagctcgcgcatggtggtctgggcagcgcgcagctcgtcgatggtgtggcgcaggagttcctcgtggcgcctcgtgcgctcgaggaacaccgcgagcatggtgcccgcggcgatgtcggggacgtaccaggacacgatggtggcccagggaacaggggggcgagggagcaggtgcgtctcgaggccgacgagagcggcgacccccatgacgaccgggaccgacaccgaggccgccagcagcacgtaggcgaggaagctccaagcgagcaagaggtaggccgcgttcgcatcgagggccaccgccaccagcagcaaggtgccctcgagtcccacgagcagccagcgggcgagcccaggccgctcgaagccgaccctgccgagcgcgagccacaccgccaccatgagtgcgaggacgaagccgaccgacacggcacgcacggccgagccgatcggatcgagcacgatcacgaagagcgttcccgccatcgtgacggtgccgagcgcctcccacccgagtcgcaccctgcgtccggtgcctccggcacggccgcccagctcgctggccatggacgcatcgtagcatccgacggcgaccccgatcgggatgcgatcggccgtggtatcgaccctcgacgacgatttgcgtcgcatccttgtcaacaggcgatgtaatccttagactcagagccagaacacacacgaatccgatccaacggaaggatcccctatgacactcgtcgaccgtgatcgtctcggcgcgctcctcgccgacgaggccgagcgcttccgtgccagtcaccccgtgagcgcccagctcgccagccgacggggcgagcatctcgtcggcggtgtgcccatgacctggatgcgccggtgggctacgccgttcgcgatcaccgtcgagcgcgccaagggctcagaactcgtcgacgtcgacggccaccgctacctcgacgtgtgcctcggcgacaccggtgccatggcgggccacagccctgagccaaccgcgcgagccatccgtgctcgcctggagtcgggtggtctcaccacgatgctcccgaccgacgacgccgaggtggtcgcggacgaactcacgcgacgcttcggagtcgagcgctggcagttcaccctctcggcgaccgacgccaaccgcttcatgctccgcacggcgcgccagctcaccaagcggccgctggttgtcgtcatggactggtgctaccacggcacggtggatgagtccttcgtcgtgctcgacggtgcgctgacccgctcgcgcccggggaacgtcggccccgccgtcgatccagcgacgacgacccgtgccgtgcccttcaacgacctcggggccctcgaggccgcgctcgccgaccgccaagtcgccgccgtcctcaccgaacccgcgctcaccaacatcgggatcgtcctccccgatgagggctacctcgaaggcctcgtcgagctcgcgcaccactacggctcgctcgtcgtgctcgacgagacccacacgatctcggctggcccgggaggcctcaccggcaagctcgggctccgtccggacggcgtcaccatcggcaaggcgatcggtggcggcgtcccgatcggtgcctggggacttcgtgccgaactcgccgacgccatcgtcgccgaccgagacgccgacctcgaggacaccggcggcatcggcggcacgctcgcgggcaacgcgctctccctcgcggccgcgcgcgcgaccctcaccgaggtgctcaccgaacgcgccttcgacgagatgggtgcggtctcccacgaactcgtgcgacgcgagcgagcgctgctggccgaccatgggttcgactggagcgtcgtcgagctcggtgcccggagcgaggtgcgcttcgtgtccccgcctccacgcaccggggccgactcggctcgcgcggccgacgtcgacctcgaccgctacctccatctcgcgctcgccaatcgcgaggtgctgctcacgcccttccacgcgatgacgctcgtggcgccgacgacgacgctcgcccacgtcgagacctacctcgacgcgctcgccgatgcgctcgcgccgctggcgcgctgacctactggccctggcccatcgagaagccgggtacgccgtcgaaggtgaagagcccttcgaccttgacgaacgcgaggccggcttcggcgagcgcgccgaggagcgcgacgccctcggcgggcgccatcgcaccggcgtcggtcacgaaccggcaccgccaatggtcgacgcagaaggtctccggcaacccgtcgggccagaccttctggccgcggttcgtgatcatgtcgaggcgaatcccgaccggcgcggccgccgacaaccgctcggcgagctcgtcgacggtgccggtccactccacgaagacatcgagaccgacctgcaccttcaccgacgcatgccgtgggctgggttcgacgcggatggcctcggcgctcgcggggtagtgcaccacgggcagcgtcgcaggcgaggccccgagccgctcgatgaccgccgccgcgaacccctccgtcgagaccttggcccgagagcgctcggggtggtagacgtcggcggtgtggatgccgtcctcgatggtggcgagccatgcgttgtggacgcgctcggcgacgtccccctgaccgacgtgcacgagcatgagcaccgcagccaacaggagtcccgaggggttggcgatcccccggccggcgatctcgggcgccgagccgtggatggcttcgaacatggcgacctcggcaccgacgttggcgctcgcaccgagccccacggagcccgcgacctcggcgacgacgtcggagacgatgtcgccgtagaggttcggcgtgacgacgacgtcgaagtcctcggggcgtgccgcgaggcgggcggtgccgatgtcgacgatcaaggtctccgtctcgaggttcggatactccctcgccacctcctcgaacacctgacggaacaggccgtcggtgagcttcatgatgttgtccttgacgaggcaggtcaccttgtgacgaccgtggcgctcggcataggcgaaggcgtagcgcacgagtcgctcggtacccggtcggctgatgagcttcaggcactgcaccacgtcctcggtctggcgatgctcgatgccgccgtagagatcttcctcgttctcgcggatgacgaccacatccatgcccgggtgcgcagtctggatgaacggggcgtacgtcgggcaggggcggacgttggcgaacaggccgagtgccttgcgaatcgtgacgttcaggctcttcatgccgccgccgcgcggggtggtgatcggggccttcaggaacaccttggtacgccgcagcgactcccaggccgacggctcgatccccgacgtgatcccccgacgccagagcgcctcgccgacctcgatggtctcgatcgcgagccgggcgccggccttctcgagcacctccagcaccgcgctcatgatctcaggtccgataccgtcgccgtaggcgacggtgatgggggtcggctggtcgcttcctcgtgccatcggcgacggcctccttcgcggttcgcacgcgctggccgaccacggccccccacgccgatgaccggccaggcgttctcatcgtgagggcgctcccccagcgcgcctcggccctcacgctagcggcacatcctcgccggctccaatcgacactcacgccgatcacgcccgcgttcccccgaccggtggcgagcacccgcgcacgagctcacctgactaggatcgccgccgtggtcgccgaggatgccgagcacgccgctctcgacacgggcatcgagtcgcgcacgtcccggcagccctccgcacccacctggaccttcctgacgaaccacggtcatgtgctcgtgtgcatcgcgcgcgatcccggcatcagaatccgcgacatcgccgagcgggtcggcatcaccgaacgagcagcccagggcatcgtcgcggacctcattcgagcgggctacgtcgttcgcacccgcatcggccgtcgcaaccactacgagatcgaccccacgcgcccggtgaggcacccggtcgagcagccgcacctggtcggtgacctcctcggcgccctcgctgcgctcagcgaccacgacaccctgggcagccgccccggcaccgagaccctcacggggtcgtcgacgtctggacgctgaaggtggtcccgcccgacgacgaaccgagcgggctcgtgatgtcgccctgggtagcgatcgagctcgccgtggggaactgacagaccgggttgatcgacgacgccgtcgagtcgctgaaggcgagtggcgcgagcgtgaaggtggtcccgggggttgcgaccgcgagcggatcgaggaacgacgtcaccgacggctccgccggcaactcacacgtccccgtcgacgtggcgaccgtcggggcctcggcgatccactccgccgagttcgcgggccccccgtagctgatcggcgtcgcggcaccgatcgtgacctgctgcgccgtcgtgagatcggcgatcgtgatcgtccactgatcggccccgacctcggtgatcgtcacctccatggtgtcgccgggactcaccgacagggccgagggcgagatgggcacggccggttgttcgttcgacggcgtgatctcctcccaccacgcacactccgccgcggccccagagccacagaatccctcgcccgcgaacgcctggttcccgacggcgacgcccgcttggagcaggtacgaattcgtcgcaccgtccaccccgatccacacactggtatcacagggcacgctgctctcgcaggtcgtcgacgttgtctgcggcgtcggcacgacgaagcgcgtcgacacgctcgtcaccgaaccccgggccgcgccctcgagcgcataccccgaccaattctgcgagacctgctgcgacgtctgcgagccgatcgccacggtccaggcctgactgagggtcgcggtctcgcccgccgagtccgtgacgctgaaggtggccgtcccggaccctgcagcgaggggcacaccgacaagctcgccagcgctcgtcagcgagagcccagctggcaaaccgctcgccgaccaccggtagccgggcacaccaccggtcggactgagggtcgccgagacggcgctcgcgacggcgagctgcgagagtgcctggctcgcactctgggcatcgatcgcgagcggtggcggtggcgcgagatcggggacgatcccgaccacgggggcggcgagggggcgggagccggacaggcccgtcagtcccagggtgtaggtgttgccgtagaagccggcgtcaccgaaactgaacaccccaccgtcggctgccaccagccagtagcccttgccgtcgggggtcggggccatggcgacgatcggggcggcgagggggcgcgatcctccaaggcctgtgagtcccagggtgtaggtgttgccgtagaagccggcgtcaccgaagctgaacaccccaccatcggccgccaccagccagtagccgttgccgtcgggggtcggggccatggcgacgatcggggcggcgagggggcgggagccggacaggcccgtgagtcccagggtgtaggtgttgccgtagaagccggcgtcaccgaaactgaacaccccaccgtcggctgccaccagccagtagcccttgccgtcgggggtcggggccatggcgacgatcggggcggcgagggggcgcgatcctccaaggcctgtgagtcccagggtgtaggtgttgccgtagaagccggcgtcaccgaaactgaacaccccaccatcggccgccaccaagtcatacccggggctgatcgtcgccgaggcgagcgcgctccggcccggggccaacgcgtcggaggacgacgagcccgggcgaagggtaatgaaggcgcttgcgaaggcggcagcgagcacgacgaggagcagcgtccgcagcagcggacgagccccccatgccagcgtgcgaccgcccacaccgcctcccgtcatcagggtatcgactcgatctcggaccggctcaagccagaaccgaccataccgaggcaggaaggctcagctcactgtcaacttagacggcgagcgcgcgcgtcgagggctcgatcggccgtggcaagtcgcttgcgcccatcagccacgcatcgacgtcgtgcgcgaccgaacgtccctcggcgatggcccacaccacgagcgactgcccgcgcctcgcatcgccagctgcgaacacccccggaatcgaggtcgcgaagcggtcgtcggtcgcgatggtcccctgaggcgtccgagcgagcgcgcgctcggggtcgatgcggtcgagttccggaccgacgaagcccatggcgagcagcacgaggtcggcctcgatgagctcgtcggtcccggggaccgccaccaggttgccgtcgacgagctggacggcttcggtcgtgagcccgaggactcgtccgtcctcgccgcgctcgatgcgcaccgtgcgacgcgcccagcggcgatcgccgccctcctcgtgcgcgctcgaggtccgcagcagcaccgggtacgtcggccaggggtgtcgagacgaacgctctcgcggcggcgctggcaggatctcgagctgcaggacgtgcgctgccccttggcggtgcgccgtgcccaaacaatccgccccggtatcgccgccgccgacgatcaccacacgcgcgtcacgcgcgctcggtgcgccgacgatcggggtcccgagcgcctcgaggttggccgcgcgcaggtagtccatcgcgaagtgcaccccggctcccgcgcgtccctcgaccacgagatcgcgaggacgggtggagccgagcgcgagcacgacagcgtcggcctcggcgacgagctcgctcaaggtgacgtcggtaccgacgcccacgccggtgcgtaccgtgacgccttcggtgacgagctgctcgagacgccgatcgacgaggtgcttctcgagcttgaactctgggatgccatagcgcagcagaccgcctgcacgatcgtggcgctcgagcagctcgacctcgtgcccggcgcgcgcgagctgctgcgcggctgcgagaccagcagggcccgaacccaccacgaccacccgacgaccgctgcgacgctgggccacgatcggtcgatcgacgccgcgctctgcggcctcgtcggccagggttcgctcgatggcctcgatcgagaccggatcccgattgatcccgagcacacacgccgcctcgcacggcgccgggcagagccgaccagtgaactcggggaagttgttcgtcgcgagcagtcgctctgccgcgcgctcgagctgcccgcggccggcgagctcgttgaactcggggatcacgttcccgagtgggcacccatggtgacagaacgggatgccacagtccatgcatcggcgcgcctggcgctcgagggttgcggggtcgaaccggtcggtcacctcgtgccagtcgcggatccgaagcgctacgggtcgcttgggcggaccctctcgctcgaaggtgagaaatccctgcggatcagcggccatggcgtcgcctccttggctggctcgcgcctcgtcgggtcgtggtgcgcctcgtcatgcgggcatcctcatgacgcggtcggggtgcgctgacgcagggcggcgcgtcccatctcgctccgaacgcgcttgaagtcgcgcgggtagacgcagaggaagcgatcgagagcacccggaccctcggccacgatctggcgcgctcggtgcgatccggtcagctctgcgtgccgagcgacgaggttccagagtcgatcacgctcctcatcgggaacgggatcgaggtcgacgagactctggttcacgcgcgccagcaaccgctcgtcgggatcccacaagaacgcgagcccgcccgacatgcccgccgcaaagttgcgtccgaaccgccccagcaccaccacgagaccaccggtcatgtactcgcacccgtgatcaccgacgccctcgaccaccgcgacggcgcccgagttgcgaacggcaaagcgctccccagccacaccgcgaacgaagcactccccgctcgtcgcgccgaagagggcgacgttgccgacgatgatggtgtcgtccgtcgaccaggcggcctgggccggaggacgaacgatgagccgcccaccggagagccccttgccgacgtagtcgttggcctcgccgacgagctccaccgtgaccccgcgcggcacgaacgccccgagcgattggccggcggctccgctgaggcgcagcacgatggtgtcgtcggcgagccccgcctccccccaccgtcgggtgagttcgtagccgagggtggtcccgaccgcccgatcggtgttggtgacctcggcggcgatggtcaccccctcgccgcgctcgagcgccgcctcggcttgggcgatgatgtcctcgtcgagccgcccggccagcacgtcgggttgggagcgaacccgccggcgcgcctgccccggccacggctccggcgcccacgtcagccgttcgagtccgagctggcgtgcctccggtgcatccacgacctcgagcaggtccgcacgaccgatgatctcgtccaacgaccgggcgccgagcttggccagccacgcgcgcacctcgtcggcgaggaaccagaagaactgctcgacgaactccggccgaccgctgtagcgctcgcgaaggaccggattctgcgtggcgatcccgaccgggcaggtgtcctggtggcacacccgcatcatgatgcaccccgacaccacgagcgcggtggtcgcaaaaccgaactcctcggcaccgaggagcgcggcgacgatcacgtcgcgtgcggtcttgagctggccgtccacctggagggtcacccgatcgcgcagcccgttggcgagcagagtctggtgcgcctcggcgaggccgagctcccagggactccctgcgtgggcgagcgacgtgagtggagccgctcccgtcccgccgtcgccaccggagatcaagatcacatcggcgtgcgccttggcgaccccagcggccaccgtgccgacgccggcctcggcgaccagcttgacgtgcacccgtgcccgcggattggccgccttgaggtcgtagatcagctgggcgaggtcttcgatggagtagatgtcatggtgggggggcggggagatgagccccacaccgggggtcgccatgcgcgtcttcgcgatccaggggtagaccttctggcccgggagctggccaccctcgcctggcttggcgccttgggcgatcttgatctggagatcgtccgccgatgcgaggtagaaactcgtcacgccgaagcggccggaggcgacctgcttgatccgcgatcgacgatcgagaccatccgcgtcagggaacgcacgttcggcgtcctcgccaccctcgcccgagttcgagcgcgctccgatccggttcatcgcgatcgcgagggtctcgtgcgcctccttcgagatcgagccatacgacatcgcaccggtagcaaagcgcgtgacgatggcctcggcgggctcgacctcctcgatcgggaggggatcggccgcctcgcggatcgcgagcaggccccgcagcgtcgcgaaccgccgagcaccctcgtcgacgagctgctcgtagcgacggaacacctcgatgcgcccctcacgcgtggcgtgctgcagcaagaacaccgtctcggggttgaacaggtggtattccccctcacgacgccactggtagaggccgccgacctcgagctcgcgatgggcctctgcctcgggtcgcacctcgaaggcacgccgatggtggtaggcgaccgtctcgtggatctctcggaggccgatgccctcgatcggcgccggtgtcccggggaagtactcgtcgacgaggtctcgcgccagtccgatcgcctcgaagacctgtgcgccggtgtaggaggcgatggtggagatgcccatcttcgacatcaccttcacgacgcccttcgtcgcggccttgacgtagttgcgcatcgcctggcggggcgtcggtccgacgatgagaccggcccgcatgcggtcgacgatggtgtcgaacacgaggtagggattgaccgccgccgcgccgaaaccgatgagggcggcgaagtggtgcacctcgcgcgcgtcaccgcactcgacgacgagccccgcacgggtccgcaagcggtgccgcacgaggtggtggtggaccgccgaggtcgcgagcagggacgggatcggcgcgagctccgcactcgcgtgccgatcggagagcacgatgaccgcggctccgcgctcgatggcctgcaccgcttcgtcccggatccggccgatcgccgcctcgagcccactcggcccctccgccaccgggtagagcatgtcgatggcgtgcgcccgaaggtcggcgtgctcaccgtcctcgtcgatgtagagcagcttggcgagttcgtcgttgtcgaggaccgggtgcgggagaaagatctgtcgcgccgccgtcggctcgggcacgagcaggttctgctcggggccgatggtgcctgcggcgctcgtgacgagctcctcacggatcgcgtcgaggggagggttcgtcacctgtgcgaactgctcgacgaagaagtcccacagtggccgatgggcctccgagcgcaccgccggcgggatgtcggcccccatggatccgatgggctcctccccgcgctcagccatgggggtgacgatgcgacgcacctcttcctcggtgtagccgaagagctgctggcgcgtcacgatcgatccgtgctgtgggatgagcatggtacgtggcgcgaggtcgtccaacgtgacgaggttcgcggcgagccaggctccccacggggccgcgccggccagttcgcgcttcacggcaaggtcgtcgagcacctcgccgcgctcggtgtcgacgaggaacacgcgaccgggctcgagtcgacccttcgcgacgatatggtcgggcgccacgtcgacgatccccgcctcggagccgagcaccaccaggccgtcgtcggtgcgccaccacctggccgggcgcaaaccgttgcggtcgagcaccgcgccgacctcacgaccgttcgtgaaaaccacggcagcagggccgtcccacggctccatgagcgaggaatggaagcggtagaagtcgcgcacgcgcggctccatctcctcgttgtgctcccacgcctcggggatcatcatcaagatggcgtgcgcgaggctcctcccgccccgcacgaggagttcgaagaccgcgtcgaaggaggccgaatcactctcgtccgtgcgcgtgatcggcagcgcctcggcgagccgaggaccgagttccgggtgagcgagcagcgactcgcgagctcgcatccaggcgcggttgccacggatcgtattgatctcaccgttgtgggccaccatccggaagggatgcgcgagacgccacgacggcatggtgttcgtcgagaatcgcgagtgcacgagcgcgagcgcgctggtgagctcctcggcctcgaggtcgcggtagtaggcggccacctgcggcgccgagagcatccccttccagaccatggtccggcccgacagcgatgggaagtacagccacggatgggcatgctcgagccgtcggcgagccaaccacgcatcgatctcgagcgcctcgtcgcgccgtccctgcgtcgacgcgaggaacacctggaccatggtgggctcgctgcgccgcgcggtcgctcccagcacgctcgagtcacgcggcaccgcacgctcggcgatgaggcggagctccggaccgagcccgctcgcgagcgcgtcacgcagctcctcgacgctgcgctcggcgaacgcgatgcccgtcacgtaggcaccctcgtcgggtaggtcgatcccgagggatcgccagtaggcatccgggttctgggtcaagatgccggcgccgtcgccggtgtcgggctcggcgcccttcgccccgcggtgctcgaggttgacgagcgcgccgagggcttgctcgacgagcgcatgcgatcggacgccgtcgagccgagcgagggctgcgataccgcaggcgtcgtgctcggcatcgggtcgatacagcggcggtagcgagcggcctagccggtcgtccatggcgtgggctcctcgtacgtaacgagtcgatgacgatgggacgacgttggcccgtgggcccacgatgctagtggctagccggcgagccacacccccatcacgagagccgcaattgccgagagcgaactcagcgcaccccagagcgcgaggccagctcgcgagctggctcgctggtggagccaggccgcgatgcccgagaacaccgcgacggcgatcttggccaccagcacggcggcgtacgcgccccttggtgcacccaccgcgacgacgttccagaccccggtcgcgagcaacaccacatacgctggccaggcaaggcgaccgaatgccctcgccaccgcgggaatcgcgcccggcgactccttgcgcacggtcgggacgagaccccccagcacgagctgtccaccgacccagatgctcgccgagaggacgtgcagcgagagccgaaccacggtcgaagcactcgcaagcgtgggcgtggcgtgcatacagtctccttcgggcacgtgctgacccaacgttaaccgaggcgccgaggctgcggcatcgtcccctggctgagtccgcgctgtggcactctgccgaggtgacgatcccactcctacactgaactcgtgccccctggtcgcaccaggccacgactggctcaggttcgagcggtggccatccgatgatcgcgagcgtgctcgggttcaacctcgtcgacctcgtgatcttggtcgtggtggggttctcggccgtgcgtgggctccgggtgggtgcaaccatccagctctcctcgtacatcggtttctggctcgggctgctcgcaggcgctgcgatcgcaccgtacctggccgatctcgccccacagggagtcctgcggacgttcatcgccctcgtggcgctcttcggcgtcgcatccatcacctcggcggccgctcgcgccctcggaacgcgcatcgtcggacacgtgcgtcgagcccatctcgccagggtggacgctggagccggatcgatcgtctcggtgatcgcgaccttgctcatcatctgggtcgtggccgcactcgccttgaacgcgccgatcccggcgctcgcctccgaagtctcgagctccgagatcgtgcgcgccctcgacgccacgctccctcctgcgcccagcgtcttcgctcgggtggacgccctcttctccaccgagggcttcccgaccgtcttcgcgtcgatcccgccagcgctcgcgggcccggtcagcctcccgagccaggccgaggtcaaccacgtcgaagcagaggtcgctccgtcgatggtcaaggtggagggactcgcctgcggtgagatccaagagggcagcgccttctcggtgggtccgggctacttcgtcaccaacgcccacgtcgtcgccggcgagcagagcacgttcctcgtgctgccctctggatcacagatcgcggccaccgtcatcctctacgatcctcacctcgacatcgccgtcttgaagacgaccggctacgacgtgcccgccctccacttcgacacgcaggtccaagcgcgcggtacccagggcgtcgtgctcggctaccccgagggcggaccgctgacctacggatccgccggggtgatggcgagcttcaacgcagtcgggcgggacatctacaaccagggactcacgagccgcctcgtgtacgaactcgatgcgatcgtacggccaggcaactccggaggaccactggtgggcctgaacggacaggtcctcggcgtggtcttctcccgatcgaccacgaacccctacgtcggcttcgcactggctgctccggccgtcgcggcagaggtgcacagcgccctctcgggcccgcagaacccggtgtccaccgagggctgcgtcccctagcgcagacggagcccacgacgggggatgtccagcgccgtggtgagcgacgacgaagcccgcgccatcgtcgagccgcggggctcgatacactcgggctatggcaaccccacttgcgccaggcctgctcgagatcgatacccgcctcgggggctggacgcacatcaccgctgggttcgtcgtcgaaggcgcgagccccgtcctcatcgagaccggttcgcagtcgagcgcgcccacgctcatcgccgagctcgccgaactcggcatcagtccaagcgagctcgccgcgatcgtcgtgacccacatccacctcgaccacgccggcggtgtcggcgatctcgcacgagccttcccgaacgccacggtctacgtccatcctgcgggcgcacggcacctcgccgacccgactcggctcgtcgcctcggcccagcaggtctacgggccgctcctcgacgagctctacggccgactggatccgaccccggccgagcggatcgtggcgctcgacgacggccagcgcatcacggtcacggagggactcgagctcgaggtcctccagacgccgggccacgccaagcaccacgtctcgatcttccacgaacccagcggcaccatgttctgcggggacgccgtcggcgtacgcctcccggaggtcggggtgctctggccagccacgcctccgcccgacttcgacctcgacaaggcgctcgcgagcctggaggccatgcgctcgcgacgaccgtcgcacctcgcctttgcgcactatggccgcttcgagcacgctgacgacctgctcaccgaggcggccgaccagctccgagcctggtgcgacgtgggcgagcgcgcacttcgagaggggcgcgacctcgagcaggccctcgccgacgctttcctgccctcgctcgaggtcgtggcacccgaggctcgcgaccgactcctcaccctgagcggtatccacgccaacgcgacggggatcgagcgctggctccgactccgcgacgagggccgcgccggcgacgaggtgcgtcgatgagcgtgcccgagggcctcgtcgaggaggctcgccagctcgcaccggaggtcatcgccctccgacgcgagctccacgccgagcccgaggtcgggctcgccctccccgacacccaggcacgcctcgtcacacggctgcgcgcgctcgggctcgagccggagctcggggcgagcctcggatcgatcgtggcgcgcatcgacggcgcgcggccggggccggtgcggctgctgcgcgccgacatggacgcgctcccgatgacggaggagaccgacctgcccttcgcttcgcgtcggcccggcgcgatgcacgcctgcggccacgatgcgcacatggcgatggcgctcggtgctgccgagctcatcgtgcgccaccgcgacgatctcgccggcgccgtggtgctcatgttccagcccggcgaggagggccacgacggcgcgcgtcggatgctcgccgaggggttcctcgagcgccacggcgtcgacgctgccttcgccatccatatcttctcgaacctcccctcaggcgtgatcgcgacgcgcgggggcgccctgatggcgagcgccgacgagttcgagatccgtctcgtcggcaagggcggtcacgcctccgcgccacaccaggcacgcgacccgatcccagcggccgcagagctcgtgctcgcgctccagagcgcgctcggccgccggatcgatccggtcgagccggcggtgctcacggtcggtcacctggcggctgggaccaccttcaacgtcatcccggaacacgccctcgtgcgcgggacctggcgtgcggtcaccgacgagacgcgcagcgcgatccgatcgctcatcgagcgcgtcgccagcggtgtcgccacggcccacggcctcgaggtcgagctcagctggcccatgaacggctacccggtgacgcgcaacgacccgcgcgaagcagcgcacgtcctcgagctcacccgctcggtcctcggcgccgatcacgcgctcgagctcgagaacccgatcctcggtgccgaggacttctcctacgtgctccagcgcgtgcccggcgccatggcgttcctgggagcagccccacccggggtcgccgagccccatgcgaaccactccaaccgcatggtgctcgacgaggacgccttcgcgatcggcgtagcgatcgaggcagcctgggcgctcgacgaccgatgatcgctgtcctcgccttctgcgtggggctcctcctcggcgcactcaccacggcactcgtgctgcttcgtcgcctcggtgaccaacgagccgcagccgcggatgcgacccgaaccctcgagacccagctcgtcgaagcgaggacgaagctcgcgcagctcgagccgcaacgccttgccgagcagacgaacctcggtccgctcctcgaccaggcccagcgaagcgtcgaggagacggtcaagcgcgtcgtcgccgagcacctcgaccacggctccgagcaagcgatccagaaggccacggcgctcctcgacaaggagttccagccgcggctcgcgtcgctcgaggacggccgcaagctgctcctcgagagcgccgatacgctccgcaagctcgtcgacgagcagcttcgctccgctcgcgagcagatcaccacgacgctgcgtgccagcgggagcgaagccgcgacccagctcagcacgaccctcacggagcggatggaccagctcaagcagctcgcagcctcgatcagcgagcagctcgccaacgaccagcgcctcaccgggaccgtcgaggagagcctgcgcagcttcgtcgccgagaaccaggagctgcgcacgcgggtccacgagctcacccaagccctccagcgaagccccaagcagcgcggcaactggggtgagctcgtgctcgagaacctcctggtcggcgccggcctcacccagcatcgcgacttcgacctccaggtcgcctttcgtgacgacgacgggcgcacggtgatcgccgacgccatcatcaacctgcccggcgaacgccatctcgtcatcgacgccaaggtccagctcgtcgactacctccgcgcggtcgaggacccggcgaacgacaccgccgcacgcgcacacgccgaggcgctgcgccgtcagatcaacgagctcgccgaccatcgctacgaccgcctcgtcgacggcgccctggacgggaccttcctcttcgtgccgatcgagtcggcgctcgcactcgcactcgagaccgacccggcgctcatggagctggccatcggcaaggggatcttcctcgcgaccccgaccaccctcatcccagtcctgaagctggtcggattcctctggcgcggcgccgagcgcgacagccgtgccgaggaggccgagcgcctcgcgagacgcctcgccgacaagatcgcgagcttcgccgagagcttcctccagatcgacaaggggctccaggtcgcacggaacgcctacgaacgggccgagggtcaactgcggagcggccgaggcaacgcgatggcgctcgctcgtcgcctcggcgaagtctccggtcgtagcggcaaggcgctcccggcccccctcgaaccgttcgacgacgctggcgacgacgccagtgacgacgatctcgcgagctctctcgaagagggaggctcgtgagccgcgatcccatcctcgccccgacggacctcagcgccgagctgcagatcctcgacgtgcgctggcgtctcgggaccccggtgagcgagcatcgagcgcgctacgacgcgggacacgtgccaggcgcgatcttcgtcgacctcgaggccgtcggcaccggagcgcatcgccccggagccggccgacacccgctgcccgaacctggccaggtggctcgcgatctcgccgccctcggcgtcgacctcggcgcgccctgcgtggtcgtcgacgacgcccgcggcgcttcggcagcccgtctgtggtggctcctcgacgccctcggagtggaggcctacctcctcgatggcgggctggaggcgctcgagggtccgaggtgccaggatccctgcgatcgccgtgccgccgccaccccacgcgcggtccctgcgacgtggcccggcgagctggtcctcgacgtcgacacactcgcagatcagctcaacgatccgtcgctgtgcgtgctggatgcacgagcgcgcgagcgctacctcggccagagcgagcccatcgacccccgagccggccacatccctggagctcgctcgctcccgatcgacgaggtgctcgcgaccggtcgcttcccagatcccgcgacggcacgccggatcctcggccccgtgggcgatcgcgagatcgtcgcctcctgtggatcgggcatcacggcgtgcgtcctcatcgcactcgcgcgacgcgcgggacgtgacgcccggctgctcgagggttcgtggtcagggtggtgcgaggatcccgcacgcccggtctgccgctcggtctgcggcgatgagctcacgcggggctcgacgcgcacgaactcctgacggactccgccacgatccgtctcgctcgaacgctcctccgtgctcacagtaccggcaatgtccggtcccatcagcgccgcaatgacgtgaaagcatcactcacatgtacggacaagtcacgcagaggtacggacaactctcccacgccaaagccactccctgaggctcacgagtgcgcaaggaactcttccacagcacgccattccctgacgactccttcagcacacgcggccctctcgatcgccttgtcgcgagtttgtaacaatcatcattgcagaacgaccgatgcagctcataccatgtcgcgcatcctttgggctttggaagggggagtgagtgatagcagcgttacttccgtacgcgagttggctgcatcccggcgataattcttggcagttgactgcggccactcttgttgggctgatgtccattcctgggctcgcagtactctatgcgggtcttgcgccgaagaagtgggctgtcaatatcatgaccatggcgttcgtcggtttctctgcagtactcgttgtgtgggtgctctggggattcgacatggccttcgggtctcccattcaccttggcagcggtctctggggttccttcctcggacatcccggcctctcgacgagtgcacacgccgagcagagtcaggcatcgataccactcgtcgacggactcatgccgagctttcggttcccacaatcggccttggtctatttccagttcgtcttcgcagcgatcacaccgctcctctttctcggttcggtctggggccgcatgaacctgaaagcctggctgatcttcgtgccgctgtggtcgaccgtggtctacagcctcgacgccttcctgctctggggcggtgggttctgggctcagaagggagcggtcgacttctctggcggatacgtcatccacctctctgctggcatctcgggctttgtcgccgcggcggtcatcggacctcggctgcaccgtgaccgcgagcatgagcggccccacaaccttgtctatatggccatcggtgccggcatcttgtggcttggttggaatggcttcaacggcggtgatccttactttgctggggctgatgccgcgactgcagttttgaacacgaacatcgccacggcagcggcactattgacgtggctcttcatggatatgtcgtccaagcgcctcaatcgcaagccaacattcggcggagcgatcaatgggatgatcgtcggacttgtggcgattacccctgccgcaggatacgtgaacgggctcggggcgctcgcgcttggcatcatcgcctcattcatcgtgtggtggtcgttcaacgtttggtcgcaaaagggtttgttcaggaaggtagacgatgcattcggcgtcattcacacacatggggtggccgggctcgccggcggtctgctgaccggcatcctcgcagatccacacgtcatcgagtacgtcggcaccggtaagacatcgtcgtcttccgtgaccggcttgctctacggacacccgggccagttgctcttgcagctcggtgctggcctcacggtgatagccatatctgccgtcgggacgttcgtcatcttgaagctcgtgggtctggtggtgccactgcgctacccggatgaggtgctcgctgtcggagacctcgctatccacggcgaggtcgtcaaccctgaggatgctggtgtcgaggtgctcgatgagccaacactcatcgatccagcactccgcgaccatgatccccacggcgagagcgaggagctgcgggacctcgagttggagtagaccagcggactgtcatggcgacagggccggtgagacagtgtggtctcaccggcccatctcctgttcgacgttcaatcgacggcggcttgtccctgcctcctgggcgtcctcacagagtgtcctcggtgagccgatgacggttctcgtcgatgcgtgggcctccgaagccaccgacatcggccgaagtccttgccgcacgagctccgcatgtcccgaggatgcactggtctcggatcgaaccattgtgtggtttgccgtccgtaccgcgcttccaagcttggtcgacaccacatccccgacccgcatgcggtggttggtgccctcgccaccttcggcgttgcccccagcgcgaccgtgcgggcaacaatccccgaccggctcggcagcttgccggtggcgacccctcgacgcacgagcgctacctcggccagagcgagcccatcgacccccgagccggccacatccctggagctcgctcgctcccgatcgacgaggtggccgcgaccggtcgcttcccagatcccgcgacggcacgcaggatcctcggccccgtgggcgatcgcgagatcgtcgcctcctgtggatcgggcatcacggcgtgcgtcctcatcgcactcgcacgacgcgcgggacgtgacgcccggctgctcgagggttcgtggtcagggtggtgcgaggatcccgcacgcccggtctgccgctcggtctgcggcgatgagctcacatcgagccagaggcgcacgacactgagacagcgcggctcgagacaccggaccggtcgctcacggcaccgatcgacgcctggcccgaaggtggcatcgcaatcggcgcatcgagatcgccggccgccacctgcgggggcaaccccgtgagcagtgcctgcacgctgacgtccagccgtaccggcggagcgagtcgtgacgaaggcaggcgagcgccggccgtggcgagcccagcgccatagaccatggtgaggagagcggctgcgaggccgacacccagcgtgcgtcggtgcgcgatcacgacagcacctctcacgccaccacaactcggtccgtgtcgccgctgtcgccgagggcctgctccacgttcgtgggtctagcaccgtggcacgagcaccgcacgagccgtcgctcacgaggtcctcagacgacgaacgacccggtcgtcgcatccccgccttcgccaaccgcacgctcgcagcgccagcgggaggttccggggatcggccggctcgagttcaccgatacgacggccacgagccgacgaccacctggcagggtgtgcgcgaccgggcggctggccgagaacgggggctctgaggcgtggcatcgcgctctgcgaacctctgatgacctcggtatcgtaccgggacgaatccctcgtcgctgggcccaacgggccgagtcacacggtcgacggtccgccctgcaggtgaggtcctgccggactcgtccgcgatcacctcgtacactgcgagggggatggagcgactcacccggctcatgcgccgcctcgaccacctccaacagcgccacaagctcctcgcgatcgcgtttgcgatcgtgcgcaagttcggcgaggacaacgcctccacctgggcgcttctcgtggcctactacggctttgcctcgctggtccccctcctgctcgtggcggtgacggttgcgagcatcgtcttcgcccaccatccgaacctcgtccacgacgtcgcccacagtgccatcgcgtcgattccggtgctcggcgcgcagttcgcaagccgagttcgcgtgcatgcgctcgcgtcgcactcgatcatcggcctcgtcgtcgggatcgccggcctcatctggggagcccagggcgttgcgtccgccgcccagaacgccatggccaacgtgtggaacgttccgctcgtcgatcggcctggctttcttccgaggacgctgcgcaacctcggcatcctcgccgtgctcggcctcggggcgctcgcaacctcggtgatcgccgccctcgcaaccggtctcggccacaccgctgtcatcaccgtcgtcatcgtcgtggccacggtcgctgccaatgctgggctctacgtgctcgggttccgcctgctcacaccggcggcgatcgcgactggcgacctcgtcacgggcgccatcgtggcgagcgtcgtctggagcatcctccaacagatcggcggggtcctcgtcacccacgacctcgcacacgcatcggcgacctacggcgtcttcggcatcgtcctcgggctcatcgcatggttctcgatcgcgaccgaggcgacgctctacgcggccgaactgaacgtggtcctcgtgcgtcgcctctggccgcgctcactggctcctcccccgctcacgacggccgaccagagcgcccttgccgccctcgtccaccagcagcgtgcgcgtcgcgaggagcgcgtcgaggttcacttcgtcgcgggcaacgacgccgtcatcgactcgcaacacgcgccgagcgctgcgcccagcacggccgacgagactggtaccaccgcgacggataccccctgacgcgatgcggggcgccaccacggcgccccgctctccctcatcgagccttgcccgacccatcggcccgagtgctcggatcgatcgacagaagcccggaggcgagggccgcgccattccggcgggtgagggcgagctaccatgaccacgtggcgggtggggcccatcgacgatgaggactcgtcgaccgagcgcaacacgcgtccttagcacgggggcaaggacacgactcctcgccgtggcgaccgcatgcgtgagccttgctcgctgtgcgtcgacggccgatgcccaccacgcgagcgacgccggtcctccgaccgttgcggtgagctcggtcgcgagtccgacccgctcgcgttcgcagcgctcgccagcgcccacagcacctgtccgcctcaccgcctccgataccacgtggctccaagagcccggctcgggcatcggtccctggatgcaagccatcgacggtgctcgccacgtcatcgagttgaacgagtacctgctgacgagccccgaggtgctgggcgcactccgcgacgccgctgctcgaggcgtggccgtctacgtgatcatcgacggtcatccctacgacgacgcagcagcaccgaggatcgccaccaccgccctcgctggcagcggtgtgctcgtgcgcgaggcgcctcgacgcttcgagggcgcctacgcgttcgaccacgccaagtacctcgtcgtcgacccaggcagcgcgcgcgagcgcgcgatcctcggctctcagaacgccaccaccgcagctttcggcaacgaccaggccgaggatgcgatcgagacctcgagcccgagcatcgtcacggccctcgcagcgatctttcgcgccgactggcgtggcgtacccgtcgggcccggtccgcgggcggtgctcgtggtctcgccaggatcgcagccggcgatcgcgtcgttgctctccacaccgggcccatcgccgtcaccgcagaagagctcggcgacgctcctgtgctctctggcgccctcgaacgtgacggccccgaggcacgtctcctcgtcgcgggtcccctcggcgcggcggccgcacggcgagcggccgcgctcgcggcttccggcgtccaagtgcgcacgctcacgcatccctacgtccacgccaagctcatcgtgaccgccgacgcgaccttcgtcggatcgcagaacttctccgtcgtgtcgatgaacgacaaccgcgaggtcggcgtcatcaccgccaacccgacggtgcatgcgctggcgctcgcgtggttcgacgacctctggagccacgcgagcgtggtcgcccccacgtcgactccggcagcccgatctgctccgtcccagtcggctccacccccgcctgctgcgaccacacccgcgccgtcgacaccggccgcaacgagccaagctcccgcacctacgagcgatggcggcgacgctccctggatcccctacggcgcgaccgagtcgcaggtcgaggcgctgtggggcgccccgggctccatcacgaccacggtcgacgacggtgagccagaggtggtgtggaactacgcggccggttcggtcgacttcgagaacggcacggtggttgacgtcgaccgagcgcccgacgacgactgaggcgacgacgtcgtccgcgcccacgatcggacggcggccatcgactgctcgggacaggtggtcggcacctgtcgacgtcgaaagacgagcgggctgtccgcgaccgtcaccgcgagcatccggccccgttccagcgccgctgtcagcgcgagcggctccgaccccgcctcgacacgctgagtcgatcgtatggctcccaccgtcacggcaagcatcccggtccccgtcacacgcccgggtcgcacgctcggcgagcccggacccgacgacggtgcgcgaggtagcgccgtcatcgctggcgaactccgacaccgcgagcacacgcgcgccccgctacgacccttcgacgagccccaccaccgcatcctcgaggacactgcggatcacgtctgggtcctggtgctcacgcagcgccatccaatgactgccgtgggtgccgtcgtcgcacacggactcgatgcggatggccgccgagcgcccccgcctcgaatgctccagccaggcctcgacagtacccatcgtcgtctcgatcgccacgtggccggcctccttcagctcgacggccgcgcgcccgacgaggtcgacgacccacggctcgacccggacgaccggatcggtcggaacagcagggagcgcctcgagatggacctccgcgagcagggcatcgatgagtgcagcgctccctgcgacgtaggtccaaggcagatcgatctccgatgcgacgaaccacgcccgatcgcggggccacgccaggttggcggtctggtatcggccgaggccacgggtggcactgatcgcctcgacaggacccacgtagcagaggtaatcgcgctcgggaaggtgcaggcgaggtccctcgcgcacggctgccgggatcggatcgggcagcggttctggcaccgcgccgggtgctgcaagcagcatgccgccaaagccgtagccgtcccagaggccgaagcagcagtcctccggcgtcgacgtgtgctcgcgcaggagtctggcgagcgcgtccgcgtcgggacgagcgagcctgcctcgcgctggcccctggctgcgccacggtgccggcgcctcaggacgtacccgtgggaacgcgatggagtggaactgggcgtcgggacggagcgtcgtaccggcccaccgagcgacgtccgaccagcgaaccaaccggccatccgcctctggctcctcgacgggatgaaggatccgggcataggccccaaagccagccgggaccaccgaggtgatcgaaccaccgccgaacggcccgagccgacccgcgatccagtcccagtctccgttcggactgacccatctcgctggtgctgtgagctgcctcgccatgagcacatggtagctcgccccgagctgcggcgacggctcatgggcgccccccgtcgccgcgacggtgcccgcggtacagactgaagctcgccttcgcaccttcccacacgtgtgagggcacccggtctcgtgccgggtgccctcgaggtccgcgctacgactgctcgacgggggtggcagcgccgtccgtctggtcgagctcacggctcgccgtggcggccgcgatagagatgtgcggccgggcgatagcaaagtacaccgccccgatcaccacgatgacgaagacgacgagcagcgtgagccagtcgaagttgaacagtgcgccgcgaggtgagttgagcccggtgggggcgacgatgttcacgatcatcgccacgccgtagatcagccccagcaccgccaccgggacggcccagcggccgagctggaacggaccttctggacgccaccctcgcaaccgtgcgatgaggtaagcgagcaccaccatctggaacgagatgtagatgccggacacaccgaagctcacgagcgcagagagggcgttcacgtgtgctggataggtgatgaagccgatgtggatcggcttcgacggggtgaagtgcacgaggaacgacagcagttccgggatgatggccgcgatcaagatggcgcccaccggggtgcgacggcgtggcgagatgcggcggatgaagtgccaccccgggacggcgtggtctcgggcgtaggagaacgcgagacgagctcctgcgccttgcaccgccgtgccgcacgagaagaacgcgaaggtgatcacgagcaagatgagatcctggaagagcttggacgagatcgccgcactcaagatcgcagggacgccccccgtcgccgcgagcgcgaggcccttcggccctgacgggatcgccaggtcgagtgctgcgacgaggatcatcgacacgagccctccgacgacgagcgcgctcaccatcgcgcgcggcacgcgacgctgcgcgtcgacgacctcttcggcgacgtcgcccgcactctcgaacccatagaagatgtagaccggaccgaggatcgcgatcaacgccgcaccggtccaccagtgcccgatgaagttgaccccgagcggattcgttgcgacgtgcgtcgtcccagcgctcgagaacagatacgagaacgagtggtgcgtcgccacggagaacaagatcaccgcgacgcccagggtaccgagcacttcgaaccacgtgccgatccgcgagatcgaaccgaggaagcgaacgccgaagatgttgaaggcggtctggacgacgaggaacccggtcgagatgagcaggatgtcattcggagccgcgccatcccagtgggtgccgaacacgttgttgacgagcgaggcgaagtacccaggcacgccggtgtccacgctcgctaccgtgatgatgagcgcccagccgtacatccatccgacccaccagccgtagccgttgccgagcaggcgcttcgaccactggaacagtgccccggcaatgggataactcgagccgagctcgccgaagacgagcgcgacgaacagctggccgatcaccacgacggggatgagccacaggtaggcaggccctgccgaccccacgctgagcgcgtacaacgagtagaccccgacgaccggtgagaggtagcagaacgcgaccgagaagttctcgaacagcgtcatcacgcggtcgagctcttggcgataaccaagctctgcgagcctcgcggcgtcaggatcgtggtggtgatggtgggaggcgagttcgtcctcccatggtccttcaggcatgctccccccttggcttcgtagtcatcatccgacggatgcgccgccatctgcgcggcgcggattcaagcgacggcgacctctccgtcgcaactcggtgcgtgggcacgatcgcgcacccggctcctcgacatcgtcctggcaatccccctccttcgctccacgctcaccccctgtctgagcgttggcccgatcctactcctccgttgcacctggtgacacggacgtttcgccgagctccgatccgttgacgaccgttcgggcgaagtggcgatgcatccaggccaggtactcgccccgggccgtcacgatacgggtgaggtcccagcgcgggatggcttgttgggggaccgacggggccatgagtcgcggatcgacctcgaacacgtgctcgaagcgttggacgaccacatcggtgatccgccgtggcgtggggaggtcgaactcgtcgcgagagcgaaagctcacagctggcccccttggaacacgttccccttgcggaaatggtacttgccgggattcaagatgccgtgcggatcgagtgcctcctcgatcgcgtccatgatggccaggcttccctcgagctcctcgggaacgacgtcgacatcgccggcgcggcaggcgccgtggcaggcagagatcgaccccccggcgccgacggcaacccgagcgatggctcgcttggcctcgacccacgcgtcccacatcccgtcgtcgagcacctgctcccagataccgacgtcgatctcgacgaggtagtcgacgccggtatcggcgctggtgtaggcgaacgtaccccagtcgtcgaaggcgtcgtagcgacgtcgcagctcctccacgatcgcatgccattgcctggtgacggagacaatctccgggtgattgagggcagcgtcctcgcaatgccaccccatcggcacgacggtgccgtcgagtcggcgcccatggagcggtgttgcgtagcgatcgtggcgtgaggcccagtcgccttgggagatctcgtcgccgaggtagcgtccgccgaggtcggcggcgatgcgccagagccgtcgcccacccgcgcgcacctcgtcctcccagccatacaaggccgtacagaccaccgagcgcaccgaggcgggctgggggatgtaggcctcgtcgtcgcggcgcaggtaggcgaccttggcctcgtcgaagaggacggcgcccgcgaacgttgcgaccccggcgccagcgagggcgtcgacgcactggtgggcatcctcgtagcgtgcaaagccccagaagagggagagctcggcctctggcttcgggtagagcttcagcgtgacctcggtggcgatcccgagcgtgccctgatggcccatgaacagctgcttgagcgagagacccgtggaactcttcgagatcttcggtccgccaccgtcaccgatgcgcaccacgcgcccgtctgccaggacacacaggaaactgaggaccagatcgcgggtgtggccgaagcgggcgccgatcagcgaccagccgctcgtgccgatcctgccgcccaccaggctggtcgggtacgacgccggatcgtcgggatagaacaagccgaacggggcgagcgcctcgttgagcttgagcatgttgacccccaccccgaccgtggcggtgcgacgcaggggatcgatctcgtagatctggccgaagcccttcatgtcgagcaggatgccgccgtgttcggggaccgcaccatcggtgagtccggtgccgccagcgcgcgcgacgaccggcacgcgccgctcgttcgcgagcgcgaggatcgcagatacctcctcggtggtgtgcggcagcacgacgacctgcggaaggtgctcccgccaccgatggaccggaaacggcgccgggacgcgcgtgcgcgcgaggcgcgcccccgcatcggtacgaacgcggtcgggacccacgatcgcgctgagctcggcgacgagcccctcgtcgagacccacggcgaggctcatcggacccaccccggcacctcgatgggcgcaccacacgagatcgcgaccagctcgagcaggtcgatgaccgccatgccccgctcggcgcccgcgttcgagagcggccgctccgcccaggggcaggcggtcacgacggcgttgacctcgaggtccgccgcgcgcgccacccgccgacgcgagagctcggccgtcacctcggggcgtgcgatcgcgagccccccgccgcctcccgagcagtagctccactgggtcacccgatcctcgtcgacgaactcgagacccgggatcgacgcgagcagcgcacggggctcaacccagatccccttgcgcttgttcagtcgacagggatcgtggtaggtcacgcgggtgttgatggggagcgtcggagtgaggcgcccctcgcgcacccaacccgcgacgagatccaacgcgaggaccacctcgacgtcgtagtcgtcgccgaagtaacgggggtagtcctccgtgaaggagatgtagtcgtgtggatcgagcaccacgatgcgtcgcgcacccgctcgccgccaatcggccacgttgtgctcggcgaaccgccgcgcctgatccgcatagcccatctcagctgcgggtccgccgcagcaccagggctctggctggagcccgatcggctccccggcggccttgaagagccacgcgacggcctgtgggaggctcgtgcggtagaaggcggcctcgcagtcgacgaagagcaccgtgtcacctccgaacggaaggtcgaacgaactcgcccacgccctggagagctccacgccgacctcggcaaccacgggctcgtggcgatcgcgatcggttgccgcgttccacgccgaccacgcaggttcctcgacacctcgatcgacggcgagcgtgcgcgctgcacgaacgacgtcgaccgtgcgcgtgcggaagcggtagaagtcgccgacgaacagcgtgttcggacaccggagctcgcaggcaccgcacatggtgcagttgacgtagtcgcgagcgacgtcctcgaactcgaccaggccctgctccatcgcgacgatgttcgcgtggaacgccgtgggaaggtacgtctcgtcgcgcgtgacctggtagacggggcacacctcccgacagaacttgtgcccggacgagtagcagttgtaggccgcattgcgccacgactcgacgaaggcttcgtccgtggctggcctcgcggcgtcgtcgctgcgatgctggatgtccatcggttccctccctaaaacacctgaaatcagatgttagatcctttccagtgtgctgtcaagcactctcgaggtgcactcacacgacgatttggtagggtcatctcgatgcctcgagccgccgagcacgtgctcacgcacgtgccgttctcatcgctgcacgagaccgacaaggtcgaccaggtggtccagcggctcgaccacgccatcgcggccggactccttccgacgggctcacgcctgccacccgaagcgctccttgcccgcatgctcggcatctcgctcaccacgctgcgggctgcgctcggcatcctccggctccgcggcacgatcacgacgcgccgaggccgccaaggcggatcggtcgtcaccgccgacccagaggccgtgcgcgccgccgcgatcgcacggcttcgcacactcggtccctccgaggttcgcgacgagggcgacctccatgcagcgatcctcacgaggagcgcaaccctcgcggccgagcgcgccaccgacggcgaacgcttggcgctctcgctggctgcgaccatgctcgacgaactctctctgatgcatgagctccaactccatctcgaactggttgcactggcacagtcgacgaagctcctcgaggtcgaactcgactgtctcctctggttcggaggcttccttcagctccgctccgacaccgagaggagcgccatgctggcgtcactcggcagcctcgtggcggcggtcgccgagggaaccagcgaggaagccggtcgacgcgcgcagcgacacgcagagcgcatgacgcgatgggtgcatgccaccctcatcgccacgacgcatgaggacggccagcgatgagcccaccagacgtgctcgacgagctcatcggcacgctcgcgactgcgatgagcgacgttcgagcgctgctcgacgatctcgctcacgaggcagcgacccacgacgccgtcgaagtgctcgtgcgccgcgagctatcgcgaccgggctccatcgtgctcggggcaggcgtcattcgagcgggcggacgcgccgacagcctctggtggtggtggcgacgtggaaccgtcacgagcgagctactcgtcgccctcgagccgacgtcgctcacgttctacgacgtcgagcaccagccatggttcctcgagcccctccaatcaggcacactgaacctggtcgggccctacctcgatcgctcggggacgaacctgatggtcgtgaccgtctcgaggccagcccccggcgcgccggccggcatcgtcggcgccgacctcagcctcgacgccatcttccgactcctcgtggcgacaccggcaggacgccagctcccctgggttctcgagaatctcgagggccgggtgatcgcctcggccgaccccgcgatcaccgtcggtgagcgcgacgtcggaccgtggcgaatccaacgcgcctgtccgatgctgccgtggcgcgtcgtcgtgcgagcgtccgcggcagcatcggattccttcgcgtcgggctaggcgctgacgctgaccgtcgtcggcagcgtcgcagacttcgccgatgactggatggtgaagcccacctggatgctcgcgcccggctcgatggtgccgttccagctcgccggcgtcacggtgacggtgccggtcgaaccggagaccgtgccgttccagaggctcccgatgctctcacccgagggcaccgtgaacccgagggtccatcccgacaccggcgccgtgccggtgttcttgatggtcacgtccacctgaccaccaccccaccaggtcgaggtcaccgtcgcggtggcggtgagctggccggacgaggtcggcgtcggtgtcggcgtcgtcggcgcagggtcactcgcggtcgacgacccactgagttcatagctcgaggggaacacgccgttctcgggcccaccgttgagcgtgaagcccacctggatgctcgcgcccggctcgatggtgccgttccagctcgccggcgtcacggtgacggtgccggtcgaaccggagaccgtgccgttccagaggctcccgatgctctcacccgagggcaccgtgaacccgagggtccatcccgagaccggagccgtgccggtgttcttgatggtcacgtccacctgaccaccaccccaccacgtggaggtcaccgtcgcggtgcccgccaaggagcccgaggagaacgagatcgggccaggcgtcgtcgggctggtgggagcgggcgtcgggttagacggcggtggcgtgggatccgacggcggtggcgtgggatccgacggagcgggcagtgacccaccggcggcctgctcgaagatctgcgagaactgccacggggtctcggtcgtgccggagcagtagttcgagtcctcgtcggcgttgttcgcgcactcgacgtcgcggtggatctcccacatcgagagcctgccgaggccaacctgctcggcgaaggccccgagctgctgggcgtcttgggtggtgaagatctcacccgagaggtcgttctgccctatcatcggggtcacgccgaccatctgccagagctgggcggtggacaggttcgaccagatcgaggcgagctgttgctcggtggcctgggcggcctcgatcgccatcgtgcccatcgcaccttgggcctgggggatgccgtagtccatcgccatgacgttgacgttggacacgtcgacaccgtaggtcttcgccgagttcagcagatacagcgagttcgcgagcagaccccacggcataaccggcagcgtgtaggagacgctcactgggtggccttgcgctgcttcttgttgctggaccagggcgagggcctggttgcgcaggttcacagcggcctggtcgttcaggtccgaaccctcgatatcgaagtcgaggttgtagacgtggtaggtgttgatgacggtctcgtaggcttgggcgagcgcctggggcgaggagcacacctgggcgagctcctggttgatctcaccgccgaaggagacgatgggcgtgccaccctcggcttggtaggcagcgatctcgttgcggaagaggccgttgttctggcccaccgggaagtagttgccccagctcggatagcaggtgcccttcgagctcacaatgaacgccagcgtgagcgccttggcgccggactcggagccgagctgggcgagggtgccggtcggcggcagggtcatgtccacgtagggcgcgaaggccgtcgaggtcgacgaagtcgtcgaggtggacgaggagaccgtgcttgcctgcatcgtcgaggctgccacggtggtcgtcggggcccaaccggtcaggttcgagatcacgatggtctcgggactggtagccgcatcgagctggagaccgaggacgggcgaggttccgacccccggaccgagcgcgagggtcgtggcctgctggcccacggttgcgtcaggcaggaacgaggcgtggtacgaggaggacagtgcgaacggcgtcacctgcgcatccccggtgggtgagctcaccgacacggtgtagccgtcggcaccgctcagcgcacagctcggccccacgagctcgacagccggatagccgctcgttgcggtgacgctgataccggcactcgtctgcgtgatcgtggcgttcccccatcgcacctggggcgtgcaggccgcagcacccgacgtgcccgccatggcgatgggcgtcgcgacgccgctgatcgaaggctcgtcgatcacacccgtgagggttgcaccctgaggcacggtgagcgccacgggggtgctcgtctcgacggccgagcccggttggacgagcggcacgaggttctgccccgtactcagtgcgatcgtctccggggacgcggcccccacgggcgtgagagcgagcgacccggagcccgccgtctcgtcgacgaccgcataggcctgaccgagcgctccgagcgcgggcaccgagaccgtcgagcccgacgccgtcgtcaccgagggcgcggcgggctcgttcgcctgcaccgcaccactggcaaggcccaggctctgctgctggaccacgacccctccgtcgaagggggttccctgctcgttggcgatcagcgacggaaaactgcagctgccgccgttgggtccggcgaaccagccccacgcggtccaaccgatgccgtgctgctcgaggtagtcgacgatcgactgctcggtggaggtcggatacggggtcgcacaccccagcacgccgaactccgtcgcgacgaccggggcgagcgacggcacggttccgagcgatgcgctccattgcgacggggtggtgggcgtgctctcgtgcacgtagagatggaagccataggcgacattcgcaccagcgaggccccactcggcgatcggcgcgaggttgcctgcccagtgattgccgtcgacgatcaccacgttctcggcgccggtcgcgcgcacgatatcgaggagctgctgctcgccaacggccgtgtaggactggccggtatcggcacaggtgatggccccgccgttgcgccacacggaccatgggatgtcgtggggctcgttgtagagctcgaacatgacgttcggatcacccttgaagatcgaggcggcctgctgccagaaggtctcactgggcacgtccggggcgcacgcggggttggccgagggtgtcgcggtcaccgagtcggccccgatcacccggtgaagatcgatgatcgggatcatgccgttgtgctcgacgagcgacacgaccgactcgacggttgcgatgtagccaggggcgtactccggcgaacccttcagccagaaggcttcgttaaccgggatacggacggcgttcgcaccccactgcttggccatcgcgacgaactcattcggattgacccccgactggctcgcgttggcccactggccatccggattccacacgaggctcggccagtccacgccgtggagatacacgggcgctccggctgcgtcgacgatgacgttgccacggacctggaacggaccgctcaccgcgccaggaggtgtcgccgggaacgcggtcgcggctgccgtcagcgctgtctgtgctcccaacacgctcgcgatgccaccggcaacgaggccaagagcaagagccacgcgcgttgccctcgacaacctcgctgcatgacgtgcaaatgaaaccatgccgtggccatcggcatcgcaaacctcgaacctgaaccggccgcgacgatctcgccgaacgggcagttcagcgtgtcaacggtcgttgagcaccgcagcagctgggctcggcctacgcccgacgcgacgcacgatctccggatcgacctggcgggcatcgatgctgatccggtagcggcgaggcgacctccctgccgagaagaggctgatggggatcacaccgtgacgcgcgtgctcgttcaactccgaattcaacctcgacaaacgggggcgcagccacgcggtatcgacgcccgacctcgtggcccgaatggtccgacggtcgatccgaacatcgatggctcgagcaagctcgatgagctccgcaccgagcgcctggtcgcgctggcgctcgcggggagcggcgagccagccatcgccctcgacgacgcgacgaaccagcaagctcaggagcagggtcgacgacggacggaggtcgaggggaacgcctccccagacgaatcgcgacatcgacccgacggtctcgagcgtgaggatcggattgagcgcatcgttgaccgcgcgaacactcagggcaagctcggcgccgacgccgaggagttggcgaaacgcgctcaggcgaacataggggacgtcgatgagcgtgaccacgcgcgcggcagcatcgaggcgcacgccgtcgaggttcacgatcgtgccctgctcgcgactcgggtagtagaacgagggagcccgctcgtaggcgggagggacgatgacgtgcaggagtcgatcgcccgcccgcgcatacagcgagaacgccaaccccacgtgataggccatggtcttacgaccgccagagagcagggcgaggatcccttggctgtcgtccttggccagttcggcgagctgcgcgaacaccgcctcacccgaggcgagggccgcctcgttggagtcgacgtcctcggcgggaatcgcgacggacgacgcctcgatggtcgacagcgacacacgcggtggtttcacgccgggggcccattcctggtagaggcgagccagccgcccggattcgccgaggagccgctgcgccagatcggcaccgacacgcgtggcgagtaggacgatctcgtccggaacgatcggctccggctgtgtcgccagcagcgcccagcaggcctcagtcacgacctgcggtgcaagtcctatcgttgcgaacagcgaccaggaacgttgtccttcgccgttgttcacacaacgaaatgtagcgccaccaccaccccctgatgacccaggaccagcgtttgcaatgttgcaacttggccgacggacatcaccaaatgatgaacattgcaatcttggttaattggtacggggagtcagggcactgcatcgtgcatgctggagggcatcatgcacgttggacgtcgcgagtcgccctgagcgcctcacggaagcagcaacgctcatgcgccgaccgacctcgcccgaacggctaggcccggctcgcaacccagacgtcagcgctccgtggtcacgcaccgcccagtggtctttgtcacgaccgactaggacgtcgtcgcgctctgtgcggtgtctacctcggtcgtcggaacggcgcgcgcgaccacgaggtgacacacctcgcgttcggggcagtcttccggtcgcagggacgcagctcgcccgaggaccatctccagctcgtcacggagcatcacgagaccggcgatctgttgctcgacccgcgcacggtgacgctcgagcagcgtcgccacatgacggcacggaacctcgccatggtcccgcaccgccaggatctcgcggatctcccctagcgaaagacccagcgtctgcgccgcacgaacgaactcgatgcggccgatcgcgagatcgtcgtacacgcggtagcccgacgcatcgcgaggaggctcggccaagaccccgatcgactcccagaatcgcagcgtcttcgagggcacgccggttcgttctgcgagctcgccgatcctcatggctgaagcatagctgaatccgcgggtacaagattccagctagctggaaggcgcagactgatgtccagacacaccgagtgtaggaggaggacatggtcatgagcacccttcacgcatccgctccctgggatctcggcatcatcggctctggctcagccgcctttgccgccgcgctcgaggctcgcgcacgcggcgcctcggtcgtcctgatcgaacgcgatgcgctgggcggcacctgcgtgaacgtgggttgcgtgccctcgaaggcactgctcgtcgcggcacaccgccgaagcctcgccgcatcggcgtacccgggcctcggagccgagacactccccatcgaccacgacgaactcgctgccggggttcgcggcgtggtttcgagcctcgtcaagcggaagtaccgcgatctcgctgagcggatggggatcgacgtacgctacggtactgcgcgcttcgtgtccgacgagacggtgagcgtcggcggtgacgagctcaccgcgcgccgctggatcatcgcaaccggtgcccatgcggtactgccatcggtcgacggtctcgacccagcggagctctggacctccaccgacgctctcacggcgctcgagattcccgctcgcgtcgcgatcatcggcgccggctcgatcggtctcgaactcgcgaccgcctacagcgggctcggagcccgggtccacctgatcgagagcactccccaggctgtcgcgagtgcgccgctcgaactgacaggagccctggtcgagcacctccgcgcatccggtgtcgccgtggcgctcacgaccacggtcggttctgcacaggcgacgacctcagggtggctcctccagctgcaaggaccagaaggtgcgacgcaggtggaggtcgatcgggtgatcgcggccgtgggtcggcgccccaccaccgagaatctggggctggagacggtcggcgtcgaactcggggcccgcggggaagtcgtcgtcgacgccaccatgcgtacgtcgaatcgaggcatctgggcggccggcgacgtgaccggcggaccccagtacgtctacgtcgctgccgcccagggcgcgctcgcagcccgcaacgccctctccgacggtgacgagcacttcgacgaccgcgcgattcccgccgtcgtcttcaccgatccgcccctggcccaggtcggtctgacgctcgacgaggcacaacaccagggctacgacgccgagtcgaccaccttctcgttcgccgatctcccacgtgcaatcgtcgagcacgcgaccgagggcctggccgtcatggtcgcagaacgcacgagtgggcgcctcctcggcgtgcacctctggggcgtgaacgcagccgaagtcatccagagcgccgtgctcgcactccgcaccaatctcacgatcagcgacctcgcgacaacgtgggcaccctacctcacggcctccgaggcgcttcggctcgcagcacagagcttcacaacggacgtcgcgaacctgtcctgctgcgcctaggtcgcctcacgagcgacgatggactgcggaccgcggacgtcgctccgccgatggtcagggcctgagctgccccgacgagcacgcgggacgctcgcgtcgcggaggcgaccgctcggccgcatccacggacgggtgtcgggcccgatcagctgagccttcgcgaaaccgacggaaacctggtcgcctggagccgtaccgcgaggcaggtgcgttcctgcggtgggcgctcaaggccttgagcgatcacgcctccggaggtggggcctgctgggtgctcaaccggatcctgatcggaccacgcgccgtcgcggggtcgaccggccgaccgtgctgcgtgatctcgacgacgttgcgagtcgccagacgtcgagccgctgcacgggccggctccacgagttcgcgccaccggtcgcctccgactgcccgagcggcctcggaagggcagatggagccacctggacgccgcccgacaagcaggtcgcagatcgcaccctcgagcgcgacgtcgatggcacgggattttgctcgccgacacgcatcggagcagtagcggacctcatcccaggtccgctcccaccggcgtcgccaagtcatgactcgaccacacgtcgcgcagaccttggcgggtacggcacctttggttgggctgcgacgtgaacgagccacgacgaccgatccccgagggatcgatccggatcgagaccgcgccacgttgcacagcctacgaacctctcacacgactgtcgcgctcacgacgcacgaccgtcgcaacgccacgatcggcgtaacggcgcgggccgcccgacacgagtccctggatgcagcggtgaggatggcgttcgtgcgacgctcttgcggcgtcgcctggcccactcccacgggtcggtagaccctccgcagcgaaacgaatcgcgctggtcctcggcggttcacaccggttcgcaccacaggtccctccttccctctactggccctcgggaacgagggcagccgcaccactgcagagctgcgatgccagcgacgatgtccatggacgacccgccgacgggttcggccgggaccttgctcgacgttctcgcgctgcgccgtgctcggtcggcgcgcacccccacaccaccacgcgcgctgatgccggattttcaccagctgcgggcccctcgatgccccacgaccatcggcctagtctgcctcatcggcgcaccagaacgcggggtggcggcctctggacaaccagcgcttcttcgagccacggagatcgcaccaccaagcaccgaggccgccatcgttgcggccgcgcatggctcgtagtcggcgtgcggcgcatgtgacgctcgaggcggcggggccgccgccggccaccagactgaggacgtgggaacacggccaaccaccgtctggatcctcggcgaccaactcaaccgatcgatctcgtcactcgagggggcagacccgtcgtcgacggtcgtgctgttcgtcgtcagccgagccaagctggccgcccgcccatggcatcgccagcgtctgcacgccatcctcgcggggatggcgcggttcgcagccgagctgagagccgagggattccgtgtcgacgagcgagaggccgacacgttcaccgagggtctcgcggcccaccgcgcctcctatcgacctgagaccgtgcgcatgatggcgccggagtcgttcgctggcgaggcgctggctcgccggcttggggtcgaactcgttgcatccaacctcttcctgacgacgcgcgaggagttcggcgagtggatcgctcagacccttgagcgtgggcgtcgcccacgcatggaggagttctaccgctggcagcgtcggcgcctcggcatcctcatggacgaagacggacccgccggaggccgctggaacttcgactcggagaaccgactgcctccgccacgagccccggttgcatggcccacggtgatcgtcgatcagctcgatcagctcgatgtgcgtatcgtggcctcactgccggatcaagctgtcggagacccaccccagggttggtggccgaccaatcgggtcggagcactgcgacgcctgcgcgccttcatcgacgagggacttagtcgcttcggaccgtacgaggacgccatgttggctgacgaaccgcgcctcgcgcactccatgctctccgtcgccctgaatctcggcctcctccacccgcacgaggttgtcgaggctgtcgaacgcgcctttcgggacggtcgcgtcggactctcgtccgccgagggcttcctgcgccaggtgatcgggtggcgtgagtacgtgcgtgggttctattggtggcagggccccacgtatcggagtcagaacgcactcggtgctgagcgaccattgccgccagcgctggccaccggacgaaccaggatgcgctgcgtgcgaacgacgctcgaaggggtcgagcgccatggctgggtccaccacatccaacgactcatggtgctggcgaacctcggcaccctcaccggcgtccagccggccgcgatgctcgactggatgtgggagcgcttcgtcgacggagcggagtgggtcatggtgccgaacgtgatcggaatgggcctctgggccgacggcggcgtcatggcaacgaagccctacgtcgcgggaggtgcgtacctgcgacgtatgagcgactactgccgatcctgtgagtacgaccctcgtcagcgcacgggagatcgcgcatgccccttcacgacgctgtattggtggtttctcgaccgacaccgtgaacgctttgctcaccatccgcgcatggccccgctcctgcacaacctcgatcgactcggtgacctcactgcgatccgagagcgtgcccggcagatcctcgaactcctcgacgcgggcctcgcctgatgtgcccgagcccgactggttcttcgagtcgatcgtcaacgtacgaccgtcacgggcgatgtgactccggacattggatgagaacaccgatgccggagacgtgtcgccaccctcgatggcatcctcgccgagcgaggagccccaggcttccgccgagtcggcaacggcccggagtccgtggcagcttccgtggccagctgggcagccgaactcgcggtgacctcgtgattcacggatccgggctccccgcggcggtaacggtccgggttcaaccggtcgttgcaacacccccgatgacgcaggtgcatgtgcaaccaaacaggaaccaggctcctccgggagcgaggcgacagtgggcggccgatcgtgccctgcggccgccgatgcgctccccagggcggccagacccaccacggatgctccagtaggccttctggcagctcatcgccacggggatctcgaccgcggacgcctgcgagcgcgtgggctcgcgcgtgctacgccaacctgtgctcccatgcccgctacggagcctcccgagcggtcatcaccaccgtccacaacgaccgctggcggagagacggccgaccccgagcctcgtcggctcgaccggcggcagaagttcgagtctcacaccgagacttgatccagacacgcgacatccgtcgtcaatggagctgacgacttctcactcgaacctgcctgaactgcgggaacggatcaatgcgttcgcccgcaccgacaggagccaccatcagacccggatcacctcgaggcccggaacggcgtcgtagtcgcggtcttgagtgacgaccgggattgaggggaccccaagagttgagccacccgctttgcgagttgatgtgcttgtcggtggagccaggcctcgacgaactcgaccggagtgagccagccgtgtgcgctgtggggcctgttcatgttgtagtcgatcctccagtcctcggttaggacctgggcttcgaggaggctgtcgaactgctggccgttgaggtgctcgtcgcgcatccggccgttgaagctctcgatccaggcgttctgccaggggctgccgggatcgatgaagacggtcccggtaccgttgaaccggcaccagtcagccacggcgtgggcgatgaactccgggccgttgtcgaagcggacgtagactggggcgctgcgacctgcggccaggcggtccaggcatctgaccaccccgtcggcgtcgatcgaacgctcgacgtcacaggcgagggcttcgcgggtgaactcgtccacgacgttcaagaagttcaagaacttgagcatcctcccgtccgacgtctggtcgaactggaagtccatggcccagatcacgttgggccggatcgggcacatcgccccgacgggcttgccgatcccccgcaggggcttcttgcgctttctgtagggcacacgcaggccttcggcgatccagaggcggtggatgcgcttgtggttggcccgccagcccgccttcttcgcctcgacggcggcccgccgccagccccagcgcggacggcgccgggcaaagtcacgcagccacgcccgcagtgccagctcgtcgtcggaggggatggggggcttgaggcgctgagtcgagcggggctggccgacgacccggcacgcccggcgttcggtcaccccgaactactctcggagggccaccacggcccgccagcggcagtccggggtcagaagtttccccggttcagctccttcaacatgtcgatgtcgagggcctggtcggccacgatcttcttgagacgcgtgttctccttctcgagctccttcagccgcttgacgtcatccgccttcatgccgccgtactggttgcgccaacggtgccaggtcgactcggtgatctccaggtggcgggccacctcctcgatcgactggccctggccgaggagcttctcgccctcagccagcttccggatgatctgctcggtcgtgtgccggcgtctcttcatcgtgtgctgtcctccttccccacatcgtggggcttggactcgcacaacgggtggagcagcctacggggacccggccaggatcccttcgaccatcgcggttgccgcaacaagcacgtcgagtatcgggacccggcggcgctcagcgtgcagcacggcggccacacgggcaaactgacgcgccacctcggcgtccaccggtagcggatcccacgtcgactccacggctgaaagcgtcgccactcgcgccggtcgatcatcgtcattcgccatgagcacgccgagcgtcagttcggccaccgtcaccaccgacacctctgtgtcggtcaccccttccatcgcgcccaggggtcgacccgactcagtggcgacgaagaacgaggtgtcgagcagtgccctcatagatcgtcggtcgtgtcggacagcagactccgcacctccctcaggagcccgcggtcggccgggtggcgagacgcaattgcgaccgcctcggtcgccgacaccgtccggcgacggcgcaagggcacgatctcggcgaccggtcgccggtcaaccgtgaccgtcaacctctcgccgctctcgacccggcggatcacctcgctgaccgtgttccccaggtcccgcaccgaaatagaaccactcacgtcgctacatgtagcacatgtagccacaagtgacccgcgtggagacgaggggactcgaacccctgacctcctgcgtgcaaagcaggcgctcttccagctgagctacgcccccaaggcttcgctcatgctaatggatcgtgctcggaccaccagtggtccaggcccttctgcaccatcagcgacgtcccggaccaagcaaccgcaggctcacaggctgcacggctggaccacgactggtcaccagtcggacgcgctcgaaaacgtgtaagaccacggcattcgccgccgcaccatcgagactctacgtctgtgccagccccgagcggggccggcacagacgccacgcggagggagtgggattcgaacccacggtacccttgcgggtacagcggttttcgagaccgcccgattcggccactctcgcatccctccccgcccaacgaccgaagtcgccgaacgcaagcagagtctacggcacgacgcctgggcgccgctccgagaagaaacggcgaaggagcaaagcagctcgttcggcatcgaccccgccgacgatctcgagctcgtggttcagccgcggatcggcggcgatgttcatgagcgacccgcatgcacccgcctttggatcccaagccgcaaagacgacgcgtcgggcacgggcgagcaccagcgccccggcacacatcgcacacggctccagagtgacgtacacgtccgcaccgaggacatagccgtcgccggcatcggcgagcgcatccgacagcgcaagcagttccgcgtgcgcaaggctggagcgccgctcgatcgtctcgttgtgacgcgcgccgagcacgcgaccactgcggaccaccacggcccccaccggaacctcagccgtccgcgcagcatcctcggccagaccgaaggcgacgtcaagccaccgacggtcgtcagcgctgagcatcgacgtcagggggtgcgacgcgcttggacgcgtcgaccggtcgagtctgtcgcttggcgatggtcgtgaccacccattcggcatacggatcgtgcgggagcgcgacagagcgaaccagcacctccgggacgtcgtacgggtgggcagacgcgatgagcttcgtcagacggagcacatgctcagggagtgacaaggcccgcacctcgacctcgtcctcggtgtgccagtcgccctgccagtagtaggtcgagcggaccccatcggtacgcttgacgcaggcacacaggccggattcgacgagcgcgtccaccagcgccgctgcgtgctcgtcacttgcgagggtggtgacaatctcgactgcgtcgatcactagcccctccgctcggtccccgccactatagtgatctgcgcttgtgcgctcgtagctcaacggatagagcatctgactacggatcagaaggttgggggttcgaatccctccgagcgcgccacaaagctcctggtaagagggttgacggcacgtggactgggcgtggttcccgctcgcgaagtcaacggcaggcccaggcatcgtgacaccggtcggcgcactccgctctgactcggcgtcctaccaccgaagggtgcttctgtcaggtcgccgcgccggaacatcggcatctggtcctggaacaggtgcagattgctctggaacgtcgttcctagcttgatcctcgaaggttgatcgcgacgtggtcggcttgtgggagtgtggttactccctcggcgtccagggccattggtcgatgtaggtggggatctcgatcgagctgcgcccatagcgcgaactctcgaggatcgcgcagctacgatccgctgtcattgtgagcgacgtccgaagggcttggctgatcaatcggcgcccggtcgagcatctcggtgtcgagctttcgggcccgactgcgacggatcgttgctgcagatctgctcctgaagcctgattcaccggacagacggaggacgacgggcacgatcgctcggcacccggagcggccgccgtggagctcggcggactccctagacggtcgggatgcgacgacggattcgaaggttgggggttcagattcctccgaactcgcatcgccgtccagctgagggggcttagaacctgcaggcaccctgccgatcacgtgcctcgtacgcttgcttcgttcgcctggccaagcgagaacacgggctccggccgatgccggagtccgcaccagtggcctcctcccttcgaatggcactggtgcgaccccgcgtcactcgagcccgaagagtgaaccggtgagcgttgcggcccgccgcgcgcgtcatcagcgaccagcctcaccatgccggtcggcaggtttggagcaggtcccagtgtgagagaccatgcccgccccggtgccaccgtactacgtcgaaatatcgggatagggaagccggacgtgcgagaggcgccgtgcgtactctcgctggaaaccgagaggctcctcgtagtcgtgctcgaacagggcgatgaacagggtcaaggtgaggaagtggtgggcacccaattcgaagagccgcacgtagtcgtgcgtggccagggcctctcgctcctcatcactgaagcccagccaggtggtcgcctccccactgtggaggttgaggacgcgattggcccgctcgcgctcccaccactcgaccgttccccgcggatccacgcgatagcgcgcgacgagttcgggatcgcgatcgaccgtgtagagaaacttgtctacgagatagcggctcacgcctcccccctcctcggataccaggtgaaatatgcctccatcgtgtggaacaggtcgaggttgtcgacgtaatcggctcgcacaccctgaccgacgacgcccatcatgagcaggaagtccatgaatccgtgcgtggcgttgcccggcagccagagactctcgagactgacctctgccagagccccatcgatgtcagcgttcgcgatccactggatcgccttctgatcgaaatctgggtccggcccgtgcggaccgaactgacgcggtccgcccaactccagcgagagatgtccagttccgatgatggcgacgcgctggttgctcggccactgctcgacgatgcgccggagcgccgctcccagctcgacgaaccgtttgggctggggcatcggcggcgcgaagatgttcgtgtagacgggcacgatgggcaggtcgacctgcggtcgcagcgtgatgagcgcacacgtgatcgagtggtcgatgcggagctcgttcgagaacgcaagatcaaagccctcgtcgagtccctgtcgaaggatgtacgcggcgagttcctcctggccggacacccgcatacgtgggagtccgaactcccgctcctcgttgtagtagttcgcgtcgaacaccggcgccttgccgaccaggaactgtggcatgttgtcgagccacagttggtgaaagtggtcagagccgaccatcacgagcacgtccggctcggcgcgggtcaacgtctctcggaacgcctcgatcttggcgacccagacgtcggcgaagtcggggcgatcggctccggtactcgtgctcgccctgtagtagaacgggtggtgcgtcgacgcgatgatcgcacacacatcggccatcatgccccccttcgtgtcatgctaggcagtcggatcgcttgcgcctggggcgacgtagcgcgcccctcgatccaccgtgaggtacacatccatcgcgatgggccgccgacgctcctcggcaagatggccaaggatcccggcggtacgcgcgagcaggaccacgcctcgcgcgagttctccctcgatgccaaggtcccagagaacggccccggctgcaccagcgccgttcagcggcagccggcgaccgagtatgtcggcgtgcactcgtccgatcgcctcgaagagtgccacgtgcggacccgcggcgccctcgcgtcgcgccagttccatgagcacgcccgtgcgcgggtcgcgctccttgtgaaccgggtggcccaaccccgggacgtagcgcccatcacggtgggcgctcgcgactgcgtcccgagcgatcgcatcgaagtccgacgcggtctgcggtgtctgctcggcacgggccaatgcgtcggcgagaaagcgaccggtatcctcggtgactccgaggaacctggagcccccaccgaggattcccgcagcaagcgccccctggatcgactccggcgcgctcaggagcgtcaaccgagctgcgatcgcggtgggggtgaagccgtggtcagcgagcgagaccaagcacgcctcgaacacgcggacctcgccagcgctgggtcgcctgccggtcacgagccagaaggccagctctccgaagctcaccgaacccatgagctcgcccgcgaggtcagccccgagcagggtgatcgcctcgggcgtggatacgccaatactggtcgggaactcgggcgtgctcaacggtcctcctccatcgggcgctggagccagtcccggatctcgtcgccgtgctcgtcatgggccggcggaggaaggtcatagcgtggcgccgtcttcgaatagatcaccgggtggcgcgtctggcgtacggcgcgcgacccctcccccaccacgatgacaggctcgagtccgatgcgctcggcgaaggcaacgccctcggccacggtgttgatcggtccgcacgggacgccgacggcggtgagccgctcaaaccacgcgtccgcactgtcgtgacggagttggtgctcaagcagtggccgcagctgttctcgatgagcggtgcggtcgtcggggtgggcaaagcgcggatcctgggcaagttcaggcacgccaaggacgtcacagagacgagcgaactggacgtcgttgccgatcgtgacgacgagttcaccctcagccgtcgggaacggctcataggggaacagactcggatgcgcgttgcccatgcggctcggcaccacgccgcccgcgacgtaggcgctggtctggttcaccatgccggacaacgccgaggcgaagaggctcgcctcgaggtgctggccctcgccggtcaacgtacggtgatggagggcggccagtatcgcgatcgccgtgtgcagtcctgtcatgacgtcgaacaccgaaatgcccgaacgcagcgctgggccgtcaggctctcccgtcaagctcatcaacccagacatcgcctggaccaccaggtcatagccgggcagttcccgcccaccctgactcgtgccaaagccgctgatcgacgcgtagacgaccgcggggttctcggccgcgacgtcctcgtaggcgaggccgaagcgtgccaatccaccaggcttgaagttctcgacgacgacatcagcacgacgtgcgagttcctgtgcgagggcacgatcgtcatcgtccttgaggtcgagaacgaccgaccgcttgttgcggttgatcgcaaggtagtacgtggacgtcccgtcggcggtgaccggaggcttccaaaaacgagtctcgtcgccggtcgggctctccaccttgatcaccgtggcaccgaggtcgccgaggagcatcgtgcagtagggaccggcgagcacccgcgagaagtcggcgaccaggaggccagcaagtggcccacgcccttggtcctggttgcgatcgtccacgcgaactcacctcgttgccacgcaccgcacgacgtcacgaacccgccgaactcggagtcgaccccgacgtgtccgtagatcggacgcctgtccgtctttgcgtggatactaaaggttcccggcggtgctgtcaagcgtccgggccgaatgcaagccgtcacgcaccgccaatggcgctgccgcgatccgagcgacgtcggcgtcgatggccttggcggtctcgatcagtctcgggagatggtgctcgagcaactcgtccagactggtctcggcagcatgcacgttcacgttgacagccgctaccaccttgccgtctggatcatggagtgcgacggcgatggagcgaatacccacggcgagctcctcgtcggtgagagcccagccccgctcgcgcacgttggcgagcacgcgccgcagctcctcgagggcaggggcacgacgcggcgtcaccggagagcgcgacggcacggccagggtgcgctccagttcgtcgtggtcgagatcggccagcagcaccttgccgagtgacgtcacggaagccggaaagcgcgtccccacggtcaccgcgattgccacgatctttggcaccgcaacccgggcaacgtagagcacgtccgaaccatccaagacagcgatcgaggacgattccctggtctcggccaccaactgctcgaggtgaggtcgcgcgacctcccaacgactcctcgcgagcaccgacgccgtgccgagatccagcaccctcggggtcagctcataacgcccgtcgtctcgttgccgaacgtaaccgagttcggccaacgtcgccaggatgcggtgggcggtcggacgcgcgagatgagctcgggtcgcgagctcgacgaggctggctggctcgccgcgaccgaacgcgagaaggacgtcgagaccccgggcgagcgactcgacgaagtcggggttctcgctgcgtctgaccaccgtgctccctctcgtccgagcccagagggagcctactcggtgcgcgcctgcacgatcgatgcgaggtccttgacgacagacgagcgatggtgcatacttgcgcatcaccatacggacacatgtccgaaactgcggaccagcagcgaccggtccagtgccgacgaagggagcgagcatgcgaaccagcgaagtcgtccgcgagccgatggtgctgcgcgagggactcgtcctcacgatgaatcgggcccacgacgtgctcgcctcgaccgacgtgctcgtccggaacggacggatcgaggcgatcggcccgcgcctcgaagtgcccgagggcacccgagagatcgacgctcgcggcggcatcatcatgcccgggatgatcgacacccaccggcacatgtggcagaccgcaatgcgtggctacggagcagactggaccttaacgcaatacttcgtgtggtactacctcacctggggcaagcggttccgtcctgaggacatctgggcagggaacttcctcagcgccctcgaggcgctcgacgccggtgtgacgaccacggtggattggtcccatggactccagaccgtcgagcacgccgaggccgccgcggacgccctcgaggaggctcccggacggttcgtccttgcctacggcaacattcaacaggggccatgggagtggacgaccgaccacgcgttccgcgccttcgtcgagcgacgtttcgggggcggaggcaccgagctcctcgggttccagctcgcgttcgacgtcaccggcgatccggcgttccccgagcgagccgccttcgaggttgctcgagatctcgacgtcccggtcaccacacacgctggggtctggggtgccaccaacgacgacggaatccgtctgatgcacgagcacgggttcatgacaccgcggaccatctacgtccacgccgccaccctgtcgccggactcctaccaccgcatcagtgcaaccggcggctgggcatcggtatcgaccgagagcgaacagagcgccggtcagggttacccgcccacctggcagctgcgacgctacggtatcggcgtctcgctctcgatggacaccagtgtgtggtggagtgccgacctcttcagcgcgatgcgagccactctcggcgccgaccgcgcgcgcgagcacctcgaggcgcacgcccgcaacgaaaccgtcaccaatcaccacctgcgtgccgagcacgtggtcgaatgggcaaccataggtggagctcgcgcactgggcctcgaccacctcatcggcagcatcgagatcggcaagcgcgccgacctcgtcgtcctcaagaatgaccactcgccagcgatgacgccgatcttgcacccctacggccacgtagcgttccaggcccagcgagccgacgttcacaccgtcatcgtcgacggggttctcgtcaaggacgaccatcggctcgtcggtgaccatctcgcccgagcgcgacgcggcgtcgacgagaccgtggcctacctcatgcaagagcttggtgacgaggcatggctcgaagggatgcatccggcgatcccggagctctcggtcctcgagaacccctatacctacaccgagtggcgcagcgagagcgcacgttggcgggaccgcggcggcccggacacctccgagcagaacgccgatggcggcacgcccaagccgccgtctgcctgacagagcccgatagctctgcccactgaggtgggcacttggccttcgaccgagaccaccggcttgggcgcaccagcaggtgcccatgggtcccccgtcgtctgctccagagtgcccacccggtggaccactgaccagagctgcgacgacaatggtccgcaagacctgcctgcaccgcgcagctccagacgtcatcgattgatgagcttgcaggaaacccgcggctggtatcgacggcctcgaggccgacggaacgacctcaccctccgcacgcggcagcccgctcgctccgacgagaggccgaccacccagcgccctgccatgaccgggagtctgcctgtcctcgctcggggcgaggtctttgtactctaccactatttcgaagctggagatacactgaggagcagcacaagcagaagggagacggtcatgctcacgatgcatcgtgttgcgctcgcagcgctcatggtcgcagcgggaggagcttcgctcaccgcctgcggatcgacgacgacctcctcgaagccgacgaccaccagtcccaccgcagcgatcaagaagagctacaccgacttcttcgccggcacgacgtccgccgcaacgaagatctcgctcctccagaacggcagagagttcgccgacatcatcgacggccaggcttcgtcgtcgctcgccaagagcgtgcaagcaaccgtccagaaggtgacgctcacctccgggacgaccgcacgcgtcgtctacaccctggacgtcggcggacagcccgcactgaagaaccagaccggcgaggcggtcaaggtcggtggccactggctcgtgggtgatgggagcttctgtggcctcttggcgctcgagggcgtgaagaacgtacctgggtgcacgagcaccgctggctaagaccgtgcatccgtcggcccgcgcacgagcgctggtggtgctctgtgcggtcatgtccctgacgttcctcgacaccacgatcgtcgcggttgcgctcgccagcgtgcagaccagcctgcacgctggcgtggcccagttgcaatgggtgatcggtggctatgcgctcgccttcggcgcgctgatgctgcccttcggagcgctcggggatcgcttcggtcggcggcgcgcgatgctcgtcggtctggcactctttgctgttggatctgcgaccgctgcgcttgcccactcacccgctcagttgatcgccgctcgcgtggtcatgggtgtcggcgctgccgccagcgagcctgggacgctctcgatcattcggcagctctacaccgagcccggcagccgcgcacgagcactcggcgtgtggtccgcagtagcggcactcgcgctcgccgtcggaccggtcatcgggggagtactcgtcgggattggaggctggccagcgatcttctggttcaatgtcgccgcgagcgtcgtcgtcatcgtggtcacggccatcgtcatccccgagagtacggaccccggtgtcgggcgcatcgactggggtggagcagcactcggcctgatcgccatcggtggggcgctcttcggcgtcatccagggcgaggcacgcggctatggcaaccctctcatcgtggcggtcttcgtcgtggccgccgtcggtttggccgtcttcagcgtccttgaggcacacgtgccgaacccgatgctcgacctgcactaccttcgtcgaccaggcttctccgggtcgctggtgctggcgttcagcgtgtacttctcgatcttcgcgatcttcttcttcactgccctgtatctgcagatcgtcgagggctacagcggctaccgcatcgcgtcggtgttcctcccgatggcgctcgccatgatcctgacctcgctggccaccggacggtgggtagcgcgcattggcgtcggcatgcccatcgcactgggatcactgctcgccggcctcggcgtgctcggtgccgacgtcggcctcagcggcagcacgcatccattggtgctcgccctctccctcaccgtggctggactcggcttcggcaccaccgtcgttccggtcacgagtatcgcgctcgccgtcgtaccgcagcagcactcaggcatggccgctgcgtccacaaacaccgcacgagccctcggcgtgatcgcgagcgtctcggttctcggctcgtacctcaatgcccagctcaccagtggccttggtaccaagctcgcccgactcggggtcccaccggtcttccgccacgtggtgatcagcgcggtcgagacgggcggcgtccccggtggctcgagcattgcggccgacaccaaaacgttcgggcctctcgtcgccaaggtcgtcacagctgcctacggagcatttcatcgaggtctcaccatctcattgatcatcgctggcgcgctcatcatcgtctcgggcgtcttgagcgccgtcgcggtgcgaggtgcgcggacgcgccccgacggcgagacgtcccaggcgtagtcgaggcccaaccaccgggcgaccccgagctgtgctcgaggccgcccgaagtgcgagctcaggccgtggtcgccgacgacgtcgtcgccgacgttccggtatgagccgggcacgggttggtggtcgtggatggcgtggtcgtggtggtcgtcggcgtcgtcgacgaactcagctggacgactgttccggtcgtcggtgcggccatcgactgcgcgatggcgaaaccgacaccgccaccagcgatcgccgctcccgcgacgccgagacggatcaggactctccgagacagggtcacgctccctctacctccttcattgtgtctgttgctggtgcccgcaggcacgccgatgggtcatcggcacccccatcctcgcgtatgggcctgggagcgagtccagctcgaccatggaagcaggcaagaggccacgcgcgactcgcgctgccttcgatcactctccgaccgctcgacgatgaagctcagccatggccgcggtagctcgctgcgcctgtgcataccatccgccccgtcgaagcagttcgtcgtgggtgccgtcctccaggatgcttccggcacccacgacgacgatccgatccatgcgctcggcactgtggaggcgatgcgcgatcatgaccgtcgtgcggccggcgccggcacgctcgatgccagcgtgcacgcgagcgtcgagctcgggatcgaggttcgacgtcgcttcatcgaggagcaagatcgcgggatcgatgaggacggctctcgcaagacacacgagttggcgctcccccgccgccagcgcgcgaccacgctcgcccacgacctggtcgtagccgtccggcagtgcagcgatgacgtcatgggcaccgacggctcgcgctgcggcctcgacgtcgtcgtcgctggcccagggtgcaccgaacgtgatgttgtcccgaatcgtgcctgagaagaggaacggctcctgggggacgtagccgacccggctgcggaaccacgcaaggtccaaggctcgcagatccgtgccgtcgaggcgcaccgcgccttgcgagggatcgacgaagcgaaccagcagcttcatgagggtcgacttaccggcgcctgtctcacccaccaccgcgacgtgctggcccgctgggatcgcgagcgagcagtcacgaagcgcggggcgctgaacccccgggtaggcgaaccacacccgatcgagttcgatgctccctcggatccgggtgggtcgactcgcgttcgggctggagcggatgctcggttgctcgtcgaggagcgagttgatcttgcgcagtccggccctcgctcgctggtacgcgtcgaaggtttgtgcgagctgttggacgggcgcgaacagctgcgtgatgtagagcaagaacgcgaccagcacgccgacttcgatcacatggccacgcaccagcccactccccacccagaggacaccggcggtcaccaccacactggtaaggtccgcgagggccacgtagatcgcctggacaccaagagcggtcaagctggcgttgcgataggcaatccccagccgtcgaaacgtcgcgagaccagcctcctcctgaccgagggcctggacgacttgcacgccagcgatgctctcttggaaatgcgcgttcaccgcggccacgtgttcgcgctgccggtcgtaggcgcgctgagcgatggctcgatacaccacggtcgcgaccacgagcaccggcacggcgaccagtgcgaccaacgcgagacgcggctcgagtgcgacgagcacgaccgcaatcaccacgaccgtcgcgatccccacgatggcactgaccaagccgttctggagcagctgcgacatggtctcgacgtcgctggtcagccgggtgacgagccgaccgctcggctcccgttcgaagacgtcgataccgagccgctgtaggtgcgagaacagtcggagccgcagctcgaagagcatcgactcccccacacggcccgtctggacagtctcggcccactgatcgatccaaccgatcaacgcgaccgcgaggagtccgagcgcggcgagcacaaccgtgatgccactgtgggcgagcatgcctccgtcgataccacttcgcacgatgagggggccgatgacccccgaagcggtgtcgatggcgacgagtgccaacgcgagcacgaggccgaagcgccagccggagagaaacgtgccgagtcggatgcgaccctcgccaggtggctgtgtccaccggggccgctgcggctcatcacgagtcggggggaggtgcgcgatgagctcgccgacccaaggcggcacgtcacccaggctccgagcagctgcgaggcgacgccgaccagaaccactcgcctcgacgatctgtcgcttgggggacaccgcctcgatctcgacatcagagccatccccaccatcgagaaatcggcgcacccacgacgacatcgcggcgacacgggcaaccgaaccgtcagcgacgacacagccctgctccaacaccaccacacgatcgaccaaggagacgacagaggcacggtgcgacacgacgatcaccgtcgggcgctctggcagcgcccggatcgacgcgatgatgcgctcctcggtcgtcggatcgatggccgaggtcgcgtcgtcgagcacgagcacgtgcgggcgcatgacgagtgcacgcgcaagcgcgaggcgttggcgctgacctcctgagagtgtcactccgccttcgccgatctgggtgtcgaacccgtcaggcaaggcctcgatgaactccagggcgcccgcccgtccacaggcctcacgaacctcggcctccgacgcatccgggcaaccgaaacgaacgttgtcgaccaccgtgccggccagcaggacgctctcctcgaagaccatgctcacgcggcgccgtagctcggcgagcgacaccgagcggacgtcgacgccgccaacgagcaccgcgccccccgagacctcggccaaccgcggcaacaacgtgcagagcgtggtcttcccggatcccgacgggccgaggatcgcgaccatctcaccagccgcgatctcgagatcgacccctgcgagcacttcgtgcgtccccccacgtagcgccgtgacgccccgtacgctgacacggcgagcgtcgcgtggaagtggcagtgggtgcggcacctcggtgatgccaggttcgatcgagaggagttggtcaatccgttcgaagcctgctcgcgcctgctggccgacgacgaggatgccggccaccatgcgcgcgggcgccgcgagctgcgtcaggtagctcgcgaaggcgacgaacgtcccgatcgtgacgtcgccgttcaacgcaagcagaccgccgagggcgagaatgcctgcctgcacgagctgcggtatcgcctggagctcagcggtgacccaggcgcgcagcctgatgttgcgaagcctcgacgcgtagagcgcacgcgcgccatcgacgaaccggcgtatctgcgacgcttcctgcccgaaggcgcgcaccacacgagctccgatgatcgactcggtcaccacggtcgtgagttcgccctcccgctgctgtgcgtcccagctcgacgggaagaccgtggagcgcagggttcgcgacgctaggaaggtggcaaccgggacgatcagtgcgagcagcatgagccagacgttcagcacgctcatgatgacgatcgacacgatcgcttggagaaccgcgccaagaaccatcggagcccacgccaggacttgttgaacgagaccgagatccgtcgtcacacgtgagagcagctggccgatctcgagaccttcgtgggtggcgagatcgagcgagacgaggtgcgcgtacacctcgttccggatgtcgagttgcacgtcgtaggccactcggccaccgatgaaccgtcgcaccagggtcgtgccaaaacgcacgataccgatccccactaagccgagcaccagcgcctcgatggcggcccgtcggcctccaagcccgtcgatcacggctcgttgcaccacgggaaccaacgccagcgaccccatcgacacggccgatgcaagcagggtcacggcaagcttgccacggtgccggcgaagccatggcgcaaccgctgcccacgagccttcggtcaccgacgtcgcgatcggacgggaccgctccccgcccttggtcatcctcaccgctctcgtgctccccgccgctgcgccccacgtgctggctcacatacttgtattctcccaccaccctagagcgatagcagcgcgatcacacctctccagggacctcatccgctaccacgagtccacccacgtggcctccgttgtgcgccgcgaccctcctctgtctcgggcgcggaccgcacggcccaaccaccgaactgccccaacgatacgagcaacgcccttggcggctgacgcgaccggtctccttggctcacaatccacagggttgtgcacacctgtgcacaaccctcttgttcaccttccgataaccctacgcctcgacttgagggtgggggtcgacgatgcccgacgcgatgcgatggagatcggcaagatcgacgaaccgaactcggatgtaccctgcgccactcttgctcacgtcgatctgcacatccgactccatgacgtccgcgagcaaccgctcgagctcgacgacgatggccggacgcagccgtgcctcgggcaccgcctccttggggccctgcgcatgctccgattcgccagcctcgaccctcgtcgcctcggccgcggggttcgagatcgcccgcaccgcctcctcgacgtctcggacggacaggccttcctcgaccgttctcctggccaactcctcctgcagacgacgatccgggcaaccgagcaaggccctcgcatgccccgccgacaacaccccatcgagcagcatccgctgcagcgcagcggggagctgcaggagtcgcagcgtattcgagacagccgcccgactcttgccgacaccacgagcaacctcgtcgtgcgtcagctggaaatcgtcgatcaactgccggtacgcagctgcctcttccagcgggttcaagtcacgacggtgcaggttctcgatgacggccacctggagcgacccgcggtcgtctcgatcttgcacgatggcggggatgcgatccaggccagctcgctgcgccgcgcgccaccgccgttcgccagcgatcagctcgtagccgtccgcgacccgccgcacgaggatcggttggagaacgccgacctcggcgatcgatgcggcaaggccactcagcgcctcctcgtcgaagatcgtccgcggctgcagaggattcggacgaatcgcccctactggaatctcgacgaggccatgctgctcctgctgaacgcctgttggaatcagcgcaccaagtccgcgccccaaaccggtctgcctagccatccttgcgcagctccgtcgccaggtcgcgataggcaatggcgcctcgcgagctcggatcgaacgtcgtaattggctgcccaaacgagggggcctcggagagtcgtatgttgcgagggatcactgtctcacacaccaagtcaccgcagaactccttcacgttggctaccacctgctcggagaggttcgtccgggcatcgaacatcgtcatgaccacgtgcgaaacacggagcgtcgggttcaggctctgctgcaccaatgtcacgttccgaaacagctgcgacaatccctcgagggcgtagtactcgcactggatcggcacgagcacctcatctgcggcagccaacgcattgaccgtcagcagtccgagcgacggcggacaatcaatgaagatgtagtcgtagtcgcctcggaccggctccaacgccctgcgcaaccgagtctcacgcgacagcaccgacaccagctcgatctccgcaccagcgaggtcgatggttgcacccgcgacgaacacattgcggaccccagtcgcctcgatgacgtcttccaacggcgtctcgtgcacgaccgcgtcatagatcgaccccgcaagatcccgagggttcaccccgaggcccgtcgtcgcgttgccttgcggatcgaagtcgaccagcaagaccctcgccccctgctcagccaacgctgcagcgaggttcacggctgtcgtggtcttaccgaccccacccttctgattggcgaccgcaatgaccctacccatggctactcccgcggacgtgttcgcctgcagttccacgtggaacttgacgcttcacggcaggctactcgatcacggctccaccccgcgccacagaccctccctccaccgtcacgttccacgtgaaactggagctgcagaccaaccacccacgccacgtcttccgtccgcaccatcagaccaaccctcccgggtctccaagcgcgcaacacgcataccaccccgccgccgctcgataccacatgaccgacggatcgaccatcgagcaccttcgaactccatgagcctgcctccgcctcacccgcgcccacccaaacccctcaacctggagcccccgtcgcagccggaaccacccgtaccatcgactccccgtgcgaccacagcttccacctggcggaccaacgccaacggccatcgacgacccccaccaaccagtacgtgcgactaccccaaacgcatgcacgtccggagcccagcgatcgatcacgcgagaacggtcaccccacagaagggcgagaggggagtgacaagggaacgagaggggagcgagtcctaggagccttctgaacaagcccctccctggtagcgactgatgccagccacccagcccgggaacgagctcagctgacccgtgctcgcccagctcctcaccctctcctcttcgtcccctcctcgtgggtgcggaggagagggcccgagcgtctctcaggtggcaagcacccagccaccacccactcgggtgagccccaggcgtagcagcaccttcaggttccaggtcgcacagagcagctcgaagtgcaggcggttgcgcacgagtccccggtagcgcagcctcgccccggagagcttgcgcttgagctgtgcgtggatccgctcgacgttcggtcgggtgcgctggtagtcgagacggacagccgggtccccaaagtgcgcccgctggctgatgccgtgccaggtggcaggggtgaaggtgaggacccgtccgcgcttcgatcgtgtgcagcgctcccggagcggacagccatcgcagtgcttggcgaaggaggcacggcccttcgcggaaatggggactcggtgccccgcaggacagctaacccatccctcctcgacgacgaagtcgtcgatcgtgaagccaccagggaccgccatagaaaggggccgaggcttgatcacctcgtcgtggccatgagcggcaagctcgttgaagacctcgctcgtggcgtaggcgctgtcgccatagaccgtgcgtgggccgtcctcgtcaccaaggagctcgggcacgacctgtgcatcaggcacgctacccgtcgtgatggtcgaggcggtgacgatgccgctgtctggctcgacggccacgtggcccttgtagccatcgatggcacgggcacgggacttgtgcacatggcgagcgtcggggtccacggtggagatgaccctgtcgcgggccactcgcctcgcgatgcgccagcggcctgcggtggcatctgtgcactcgacgtcctggcccgccacgagcccaaggaggcccagggcctcgcgctggggctcggtgagagacgcgagcttctcggcctcggcgaggtgggcggtggcatcggcgacgagggcgctcaccgtgcgcaccactgcttcttcgtctcggtagtcgatggcaggctttggacgggtgtagtcgatcgctggtgacagaggaacttcgcggagctcggggatcagcctgcgtacccggttgatctgagcgacgagttgggtcatggtgtcttgggtcgcgaccgcatcggcgagcacggtggagtcgacgacgcgcttcgtcgtgcccttgagcacccccgtggcaccgatcacctcggccacgagctcggtgatgagtcttggggtctcggaggtggcgatgcgcctgcgccagtaggtgagcaccgtggggtgaaaacctgggtcctcgaggtcgagaccgagggcgtacttccagcgcaggttgtagcggacctgctctgtcgcctcggtgtccgagagcccctcgagcacctggagcaccatgaccgcgagcaccctcgaggcggggatggagggtctgccggtcgtggagggatagaggtggcggaagcgctcgtcggggaagagctccctgcggtgctcggcgaggaaggcgtagatggaccctggctcgatgagcgaggagcagaaggcctccgtcgcggtgaggtgtgcctggtctgattcggtgcccaacatgcaaaaagtctagctgagctgggcaaatggcgctgggcaggaggggaggagcgccgtgcgtcgccgcgctacgtggaggagttgttcaggaggctcctagaggcctacggccacctcgcacaccgatcacgggtggaccacagccgcgacgctcccagacgcctctcgatccatgcacggctgctcgtcggtgcccatcgccacaggacgggcggaccgccgccatcacgtcacacggaatcgcgccgaaccacgcgcagctcgtcccggaatgccgtcgtccgacatcggccgcacacgccgctcgcgatgaccctcacgatccgactccctgcgcagagctgccaacgccgagcccaggcatcactgacctggcggaccaccccaacggccacggtcgagaacgccagccacgacactacggacaccaccagcgccaactccagcgaccaagcacgcgcctacgccacgacgccgatgcgaccacgtgcgatcggtgcgtgccgacctcgagttcacccacctcaccgaatgcccacagcagctgatcgcccgcaggagctggccacaccaccacgtgctgccggagccagtgtgacttgccgacgagaccaacccaccgttcctcaccgaccgtcgccccgcgctccagcaagcaggcacgccacagctcgcgaggccgctctctcggcacgcaccacccgcacgtcagcgcacgacccccgaggcaatcccgtgggcggctctcgtcgacgatcgagtgccagcatcgaggcacaccgaggcaatccacacaggtccccaaccagccgcccactcatacgtcgtcgcgcccgacccgcagtgtcgtcgaggaacgctcctcgctccacaacggtcgacgctccggtatcccggagcgtcgaggatactgtcccgcgagcggtgctaccttgcgcagcacagtgaagtgtggggggcccaccaccacttcagccacgacgagaccgagcctcgcgagctgctcgctggccgaccaacgccgtccagccccctcaggtggatcggagaccacgatgacgcctccaacgcgaacgaatccgctaccgatctcggcggtgaccggcggagctccgaatccacgagcgaccacggcgtcagcccgttcacgaatctccttcgaccttgcgagcacctcgccccgctcagcggcgattcgcacccgagccgaccagttcaaggctcgaaccgcctcggtgaggaacgccgcacgccgctggcgagcatcgaccagcagtccttccgatgcgggtagctcgagcgcgacgatcaggcccggtatgcctccgcccgatccaagatcgacccatcgctcggcaccgtagcgacgcacgagcgcagagaaggccctcgaatgttcgagggccttctctgtgggctcgcctacgagaccgagctcgtgggcccgatcaatccactgctcgaccggcagcatcgacggactcggcggccgatggtgctaccccgacacggaagatcacaacgtagcgatccggttcctcaccctctgaacgcgtcccgacaccgtcgatctcggccaccacgtcatggatcaccttccgatctgcggcgctcatcggctcgagcacgcgctcttcgccagtcgtcagtgcgacctctgcctgctctcgcgcgaagcgctcgagcgcgacccgccgtcgctcgcgatagccggcgacgtcgaccgccacccgtcccacaccctcgccggcgatggcctgcaacacactgcgcgtcagctcttgaatcgcgttcaggacactcgcccgtggccccacgaggaccccgagcccatcgccctcgatgtcgagactcatctcttcgtcatcgaggttgctgacgcgaacctcgcccgtcagcccgaactcctgcatgagcccggccaagaaggcctgtgctcgcgcggcaagctccacacgcgagaggggaggagttccctctgccgccggggcttcggccgtctgttgttcgtcgttcatcggagcatcctctgtttcgtctcgcctggtaccagccccgggccgcgcgtcaacggcccgatttcgtcgtccacgacgccgatcacgctttggcatcggaagcttcggccgaagacgagctcgaacccgtgcctctctccgtccgaacccgagaaaacttgctcgcccttcgtcgaggacctcgaactcgacctcggcgtcttccacgccgagcacatccagtgcttgctcacgtgcctcttcgacagttcgtcctgtcgtctcgatccaatccatgctctgactcctagcgattcgccggtcgccgttagcgacgacgccgaccacggcgacggcgatagctgttcttcgaaccctgctgcttgttcttcgctggccccggtggggtcgctggaccgtcggacccgccctcgaccgccgacggcaaccccttcttgccgccaaggaagccaaagataccgccacctgcgggagctgtcggactcgccgcaccgttaccgcgctgctctgcgacccgacgtctcgcctcgaccgagtgcgcacgaaggaccggatcacggcgccacatcacctcctgctgggcgacgcggaacaacccggaaaccaggaagtacacggcaacaccggcagggacatcgaggtagatgacaccgaagacgaccgttgtgagctgttgggtcagcagcgccgatcggttcgccgcggccgccgtgggattcttcgacgcaatctgctgaatctgcaggtactggataccgaccgcgatcagcaccagcacgtagtaggggagtgcgtgcacgaaaccgacgtgcagatgcaagggggtcagggccaggttgatccccacaaagtccatgtgcccgcggtcggccaccagattcttgtagagcttgctggcgtgtgagatgtacaacggcgctgcgacgatggcatgatgactcgtcaccgtgtgtgtcaggccacggatgacgtcgtacatcacgaacagcagcgggaactgcaacagcatcggcaagcaaccgccgagcggcgaaacgccctcctccttgaagagtcgctgctgcgcttcggcgagccccgcacggtccttgccgtactggcgctgcaactccttgagcttcggctgaatcgcttgcatctgcagcatcgaccgcgtggagcggatggtcagcggcgacagcgcgaccatcacggtcaccgtcagcagcgcgatcgcgatgccgtagctcgggatgatggcgtaccagaaggtcacgatccccgcgaggagctcgaacaacgggcggaagatctcgcccagaacacttgcgacgatcatgcgtgcgttacctttccggaccgtcgaggtggaacgggatcgtaccctgagcccccgaacgggttacagcgacccactcgtttagccgccaaccagcttcccctcgccaagccgtgcaactcgactgcctcgtacgcgtactgagagcagctcggcacgtagcgacacggcgatggacgaccacgccgtgcgacctggtaggcgcgaatgaggcccatgccggcccgacggggaagcgcacgtacgcgcgccacaaggctcacgggtcctcccgggggaactcgcctaggtgctccagcctagtgacatccgcacgaatggcggcaaaggaggcgtcgagcttcccttctctcggcccgatcaggtagctgccgggtgcgacagcgctgacgcgcaaggcctcgcgaacccggcgccgaaatcgattgcgctcgaccgccgtacctgctcggcgcggtatggcaaacgcgacacgaactgcggcgctctgctcgtcgcctgacacggtctccgtcggcgcgaccacgacccacatggtgccgagctgatagcgccgacccacgcgccggagacgatggaagtcctgccggcgggcaagccttccgagccgcacctacgccgacagccggtgacgccccttgaggcgccgagccttgagcaccgcacgaccggctctcgtcgacatccgcgcgcgaaaaccatgggtgcgcgcacgacgccgattgttgggctggaacgtccgcttcatcgcctgatcaccttccttgtcgagccccgcagtctaggagttcgaggagtcgaggccaacaccctgcgaggcgagcgaacgtgccctatgat

SEQ ID NO: 2 - DNA, 17 bp, Artificial Sequence
  Synthetic construct, Bact-338F1 primer
cctacgggrggcagcag

SEQ ID NO: 3 - DNA, 18 bp, Artificial Sequence
  Synthetic construct, 909R primer
ccgtcaattyhtttragt

SEQ ID NO: 4 - DNA, 20 bp, Artificial Sequence
  Synthetic  construct, acd320f primer
cggtccagactcctacggga

SEQ ID NO: 5 - DNA, 23 bp, Artificial Sequence
  Synthetic construct, 423r primer
gacagggttttacagtccgaaga

SEQ ID NO: 6 - DNA, 20 bp, Artificial Sequence
  Synthetic construct, acm342f primer
gcaatgggggaaaccctgac

SEQ ID NO: 7 - DNA, 20 bp, Artificial Sequence
  Synthetic construct, 439r primer
accgtcaatttcgtccctgc

SEQ ID NO: 8 - DNA, 551 bp, Acidimicrobiaceae bacterium A6
  misc_feature (1)..(551): FMO gene
accgactggaaagaccgtcgtctgtgggtaactgttgcaccgatcgttgctgtaactttcatcgtggctgttactttccctgcagctgtgcaagcttgcttgtggggtcgttaccgcatgccttggggcgcgactgtttgcgttctgggtttgttgttcggtgagtgggtcaacagatacttcaacttctggggctggacatatttcccagttaacttctgcttcccttcacaattgattcctagcgctatcgttctggatgttgtgttgttgctgtctaacagcttcaccttcaccgctatcgctggcgcaatgggctggggtttgattttctacccaagcaactggccggttatcgcgccattgcacgtgccggtagaatataacggtatgatgatgactttggctgacttacaaggttaccactatgtaagaaccggtactcctgagtacatccgtatcccttcgtcaaggtcgaagctccctacgatgaagtgaaggagtttattgaaaagctctgggacgtctggggagagaacgggaacaaccgt

What is claimed is:

1. A composition comprising: an Acidimicrobiaceae Feammox bacterium A6 having Accession Deposit Number PTA-122488, a carrier and wastewater, wherein the bacterium is capable of oxidizing ammonium coupled with reduction of Fe(III) to Fe(II), the carrier comprises a medium for culturing the bacterium, and the wastewater comprises an ammonium containing contaminant and at least one more contaminant selected from the group consisting of: halogenated organic contaminants, chlorinated volatile organic compounds, perchloroethylene (PCE), trichloroethylene (TCE), trichloroethane, dichloroethane, vinyl chloride, polychlorinated biphenyls, fuel constituents, benzene, ethylbenzene, toluene, xylene, phenanthrene, methyl tert butyl ether, tertiary butyl alcohol, polyaromatic hydrocarbons, and ethylene dibromide.

2. The composition of claim 1 further comprising a source of ferric iron.

3. The composition of claim 2, wherein the source is selected from the group consisting of: a ferrihydrite, a goethite, a scrap iron, a nontronite, and an iron-rich clay.

4. The composition of claim 1, wherein the medium comprises ammonium and iron oxide and has an acidic pH.

5. The composition of claim 4 further comprising $CO_2$.

6. The composition of claim 1 further comprising $CO_2$.

7. The composition of claim 1 comprising at least $10^4$ bacterial cells per milliliter of the composition.

8. The composition of claim 7 comprising the bacterium in the concentration in a range from $10^4$ to $10^{10}$ bacterial cells per milliliter of the composition.

* * * * *